United States Patent 9,315,822 (GENES AND USES FOR PLANT IMPROVEMENT) - sequence listing, part 3

SEQ ID NO: 8554 - protein, 370 aa, Deinococcus radiodurans R1
MTSPSSTATSSPTTTTAPTPARMRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 8555 - protein, 331 aa, Synechococcus sp. WH 5701
MAIAMGINGFGRIGRLVFRRSFEIEGIDVVAINDLIDLEYIAYMLRHDSTHGRFRGEVETRDGQLIVNGKAIRVTSERNPADLNWGAVGADVVLESTGLFLTDASARAHIQAGAKKVVLSAPSKDDTPMFVMGVNHHTYAGQDIVSNASCTTNCLAPIAKVLHDNFGIRDGLMTTVHAMTATQKTVDGPSAKDWRGGRGAGQNIIPSSTGAAKAVGKVIPSLNGKLTGMAFRVPTPDVSVVDLTVNLERPASYEAIKDAMKAAAAGPMAGVLGYTEAEVVSSDFLGETCTSVFDAGAGIALTDTFVKVVAWYDNEWGYSCKCLDLIRHISA

SEQ ID NO: 8556 - protein, 415 aa, Pseudomonas aeruginosa PAO1
MKAVVFHDIGDIRLEDVAEPRLQEPTDAIVRLTASAICGTDLHFVRGSVGGMRPGTILGHEGVGIVEALGDEVRNLQVGDRVVIPSTIACGNCVYCRAGYYAQCDVANPGGSQAGTAFFGGPRANGGFHGLQAEKARIPYANIGLIRLPSSISDDQAILLSDIFPTGYFGAELAGIAPGNTVAVFGCGPVGQFAIASALLLGAARVFAIDRHPDRLHMARQQGAEVIDFEREDPVQALRWLTAGIGVDRAIDAVGVDAEHSHGTATPAPRQEGTSWSPGNAPAQALEWAVQGLAKAGTLSIIGVYAEDSRQFPIGLAMNRNLTIRMGNCHHRKYIPLLLEHVLSGRIDPAKILTQVKPIGDAIEAFEAFDRRETGWIKVELVPQKRQVEGSEERLDERAVDELARRPTPESGARG

SEQ ID NO: 8557 - protein, 1010 aa, Glycine max
MRVLVLLMLFLHSLHAARISEYRALLSFKASSITNDPTHALSSWNSSTPFCSWFGVTCDSRRHVTGLNLTSLSLSATLYDHLSHLPFLSHLSLADNQFSGPIPVSFSALSALRFLNLSNNVFNQTFPSQLARLSNLEVLDLYNNNMTGPLPLAVASMPLLRHLHLGGNFFSGQIPPEYGTWQHLRYLALSGNELAGYIAPELGNLSALRELYIGYYNTYSGGIPPEIGNLSNLVRLDAAYCGLSGEIPAELGKLQNLDTLFLQVNSLSGSLTSELGNLKSLKSMDLSNNMLSGEVPASFAELKNLTLLNLFRNKLHGAIPEFVGELPALEVLQLWENNFTGSIPQSLGKNGRLTLVDLSSNKITGTLPPYMCYGNRLQTLITLGNYLFGPIPDSLGKCESLNRIRMGENFLNGSIPKGLFGLPKLTQVELQDNLLTGQFPEYGSIATDLGQISLSNNKLSGPLPSTIGNFTSMQKLLLDGNEFSGRIPPQIGRLQQLSKIDFSHNKFSGPIAPEISRCKLLTFIDLSGNELSGEIPNQITSMRILNYLNLSRNHLDGSIPGSIASMQSLTSVDFSYNNFSGLVPGTGQFGYFNYTSFLGNPELCGPYLGPCKDGVANGPRQPHVKGPLSSSLKLLLVIGLLVCSILFAVAAIIKARALKKASEARAWKLTAFQRLDFTVDDVLDCLKEDNIIGKGGAGIVYKGAMPNGDNVAVKRLPAMSRGSSHDHGFNAEIQTLGRIRHRHIVRLLGFCSNHETNLLVYEYMPNGSLGEVLHGKKGGHLHWYTRYKIAVEASKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDPRLPSVPLHEVMHVFYVAMLCVEEQAVERPTMREVVQILTELPKPPSSKQGDLTITESSLSSSNSLESPTTASKEPKDQHPPQSPPTDLLSI

SEQ ID NO: 8558 - protein, 530 aa, Burkholderia mallei ATCC 23344
MTDLATKPTPAASHGTLPRILPVILAGGSGTRLWPLSREHHPKQLIDLIADESPLSATARRLTGIANAELADTLLLVCGEQHRFTSAAQVSARGLDVRILLEPAARNTAPALTLAALEALAHHGDPVLAAMPADHAVSDTRAFQETIALAARYAQDGAIVTLGVLPRRAETGYGYIKVGAPLAGANGDTGGYAIDSFVEKPHQELAQQYLQSGDYWWNSGIFVVRASTWLAAIRALQPDMHAACETAWRGGTSEGAFFKADAAAFAACPSDSIDYAVMERLTGARALGIPGVIVPLTAGWSDVGSWDAIWELLPKDEAGNVARGEVLFEGTEDSFARSEGRLVACVGLKDVVVVETPDAVLVANKHRVQDVKTVVARLKSGRHEQVRDHRKVQRPWGYYDSIDRGERFQVKRIVVDPGKQLSLQMHYHRAEHWIVVRGTAKVTRGDETFLLSENESTYIAVGAVHRLENPGRIPLEIIEVQSGDYLGEDDIVRFDDRYGRASAQHAPDAAKPADAERAPAAGPARALGAQ

SEQ ID NO: 8559 - protein, 173 aa, Triticum aestivum
  misc_feature (139)..(139): Xaa can be any naturally occurring amino acid
  unsure (1)..(173): unsure at all Xaa locations
MLQGSGISNQKTLYEVLSVPEDATYDEIRAAYKCAALNTHPDKAQATLEPSVSTGEQHGFFSVQKAWETLRYPKCRAEYDKQLQSSRQSLDVIATDIEIEDMIVESSGDGVELLYACRCGDYFSITACELGEMGISVSXDGEIEAQAPDSLPTSVVLGCGSCSLKTRLIINKA

SEQ ID NO: 8560 - protein, 336 aa, Triticum aestivum
MIEQVCTKKQAGTDRSIPSARPVCQPPTTPSPTPNSIRSPAAAPLSYSPMAAAPPQPAAPAPGPANGGDAFRLGFVGAGNLAESIARGVAASGVLPASAVRTAPHRRPERGAAFASLGATILASNAQVVDGSDVIVISVKPQIVKQVLVELKPLLSEEKLLVSIAAGIKMKDLQDWSGQRRIIRVMPNTPSAVGQAASVMCLGETATEKDENRVKSLFSAIGKVWTAEEKYFDAVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 8561 - protein, 263 aa, Haemophilus influenzae Rd KW20
MARRPLVMGNWKLNGSKAFTKELIEGLKAELHDVTGCDVAIAPPVMYLGTAEAALSGCGCSCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 8562 - protein, 157 aa, Triticum aestivum
MHCAKNSDLHVYAPQIEETIDVTSDLCAYKVQLSEKLMSNVLSKKLGEHEIAWVDSGVGKVDEKLTLLPPSSTPAAHKSVLVGDLKLADFKQFLANKGLQVEFAGGALRCGEYITVRKIGDSNQKGSTGSQQIVVEGPLCEDYYKIRELLYSQFFLL

SEQ ID NO: 8563 - protein, 254 aa, Bartonella henselae str. Houston-1
MSPNIRPFIAGNWKMNGTGESLGELRAIAAGISSDLGRLFEALICVPATLLSRAFDILGGENILLGGQNCHFDDYGPYTGDISAFMLKEAGASHVIIGHSERRTVYQESDAIVRAKVQAAWRAGLVALICVGETLEERKSNKVLDVLTRQLEGSLPDGATAENIIIAYEPVWAVGTGNTATSADVAEVHAFIHHKMHSRFGDEGAKIRLLYGGSVKPSNAFELLSTAHVNGALIGGASLKAIDFLTICDVYRKL

SEQ ID NO: 8564 - protein, 427 aa, Cryptococcus neoformans var. neoformans B-3501A
MSVDTPTSEKLDQAASVFDKDPTTAERLYKEILQDDSQPGNEDLLRDKEVALIKLGTLYRDSSMLDKLSQLITDSRTFMSHIAKAKTTKLVNSKVRTLLDLFPQDSKDMQMKVIQENIDWARTEKRVFLRQSLEIKLINVLLDAEKYQEALTITQTLLKELKKFDDKIILTEVYLLESRAAHHMHNHALAKTALTSARTTANSVYCPPTLQAQLDLQSGVIMAEDKDYKTAYSYFFEAFEGFCQSAERDNRALSALKYMLLCKIMIGSPNDVFSLLSLKSAAPYIGKDVDAMKAIATALEERSLDLFKTALQNYSDQLQKDEIIRSHLSYLYDTLLEQNLIRVIEPYSAVELSWIASEVGQSLQVIEDKLSQMILDQKFCGILNERMGTLEVHDDYSNEGICSMALGTLKHISDVVNGLNDKAAQMV

SEQ ID NO: 8565 - protein, 434 aa, Bacillus thuringiensis serovar konkukian str. 97-27
MVYLNDKLSETKVFKDPVHKYVHVRDRVIWDLIGTKEFQRLRRIKQLGTTFFTFHGAEHSRFTHSLGVYEIIRRMIDDVFDGRPNWNAEDRLLCLCAALLHDVGHGPFSHSFEKVFSLDHEKFTQKIIVGDTEINRVLSRVDKDFPQKVADVIAKTSNNKLAISMISSQIDADRMDYLLRDAYFTGVKYGNFDMERILRVMRPYGNQVVIKNSGMHAVEHYIMSRYQMYWQVYFHPVTRSAEVILTKILHRAKSLHEKYYTFKNHPVHFYSLFEEEVTVEDYLKLDENVMYYYFQVWQDEEDPILSDLCRRFMNRNLFKYVEFTDKHGLDNWMELSSLFKKIGLDPEYYLVVDSTSDLPYDFYRAGEEEERLPILLLMPNGELRELSRESDIVEAITGKKRRDQKLFYPHDLIYEDGRKGKYKERIIELLEGKK

SEQ ID NO: 8566 - protein, 596 aa, Candidatus Blochmannia floridanus
MMNDNKYIHIDSCVIEKHKIWDSLITKFGSHDLILQSAYIDSLIIWIPKERIIPIMEFLKQILAPHVMLYDLHGIDERLRMYRKELPEADFTVFYHIMSMSRNYDVILKVPLLENAMNVTTITSVFMNANWYERETWEMFGIHFDYHPNLTRIIMPKCWKGFPLRKEYPARATEFYPAFTLTRKKEDLAMDDLLFKPEEWGMHRNNKHEDFMFLNLGPNHPSVHGVFRIILQLSGEEIIDCVPDIGYHHRGAEKMGERQSWHSYIPYTDRVEYLGGCINEMPYVLAVEKLAGIVVPDRAKIIRIMLSELFRINSHLLYVSTYLQDVGVMTPVFLAFTDRQKIYDVIESITGARMHPAWFRIGGVADDLPLNWSDLLKQCLDWLPKRIAFYIDIALKNSIFKKRTCGIGSYGAKEALSWGVTGSGLRATGIEFDLRKSRPYSGYENFDFDIPIGNGLSDCYNRLVLKIEEMYQSIRILNQCLKNMPTGPVKSDHPLTTPPMKKYALKHIETLITHFLQVSWGPVIPPNESLQMVEATKGINSYYLISDGNTMSYRTRIRTPSFPHLQQIPSVIRGSLIPDLIAYLGSIDFVMSDVDR

SEQ ID NO: 8567 - protein, 149 aa, Arabidopsis thaliana
  misc_feature (59)..(59): Xaa can be any naturally occurring amino acid
  misc_feature (63)..(63): Xaa can be any naturally occurring amino acid
  misc_feature (80)..(80): Xaa can be any naturally occurring amino acid
  misc_feature (82)..(82): Xaa can be any naturally occurring amino acid
  misc_feature (102)..(102): Xaa can be any naturally occurring amino acid
  misc_feature (138)..(138): Xaa can be any naturally occurring amino acid
  unsure (1)..(149): unsure at all Xaa locations
MASSMLSSAAVATYPAQANMGAPFTAMKPCASLPDTRKANNDITYITCNGGRASRMKGXPPIXKKTLETLSYLPDLTDYXIXKEVDYLLHNKWITRGEFQMXHGLEYREHGNTPGYYDGRDWTIAKLPLFGCTDSAQXLNEGEECKNEY

SEQ ID NO: 8568 - protein, 388 aa, Hordeum vulgare subsp. vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 8569 - protein, 564 aa, Oryza sativa (japonica cultivar-group)
MSVLIVTSVGDIEVDLHTDMCPLTTKNFLKLCKMKYYNGCLFHKVEKDFLAQTGDPTGTGAGGDSVYKFLYGDQARFFDDEIRPDLRHSKKGTIAMASAGENCNASQFYITLRDDVDYLDDKHTVFGMVAEGFDTLTKISETYVDDKGRPFKDIRIKHTYVLDDPFDDPPQLSELIPENSPVGKPQDEIAEERLEDSWVPMDEMVAPEELEEMIRSKEAHTNAVILESVGDIPDAEIKPPDNVLFVCKLNPVTQDEDLYTIFSRFGTVTSAEIIRDYKTGDSLCYAFIEFETKEACERAFFKMDNCLIDDRRIHVDFSQSVSKLWGQFRQSKRNANKDGCFKCGAPDHIAKDCDQGTEQKNKGPSYVLKDENTQRGGNNRRSYDLVFDEDGENYTDQQDPGSTGRRKIQRTDDRKSGLPPRGDHDRISRERTHSDENGREGGKEGDRDRGIRKHEDYHRYNKSGERSSSRYDDRGYSKHESRGKYRDGNDDYRRQPGGGSRYGRDKYEGERRYREDDGHGRSDRHKRDESDNRKRSPDTGKHRREDGGHRETSKHRERRQRDDR

SEQ ID NO: 8570 - protein, 404 aa, Ralstonia solanacearum
MMSRHTELNRHLAAAQPSATYRVIDRVAARRASGAEVISLSAGEPDFDTPAHVREAGIEAIRAGMTRYTQVAGLRALREAVADKFRGENGLAVGWQDTIVCSGGKQVIYNALAATLNEGDEVVIPAPYWVSYPEIVQLCGARSVIVPCGAESGFKLTPGALEAALSARTRWLILNSPSNPTGAVYTAQELRALAEVLLAHPDVLVLSDDIYEHLIFDGARFHTLAQVEPRLQSRVLTMNGVSKAYAMTGWRIGFGAGPRWLLEAMEKLQGQQTSGACSISQHAAVAALRGPQDFIGASRAAFERRRDLVVGMINAVPGMRCETPAGAFYAFASCDGLIGKTTLDGTLLRSDEDVSNALLDERGIGVVPGSAFGLGPYLRIAYAIDDTALRTACTAIDTFARSLR

SEQ ID NO: 8571 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 8572 - protein, 1870 aa, Neurospora crassa
MSGLENGDVALANMTNAPDPVAAAEPYAILRQEVELDINFREKSVSGICTFKIYPLVPDLEELVLDTRQCEIDVSNITVDGYKTRAQAHDPYDRMEPPTNAQIGATQHHIMKKWMAPLLPETRRQAPIVERAEQLNISVPADGSLRIRLRPDALIQDSEPKRILKIKTPKSVSENATGLSDPNEELTVVVPFRSKRIRDGLHFVGVEEGDLRYPHVYTRHSLEPGTASCIFPCLDDPGSRHSWTIKITCPRTLEDAFAPPLATQSALLTALDGGRKRKASDISAHQPGSSFTEEDKLREITVVCSGNLIGEQMHPKDERKKTMIFECVNTAARHIGFAVGPFEHVDLGAEFRTEEADEKLGANAARIHGYCLPGRVDEVRWTCQAVVAAADYFAPEFGRYPYEAYKMCFVEDLVHDTAVANSLSLCSTRLLYPETIIDTDIEVTRKLVHALASQYVGVHIVPNERSDTWLIIGLQWFMTDLFMRTICGNNWYRFHIKSLSDKLVEADVRRPSLHALGDYLHLGDFELEFMALKAPLVLYILDQRMSKIPGSTGVVRVLSQMVSAANISNTDPKATTLSFQDFRRWCEKRSQYVPDELWNQYVFGAGCPRLDIHQKFNKKNLNVDIQILQYQGPTKKSISKDEFWRELQEEIHQVYAGDVPKLFTGPFTVRIHEADGTPYEHYQLITEKDKGGTNLQIAYNTKYKRLKRTKKAMAAAANSNSDKHEIQEDDVVYFNMLGDVLTSQKDMEDWGLQDWASEVQTKMDQESYEWIRLDANMEWLCFMKTDMQEYMYLAQLQQDRDVVAHQDAMLAFKREKRHAVHSTIETRTVMDRRYYHGVRVMALEDLAKQAHPDLNYIGMVHLILCFRKFFCKKVPIPGREGGYHYPIAPNDFTDKGQYAIQCAIPAVLARTTDLQEKGRCSKRARQFIMEMLLFNDNSENEFSDQFYIAKLLDALTTSVIPQKEITEGYLIKNLDPFDEDDAEFKSFIEKTIEEIDKFRRMDEWTLTYQNIWTTTALHCKMRLMKARVIPESALDFVQYLQDDNIDLVRIKAFECLVELGMISKPPILKLLLSYMSTDSSPFIRDRLFKVFCRGIAAIAFGENKASTQELEALNDGGLVIDQGDAEIQQRKLDAVRREDIAHALNALKEELRGNTEMQISIWKAFNSPVIGLQEKRQLLELCSAMFEPEDSLLVTIKYPIVWKATRDPTIVATAPQILGTPPKKRCVVKFKSEYRTLPKSKDMVAIEAPPPPAPLPAPTPSTNLSASRVEIKPPEKKTIVKLQSRPSYIAKPRESPVPEAPPPVRKDSIAMTVPPRPSTTAGPRTPLPTSVPSAPAPNTSAAQPSIKTAVPKAASPPPVPAPKPQQSNDVAVPRPSTVNLGKPKIVKPVIKRKSDESFENPSPKKIIKTNSDSFRSDPSRNSSFKTEPPRSESFKKEAPRSEAIRGHSFRESAPQIPPPRTSSFSVRPNANGQPSKVVTLPFRKWTKLSARAQRSIDYEQSQREKQMLAASARGISGSLATPVHKRSSAAVGFGSGSAPSSPKSRMQSPAGNGYGSSGSYAEKEQRNKERDRDRERDRDRERDSSSKFREKDRNDHDRERYRGGAEREKEKYRERERDRESDREHERPREKERDREKYRERGDRDSDRERDRPREKYREKGTDRGDSDRGGRTTDSDRERNRIDRDRDRDRERERERSDRDRERTDRERERIRDKYRDRADRDSDRDRDSYKDRDRERDRDRDRDRERDRGDRGDRGDRDRDRDRDRDRGDRDRVSSSGSSLLIKKDRKPLPGSGEKERRPLPTGAPHEKAPHPLKESHSPIHPTPAATTNGGEPKKKIIKLKLKSSGSGLGGGSGSSSTPGAGGGSGSR

SEQ ID NO: 8573 - protein, 157 aa, Zea mays
MQASRARLFKEYKEVQREKSADPDIQLICDGSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGYQSMARMYTRLAAMPKKG

SEQ ID NO: 8574 - protein, 466 aa, Synechococcus sp. WH 7805
MTSRVDSPKPGLTISVQGEDLDQQGRGIARWNGWVITVPELIPGEDASVQLLQRQRRLWHGKKIKSIKPSPDARRPPCILAHACGGCTLQHISVNAQNQWKQEHLKATLLRIGGVTTLAGPLISPEDESLGYRNRALIPIQRGEGGLRLGYYRRGSHRIVNLNHCPVLDPRLDALIEPIKNDLALTDWPMDSDLRGEPGLRHLGLRIGVRTGQILISLVAATDHLPGLDRLTAEWMQRWPQLKGVTLNVQPKRSNTVIGEQTLCIQGDDVIEENFCGLSLQLGTTTFFQVNTTRAEQVVTMICDWIHASAPSANVIDAYCGIGTIALPLAASGLNVVGLEINRDSVIQAQENAQRNGLEKVCFLDGDVAEHLEQLLPHHQALVVDPPRKGLAPAVLQMILAIPPAFLIYLSCDPATLARDLQQLAGPDGPYRIEQIKPVDFFPQTSHLECLVMMIRVSSAVPPRTA

SEQ ID NO: 8575 - protein, 435 aa, Coxiella burnetii RSA 493
MVDHSAALFNKAQNYMPGGVNSPVRAFGAVGGVPRFIKKASGPYLIDVDEKKYIDYVGSWGPMILGHAHPAVIQAAQEAVQNGLSFGAPCENEIKLAALIGEFMPSIEKVRMVNSGTEATMSALRLARGVTGRSKIIKFEGCYHGHADCLLVNAGSGALTFGMPSSPGVPLGTVQDTLTATFNDLDSVAALFEKYSKDIAAIIVEPIAGNMNLIPAAPDFLTGLRELCNQYGSLLIFDEVITGFRVAKGGAQSLYNIRPDLTALGKIIGGGMPVGAYGGRREIMNQLSPEGPVYQAGTLSGNPVAMAAGLATLKELTAENFYSNLKEKTERLVMGILSRAKAAKIPLTANFSCGIFGLIFTSEERVTRYAQAVNGNVEHFRSFFHKMLDNGVYLAPSAFESGFISAAHTNKEVDNTLDIIENIFSVSETYLRISV

SEQ ID NO: 8576 - protein, 426 aa, Salmonella enterica subsp. enterica serovar Typhimurium
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIASIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLCEAAQEAGIPLVVNHVGGMFGIFFTDAESVTCYQDVMACDVERFKRFFHLMLEEGVYLAPSAFEAGFMSVAHSMDDINNTIDAARRVFAKL

SEQ ID NO: 8577 - protein, 213 aa, Pyrobaculum aerophilum str. IM2
MGIEDAIAAFKAGRLVMIYDGDDREAEVDFVIRADAVTPTTIRWLRQNAGGLLCFVTTREVGEILGLEFLSSYYKRRGFLATAPYGDEPAFMGYVNHVKTKTGIRDVDKALTIRELAKVVQLAQRDPEEAREAFKANFYMPGHVPILGGRLGERWGHTELSLILAKAAGVPPAVVIVEVLGDHTEAMPVEEAREYSKTLGVPLVTGTEIKSLI

SEQ ID NO: 8578 - protein, 321 aa, Escherichia coli K12; identical to SEQ ID NO: 376

SEQ ID NO: 8579 - protein, 253 aa, Xanthobacter autotrophicus Py2
MPHAAPVGRARGTGTETPMVHAEDPKRRAAAHALTYVTDGMRLGLGTGSTARHFVELLAEKVHAGLNILGVPTSEQTLSQAVSLGVPIATLDEAGPLDLCIDGADEVGPGLALIKGGGGALLREKIVASAAREMVVIADSSKKVAMLGRFPLPIEVVDFGVASIERHVADAVRKAGCEGPVKLRRDGDGHPFVTDQGHLILDVHLGRIPDPAALARAVEEVAGVVEHGLFLGLARRVVLAGADGITVLEPGSF

SEQ ID NO: 8580 - protein, 300 aa, Coccidioides immitis RS
MATSEEEPLIDENAPLQSYYASLESRVGYRLFLGGTRHFGYYDPDTLWPFPIGRALRKMEDHLARSLDLFKGARALDAGCGYGHVAIHMARKHHLEVTAIDVVDRHVARAQRNVAAAGLRGAIVVQKADYHHLDSFSDSSFDGVYTMETFVHATDPAAALAGFFRVLKPGGSIALYEYDHAKSLDAAEEMVKMFDQVNIHAAMPSNALFEQGRLPSLLEDAGFVDVKVADLSENIKPMLRLFFVVAYIPYLIIRLFGLEAYFINAVAAVMGYRYHYAHRYVAVTAKKPLTAEYPTRRRRI

SEQ ID NO: 8581 - protein, 268 aa, Bifidobacterium longum DJO10A
MLNNGTVIPQVGLGVFQTPDGDTTVNAVQTALENGYRHIDTAMIYHNEASVGEGIRRAGVPRSDFFLTTKLWNDDIRARCGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 8582 - protein, 134 aa, Oryza sativa
  misc_feature (55)..(55): Xaa can be any naturally occurring amino acid
  misc_feature (100)..(100): Xaa can be any naturally occurring amino acid
  unsure (1)..(134): unsure at all Xaa locations
RVRNEPSQISIDTNAYCLARYTIICHANRVPPHVPPDILDDGSHHIARFTYVTQXILLGYYTTSITHVLRTASLMKPNIATRGSKSKKVCPNVIAEYTVXALQRTVPAAVPAISFLSGGQSEEEATENSNAMNK

SEQ ID NO: 8583 - protein, 323 aa, Staphylococcus aureus subsp. aureus MSSA476
MSKYSQDVLQLLYKNKPNYISGQSIAESLNISRTAVKKVIDQLKLEGCKIDSVNHKGHLLQQLPDIWYQGIIDQYTKSSALFDFSEVYDSIDSTQLAAKKSLVGNQSSFFILSDEQTKGRGRFNRHWSSSKGQGLWMSVVLRPNVAFSMISKFNLFIALGIRDAIQHFSQDEVKVKWPNDIYIDNGKVCGFLTEMVANNDGIEAIICGIGINLTQQLENFDESIRHRATSVQLHDKNKLDRYQFLERLLQEIEKRYNQFLTLPFSEIREEYIAASNIWNRTLLFTENDKQFKGQAIDLDYDGYLIVRDEAGESHRLISADIDF

SEQ ID NO: 8584 - protein, 329 aa, Magnaporthe grisea 70-15
MLNTPSDGELTLAVLGCGTMGIAILSGILTSLQDMAASGVLSASASGTSTPVHPEVPDRLPSRFIACVRRPESAKKVKVALAEHLSVVKVVQNDNLASARQAGVVILACKPQMIGDLLSKPGIAEALRGKLLISICAGVTVPQIEGHLEQALGSKDVENPCRVVRAMPNTASMIRESMTVVATTEPPLPPQVSSLVTWIFKRIGDVVYLPASTMDASTALCGSGPAFFALMLEAAVDGAVAMGLPRAEALRMAAQTMKGTAALVQHGDHPALLRDKVSTPGGCTIGGLLVLEEGIVRGTVARAVREATVVASQLGQGVQGVNGTRPMRH

SEQ ID NO: 8585 - protein, 319 aa, Zea mays
TEHHIMEGGAVPKPSEKRVALVTGGNRGMGFEICRQLASSGLTVVLTARSETRGAEAARELHGFGLPDVVSHQLDVTEPTSAARLADFVRTKFGKLDVLVNNAGIMGVTMEVGDDEAAVKEMMVGKDQNEIAEWLKQRTTQSAEQAEECVRINYHGTKTVTEALLPLVQSSSSSSSGGRIVNVTSSFGLLRFFSGEELRQELSSVDTLTTQRLDELSALFLEDYRSGRLEPRGWPTDRVYAAYQVSKALVSAYARVLARDNPALRVNCVHPGYVQTEMNRNTGDLTAAEGARVSVAVALADQGGVTGAYFDRTQIASFV

SEQ ID NO: 8586 - protein, 261 aa, Apodachlya brachynema
EKMTQIMFETFNVPAMYVNIQAVLSLYASGRTTGCVLDSGDGVSHTVPIYEGYALPHAIVRMNLAGRDLTDYMMKILTERGYSFTTTAEREIVRDIKEKLTYIALDFEQEMKTAAESSGLEKSYELPDGNVIVIGDERFRTPEVLFKPSMIGMEASGIHDCTFQTIMKTDIDIRKDLYCNIVLSGGTTMYPGIGERLTKELIALAPSTMKIKVVAPPERKYSVWIGGSILSSLSTFQQMWISKAEYDEAGPSIVHRKCFQA

SEQ ID NO: 8587 - protein, 563 aa, Anaplasma marginale str. St. Maries
MSHASYLLDVILLLSAAVVVVVVFGKLRISPVLGYFVAGAAIGPHGLQLVESSAIISSLGEFGVVFLLFLIGIELTFERLAAMRLHVFGFGTMQVIVTATLIWCVARALGVDYESSVVIGGALALSSTAIVLQVLQEKGQQSTQIGRLSVAILLLQDFAVVPLIVLLPLLAGESNSLVMSLMHALLKAVAALALIFISGRLLLRPLFGTIATMKSNEAFIATTLLVVLGAAFVTENFNLSMALGAFVSGLLVAETEYRYDVEQVVLPFKKLLMGLFFMVVGMSIDGGLLISKLPIILALSIALILLKAIVVCALCRFFRFQLAVGVHAGLLLCQGGEFAFILFGLAAEKGVMSHGLAQILMMTTTVTMAFTPLLAALGHWIAGLLTKNKIAFSSQELVLDTRDLDQHVIVVGFGRVGRIVAKVLTAEHVNYIASDIQPVVVTEGRKEGFPVYLGDLTRLETLTSMGIARAKAVIIAINNSVTTKKIISLVANNFRDTIVAVRIPDLTNAEAYRKLGAHYLIPETYETGLQLGGVALSISGFSTDAIASLQDALRAEDYGHIEE

SEQ ID NO: 8588 - protein, 90 aa, Glycine max
MSSTSRAWAWTVAAGVGVVEAMKDQGICRWNSVMRSAQQHAKHNMRSLSQTKKLYSQSSVMASAKLKDEKAKQSEESLRTVMYLSCWGPN

SEQ ID NO: 8589 - protein, 261 aa, Brevilegnia macrospora
EKMTQIMFETFSVPAMYVNIQAVLSLYASGRTTGCVLDSGDGVTHTVPIYEGYAIPSAIMRLNLAGRDLTDYMMKILTERGYSFTTTAEREIVRDIKEKLTYIALDFDQEMKTAAESSGLEKSYELPDGNVIVIGNERFRTPEVLLQPDLLGKEALGIHECTFQTIMKCDVDIRKDLYCNVVLSGGTTMYPGIGERMTKELTALAPSTMKIKVVAPPERKYSVWIGGSILSSLSTFQQMWISKAEYDESGPSIVHRKCFQA

SEQ ID NO: 8590 - protein, 508 aa, Mycoplasma pneumoniae M129
MHKKVLLAILDGYGISNKQHGNAVYHAKTPALDSLIKDYPCVMLEASGEAVGLPQGQIGNSEVGHLNIGAGRIVYTGLSLINQNIKTGAFHHNQVLLEAIARAKANNAKLHLIGLFSHGGVHSHMDHLYALIKLAAPQVKMVLHLFGDGRDVAPCTMKSDLEAFMVFLKDYHNVIIGTLGGRYYGMDRDQRWDREEIAYNAILGNSKASFTDPVAYVQSAYDQKVTDEFLYPAVNGNVDKEQFALKDHDSVIFFNFRPDRARQMSHMLFQTDYYDYTPKAGRKYNLFFVTMMNYEGIKPSAVVFPPETIPNTFGEVIAHNKLKQLRIAETEKYAHVTFFFDGGVEVDLPNETKCMVPSLKVATYDLAPEMACKGITDQLLNQINQFDLTVLNFANPDMVGHTGNYAACVQGLEALDVQIQRIIDFCKANHITLFLTADHGNAEEMIDSNNNPVTKHTVNKVPFVCTDTNIDLQQDSASLANIAPTILAYLGLKQPAEMTANSLLISKK

SEQ ID NO: 8591 - protein, 559 aa, Nicotiana tabacum
MGSSGDAWKLKDHPKLPKGKTVAVIVLDGWGEAKPNEFNAIHVAETPVMYSLKNGAPEKWRLIKAHGNAVGLPTEDDMGNSEVGHNALGAGRIFAQGAKLVDLALASGKIYEGEGFKYVKECFEKGTLHLIGLLSDGGVHSRLDQVQLLLKGAAKHGAKRIRVHALTDGRDVLDGSSVGFMETLENSLAQLREKGIDAQVASGGGRMYVTMDRYENDWDVVKRGWDAQVLGEAPHKFKDPVEAVKKLRQEPNANDQYLAPFVIVDDNGKPVAAILDGDAVVTFNFRADRMVMLAKALEYENFDKFDRVRVPKIRYAGMLQYHGELQLPSHYLVSPPEIARHSGEYLVRNGVRTFACSETVKFGHVTFFWNGNRSGYFNEKLEEYVEIPSDSGITFNVKPKMKALEIAERTRDAILSGKFDQVRVNLPNGDMVGHTGDIKATIEACKSADEAVKMILEAIEQVGGIYLVTADHGNAEDMVKRNKKGEPALDKNGNIQILTSHTCEPVPIAIGGPGLAPGVRFRQDLPTGGLANVAATFMNLHGSEAPSDYEPSLIEVVDN

SEQ ID NO: 8592 - protein, 244 aa, Mycoplasma pneumoniae M129
MRTKYLIGNWKTNKDLHQALAFVEQFKQHPAKTKAVLGIAPVHVHLTEVNKVLPNNLLLLAQDANFIASGSYTGTVSYTQLQDIKVNSVIIGHSERRKYFNETAQVINQKLKACLQAGMLVVLCIGETEGQPISFLKEDLTQVLQGIDLSLLKQLVIAYEPIWAIGTGKTATPEIANNTIAQIRVYLSELYNKEIAQQTSILYGGSVAKDNIKELAQTEQIDGFLVGKASLDVNDFLVMAQVYA

SEQ ID NO: 8593 - protein, 299 aa, Isochrysis galbana
WDDMEKIWHHTFYNELRVAPEEHPVLLTEAPLNPKANREKMTQIMFETFNVPAMYVAIQAVLSLYASGRTTGIVMDSGDGVSHTVPIYEGYALPHAILRLDLAGRDLTDWMVKLLTERGYSFTTTAEREIVRDIKEKLAYVALDFDQEMQTASSSSALEKSYELPDGQVITIGNERFRCPEALFQPTFLGMEAAGVHETTYNSIMKCDVDIRKDLYANIVLSGGTTMYAGIADRMSKEITALAPNSMKIKIIAPPERKYSVWIGGSILSSLSTFQQMWISKQEYDESGPSIVHRKCFQA

SEQ ID NO: 8594 - protein, 408 aa, Glycine max
MVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 8595 - protein, 491 aa, Rhizobium sp. NGR234
MTLTSALTRHLKCPELFRNLANEPHPSVAGQRQRFSVFNPSTGELLAEVPDMGAADAHAAIERADAAQEPWSGLTARARSDILWKWHRFILEHSDDLAAILTAEMGKPLGEAKSEVQHAAAYLQWYAEEANRIYGETISAPSTDRRMLVIKQPIGVVGAITPWNFPASMVARKISPALAAGCTVVLKPAEQTPLVAGAMFALAKLAGFPDGVLNLVYASEGDAIGRELCTNPKVRKISFTGSTEVGRLLMRQCSDQIKRISFELGGNAPFIVFDDADIDAAVDGAIQAKFRNAGQTCVSANRIYVQSGVYAEFAEKFTERVRTLKVGDGFDPNVAIGPLINQEALKKIELHISDAVQKGARVRSGGRRTGSSGTFFEPTVVTDVSKTMRLAEEETFGPLAPLLRFDDADHVVREANDTIYGLAAYFYASNLKRVWRVAEALEYGMVGINTGRMSSEAAPFGGVKQSGIGREGSRHGLEDYLDMKYLCVGGL

SEQ ID NO: 8596 - protein, 295 aa, Lycopersicon esculentum
MTYMFKYDSVHGQWKHHELKVKDEKTLLFGEKAVTVFGFRNPEETSMDRLGADYIVESTGVFTDKDKPAAHLKGGAKKFIISAPSKDAPMFVVGVNEKEYNPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRPSIFDAKAGIALSKNFVKLVAWYDNEWGYSTRVVDLIIHMSSVQ

SEQ ID NO: 8597 - protein, 733 aa, Arabidopsis thaliana
MTRWSMSMHCTLFLLFLLRLTCIFSDSDYLMGLGSYDITGPAADVNMMGYANMEQVASGVHFRLRARAFIVAEPYKKRIAFVNLDAGMASQLVTIKVIERLKQRYGELYTEENVAISGTHTHAGPGGYLQYILYLVTSLGFVHQSFNALVDGIEQSIIQAHENLRPGSILINKGELLDAGVNRSPSAYLNNPAHERSKYEYDVDKEMTLVKFVDDQWGPVARIMEDWFERENGCRSVDVESPRRVSSIISDPYDQDLMEMASSLLSTGGKTVTRMSSVARRVRSRFRHADKPRFVSAFCQTNCGDVSPNVLGAFCIDTGLPCEFNQSTCGGKNEQCYGRGPGYPDEFESTRIIGERQFKKAADLFTKASEEIQGKVDYRHAYVDFSQLEVTINGQNGGSEVVKTCPAAMGFGFAAGTTDGPGAFDFKQGDDQGNPFWRLVRNLLKNPTEEQVRCQRPKPILLDTGEMKQPYDWAPSILPVQILRIGQLVILCVPGEFTTMAGRRLRDAVKTVLKEGSNGREFSVVIAGLTNSYSQYIATFEEYQVQRYEGASTLYGPHTLSGYIQEFKKLANDLLSAQTTDPGPQPPDLLHKQISLLTPVVADMTPIGTAFGDVTSDVPRLSKFRKGADIVRVQFRSANPRNDLMTEGTFALVERWLEGRETWVPVYDDDDFCLRFKWSRPFKLSTQSTATIEWRIPETASPGVYRITHFGSAKTPISSIHHFSGSSSAFVVY

SEQ ID NO: 8598 - protein, 283 aa, Pediococcus pentosaceus ATCC 25745
MNNLTDTYTLNNGVKIPVVGFGTWQSKDGDEAYNAVKAALEAGYRHIDTAAAYGNEESVGKAIKDSGIDRKELFITSKLWNRDHGYESAKKALDTSLAKLGTDYLDLYLIHWPNPVQFRDEWQQRNADSWRAMEEALDAGKVRAIGVSNFRAHHLDELLKTAKVTPAVNQIFLNPSDTEDEVVAYNKEHGILSEAYSPLGTGKIFTIPELKDIAAKYNKSVAQVVLRWSLQHGFLPLPKSVHADRIKQNTEIFDFELSDDDIKKIDGFHGVAGLAQDPDATDF

SEQ ID NO: 8599 - protein, 318 aa, delta proteobacterium MLMS-1
MKIVGDEADDPHWRQLRQEGRLGHRRARYLVETTSTNDLALALATTGEAEAGAAGWAHGASDYPQLVVAERQSQGRGRLRRSWWSPPEGGLYVSFVYRPRLELEELAKLTLVAGVATAVAVERETGLQPGLKWPNDILLAGKKCGGILCETRLISSASPARDDDGQGTLCQPSAGDPAGHGAPAVVVVGIGLNVNTTAAQLPPELQATATSLRLATGRVWQRGMLLAAIADELDALVGRLEAGEFAAILARWRRRDALYGRELAWLTPAGEVVRGVALGPDDDGALRIRDRRGAVHQVLAGDLTVCPDTDKIPRTPGT

SEQ ID NO: 8600 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 8601 - protein, 236 aa, Ashbya gossypii ATCC 10895
MGKAEFGTAKYISNQLKARGLQKLRFYCQICQKQCRDDNGFQSHIKSPSHLRKISTITPKDIDQYTKQFERDFLRLLHMGHGEKKIEANKFYNEYIQDKHHIHMNATRYTSLTKFIQHLSKTGKIRVHGVEELEEDMDPGQILISYIDNSSDNMLKKDKLRELEENDKHEEDIRQNMLLKQIEFGKKAEQLADVPASDEVPGAEKPAVIGKVSLRLETKNKVKKKKSKGTNVFKKA

SEQ ID NO: 8602 - protein, 344 aa, Triticum aestivum
  misc_feature (88)..(88): Xaa can be any naturally occurring amino acid
  misc_feature (97)..(97): Xaa can be any naturally occurring amino acid
  misc_feature (107)..(107): Xaa can be any naturally occurring amino acid
  misc_feature (118)..(118): Xaa can be any naturally occurring amino acid
  misc_feature (150)..(150): Xaa can be any naturally occurring amino acid
  misc_feature (213)..(213): Xaa can be any naturally occurring amino acid
  unsure (1)..(344): unsure at all Xaa locations
AYLGDTIEQVCTKKQAGTGPEFPGYRRPTRPAMLPTITSKDWLDIHFGIAEGVHFIAVSFVKSAEVINHLKSYIAPRSRGNDIAVIAXKIESIDSLXNLVEIIRASXDGAMVARGDLXPQIPLGARPFKYNNQIVKLCRQLNKPVVVASXLLESMIEYPIPTRAEVADVSGAVHPCAGALMLSGESAMGRYPDKALSVLSSVSLRIERWWREXEKHHEALELEDVSSSFADKISEEICISAAKMANKLEVDAVFVYTKGGHMASLLSRCRPDCPIFAFTNSTSMRRRLNLQWGLIPFRLTFSDDMESNLNRTFSLLKARGMIKPGDLVIALSDMLQSIQVMNVP

SEQ ID NO: 8603 - protein, 283 aa, Streptococcus agalactiae 2603V/R
MATIQWFPGHMSKARRQVQENIKHVDFVTILVDARLPLSSQNPMLTKIVGDKPKLMILNKADLADPIRTKEWRDFYESQGLKTLAINSKEQSTVKKVTDIAKILMSDKIANLRGRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTYYPDRLKERFKSINLEDEAPEIIMALTQKLGYRDDYDRFYNLFVKEVRDGKLGRYTLDIVGEHDGNN

SEQ ID NO: 8604 - protein, 481 aa, Azospirillum brasilense
MANVTYTDTQLLIDGEWVDAASGKTIDVVNPATGKPIGRVAHAGIADLDRALAAAQSGFEAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLASLAGLHMKRATMELGGHAPVIVAEDADVALAVKAAGGAKFRNAGQVCISPTRFLVHNSIRDEFTRALVKHAEGLKVGNGLEEGTTLGALANPRRLTAMASVIDNARKVGASIETGGERIGSEGNFFAPTVIANVPLDADVFNNEPFGPVAAIRGFDKLEEAIAEANRLPFGLAGYAFTRSFANVHLLTQRLEVGMLWINQPATPWPEMPFGGVKDSGYGSEGGPEALEPYLVTKSVTVMAV

SEQ ID NO: 8605 - protein, 341 aa, Shewanella sp. ANA-3
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQESLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 8606 - protein, 478 aa, Leptospira interrogans serovar Lai str. 56601
MPCMKILNRKKTKIVCTIGPASSSEETILSILKAGMDIARMNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 8607 - protein, 468 aa, Pseudomonas syringae pv. tabaci
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMSKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 8608 - protein, 274 aa, Listeria monocytogenes str. 4b F2365
MNLKYTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 8609 - protein, 556 aa, Ricinus communis
GEFTWKLADHPKLPKGKTIAMVVLDGWGEAKPDQYNCIHVAETPTMDSFKKTAPERWRLIKAHGTAVGLPTEDDMGNSEVGHNALGAGRIYAQGAKLVDLALASGKIYEGEGFKYVKECFDKGTLHLIGLLSDGGVHSRLDQLQLLLKGAAEHGAKRIRVHVLTDGRDVIDGTSVGFAETLEKDLENLREKGVDAQVASGGGRMYVTMDRYENDWNVVKRGWDAQVLGEAPYKFKSAVEAIKKLREEPKANDQYLPPFVIVDENGKPVGPIVDGDAVVTINFRADRMVMLAKALEYENFDTFDRVRFPKIHYAGMLQYDGELKLPSHYLVSPPEIERTSGEYLVHNGVHTFACSETVKFGHVTFFWNGNRSGYFNPEMEEYVEIPSDVGITFNVQPKMKAIEIAEKARDAILSGKFQQVRVNIPNGDMVGHTGDVEATVVGCKAADEAVKMIIDAIEQVGGIYVVTADHGNAEDMVKRDKSGKPMADKSGKIQILTSHTLQPVPIAIGGPGLTPGVRFRSDIPTGGLANVAATVMNLHGFEAPSDYEPTLIEAVDN

SEQ ID NO: 8610 - protein, 516 aa, Bifidobacterium longum DJO10A
MTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 8611 - protein, 359 aa, Aeropyrum pernix K1
MRIEQDFSQSLGVERLKAARLHEYNKPLRIEDVDYPRLEGRFDVIVRIAGAGVCHTDLHLVQGMWHELLQPKLPYTLGHENVGYIEEVAEGVEGLEKGDPVILHPAVTDGTCLACRAGEDMHCENLEFPGLNIDGGFAEFMRTSHRSVIKLPKDISREKLVEMAPLADAGITAYRAVKKAARTLYPGAYVAIVGVGGLGHIAVQLLKVMTPATVIALDVKEEKLKLAERLGADHVVDARRDPVKQVMELTRGRGVNVAMDFVGSQATVDYTPYLLGRMGRLIIVGYGGELRFPTIRVISSEVSFEGSLVGNYVELHELVTLALQGKVRVEVDIHKLDEINDVLERLEKGEVLGRAVLIP

SEQ ID NO: 8612 - protein, 224 aa, Brassica napus
RTNVNLPGVGDDLPTLTDKDIEDIMGWGVPNRIDMIALSFVRKGSDLVNVRRVLGSHAKSIMLMSKVENQEGVVNFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKAHAKLI

SEQ ID NO: 8613 - protein, 249 aa, uncultured bacterium 562
MKLNTLNKNKILKNIDVDRINIAIYNTIGSTNDKCKTLEQSNDFNIVLAEEQTKGKGRMGKEWSSPLGNIYMSIAFSGSKSNEPLSLISGLICQEAINKVIGEDSIVLKWPNDIILHKKKVGGILIEKEVLGSDVTNIVGIGLNLKLVKKESWWGDLSEYQHIDRNELINTILIKFISYCDKGIDNWKEKWETSCMHLNSNIKIQSNNIKINEGMCIGITNRGALRISSNKDGKICEYEYGDISIKGVY

SEQ ID NO: 8614 - protein, 259 aa, Prymnesium parvum
EKMTQIMFETFNVPAMYVAIQAVLSLYASGRTTGIVMDSGDGVSHTVPIYEGYALPHAILRLDLAGRDLTDWMVKLLTERGYSFTTTAEREIVRDIKEKLAYVALDFDQEMQTAASSSALEKSYELPDGQVITIGNERFRCPEALFQPSFLGMESPGVHETTYNSIMKCDVDIRKDLYANVVLSGGTTMYAGIADRMSKEITALAPASMKVKIIAPPERKYSVWIGGSILSSLSTFQQMWISKQEYDESGPSIVHRKCF

SEQ ID NO: 8615 - protein, 404 aa, Oceanicola granulosus HTCC2516
MSPAPFRRAERLAGIEISEIVQLSERAAELRRAGQDVVALTTGEPDFPTPPHVVAAAHAAAEAGQTRYPPTAGTPELRAAIARQAGAEAAEVLVSTGAKQVLANAMLATLDPGDEVLIPAPFWTSYGDIVALAGGRPVRLPCPAADGFKLRPEALAAAITPRTRWLMLNSPSNPTGAVYGPGELAALAAVLADHPQVWVLSDEIYSHLAYVPAPSLRDAAPGLAERTLVVDGVSKAFAMTGWRLGWGIGPRALIGAMAAVQGQVTSGACSISQAAALAALTGPQELLADRRAAFRARRDRVCAALAAIPGISCVPPDGAFYAFPDVTGLILGGGFADDAALCRWLLDEVGLALVPGRAFGMPGHVRLSFAYAEREIDDALDRLATAAARLAARPFQASKEQVTT

SEQ ID NO: 8616 - protein, 321 aa, Methanococcoides burtonii DSM 6242
MTDKKMDIIRALKRAGNNPISGEELGGILGISRTMVWKYMKALGEEGYVIRSSPGSGHVLVSAPDKLYPSEIMDGLDTSIIGGDIRYFDEVDSTNDVAKKMGSSSDEGTVVIAEMQDSGRGRKGGHWMSPRGGVWMSVILKPNVVPAYAPRFTLMAGVAVAKAIRGLGVEASLKWPNDVLIGDKKVCGILTEMDAECDQINFVIIGIGINVNVLIEELSEDLRSSSTSLSEIKGEELDRIAFVQALLRALEDEYIRSKTSGFDSILEEWRSLSSTIGRDVDVVTPQRIIRGKAVGITENGTLLVETAEGLEEIVAGSCIHG

SEQ ID NO: 8617 - protein, 220 aa, Cryptococcus neoformans var. neoformans JEC21
MSGWMSYFTGRKDTRESARDAIVGLRQQLLMLEKKEEFLQKKIEEEMKKAKANATGNKRLAMAALRQKKAHENELDRIAGTRLTLETQVNAIESANLNAETMVAMKKGADALKGIHSNLTAEGVDATMDKIREQMDLTNDISDAISNPVGMGIVLDEDDLKEELEALEQEQLDDRLAGADRVPSHLPASPVGQTTGRAAVEEDEDDEEAQLRKLQAELAM

SEQ ID NO: 8618 - protein, 334 aa, Acinetobacter sp. ADP1
MATVDLFAIGNALIDQEFKVTDQFLGEAGLQKGTMQLTDGETQAALYEKLQATQDYKGQASGGSAANTTVAFSSLGGSAFYGCRVGNDELGAIYLNGLNDADIVTSEKSLTTGTTGTCMVLISPDTERTMHTYLGITTELSEQQIDYTSLKTAQWLYIEGYLSTSPTARQAVKQARKIAREHGVKIALSLSDPAMVQYAREGLDEMIDDGVDVLFCNEQEALMYTETQTLDEAFSRLKQKNHTVVVTQSAKGASVSNPHTHFHLSGRRVTAIDANGAGDAFAGAFLFALNHGMSLEDATQLSILISSEVVSQYGPRLAVESYATLLRNFLTECA

SEQ ID NO: 8619 - protein, 472 aa, Neisseria gonorrhoeae FA 1090
MSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 8620 - protein, 538 aa, Colwellia psychrerythraea 34H
MWWRGAVIYQIYPRSFYDANQDGIGDLPGIISKLDYIASLGVDAIWISPFFKSPMKDFGYDISDYREIDPIFGTLADFDELVIKAHALGIKIMIDQVLSHTSDQHQWFIDSREDQTNDKADWYVWSDAKEDGTAPNNWLSIFGGTGWTWEPRRQQYYLHNFLTSQPDLNFHNPDVRQAVLDNIEFWLKRGVDGFRLDAINFCYHDAQLRDNPAKAKELRTSIGFDEKNPYAYQYHYYNNTQDENLGFMEDIRTLLNEYPGTVALGEISSEDSLKTMAEYTQGEHRLHMGYSFDLLTDNFSASYIKQVVQNLESRVLDGWPCWSISNHDVERVVTRWGGFNSKDFAKMLYAMISSLRGSVCSYQGEELGLNEADIAFEDIQDPYGITFWPQFKGRDGCRTPHPWQHNAINAGFSEGKPWLPVSNEHFAKSVDVQDDAVDSVLNSYRNFNRWRKDQPALRYGDINFIDTAEPLLAFVRQYQGEQLLVCFNFSEQSQIVALSSLTPASDSLTVLSDHKLISATITDGVLELPPFGCFYSKL

SEQ ID NO: 8621 - protein, 118 aa, Zea mays
  misc_feature (12)..(12): Xaa can be any naturally occurring amino acid
  misc_feature (76)..(76): Xaa can be any naturally occurring amino acid
  unsure (1)..(118): unsure at all Xaa locations
MERTYIMVKPDXVERGLVGEIIKRFEQRGYQLTALELIHPTKELLEEHYCDLKGKAFFPSLVEYMLSGPVVGMVWXLAKDAVKTGRKMLGETNPLASAPGTIRGDFCIEVGRNICQRF

SEQ ID NO: 8622 - protein, 267 aa, Bifidobacterium longum DJO10A
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 8623 - protein, 131 aa, Ashbya gossypii ATCC 10895
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTIAQGGVLPNIHANLLPKKSAKATKASQEL

SEQ ID NO: 8624 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIEKNGENKRVDGKSA

SEQ ID NO: 8625 - protein, 378 aa, Bacillus cereus G9241
MVYLNDKLSETKVFKDPVHKYVHVRDRVIWDLIGTKEFQRLRRIKQLGTTFFTFHGAEHSRFTHSLGVYEIIRRMIDDVFDGRPNWNAEDRLLCLCAALLHDVGHGPFSHSFEKVFSLDHEKFTQKIIVGDTEINRVLSRVDKDFPQKVADVIAKTSTNKLAISMISSQIDADRMDYLLRDAYFTGVKYGNFDMERILRVMRPYGNQVVIKNSGMHAVEHYIMSRYQMYWQVYFHPVTRSAEVILTKILHRAKSLHEKYYTFKNHPVHFYSLFEEEVTVEDYLKLDENVMYYYFQVWQDEEDPILSDLCRRFMNRNLFKYVEFTDKHGLDNWMELSSLFKKIGLDPEYYLVVDSTSDLPYDFYRAGEEEERLPILLLM

SEQ ID NO: 8626 - protein, 340 aa, Nicotiana tabacum
MEYDGILLGMGNPLLDISAVVDQDFLNKYDIKPNNAILAEEKHLPMYDELASKNIVEYIAGGATQNSIRVAQWMLPFPGATSYMGSIGKDKFGEKMKKNAKDAGVNVHYYEDEAPTGTCAVCVLDGERSLVANLSAANCYKVDHLKRPENWALVEKAKFYYIAGFFLTVSPESIQLVAEHAAANNKIFSMNLSAPFICEFFRDPQEKALPYMDFVFGNETEARTFSKVHGWETDNVEEIALKISEWPKASETHKRITVITQGADPVVVAADGKVKLFPVIPLPKEKLVDTNGAGDAFVGGFLSQLVQGKPVEDCVRAGCYASNVIIQRSGCTYPDKPDFA

SEQ ID NO: 8627 - protein, 460 aa, Acidobacteria bacterium Ellin345
MSTETLHLPAKKERQYRFPRGVEHNLLWEGLKNLGPIDPLRFFERLKRDYGKVGGYRVGNKRVVFLADAELIREVLVVQNDNFVKGEPVRRTKVLLGNGMITAEQQDWRSQRQAAQPAFHRQRIRSYADQMVGLTIETRDRIAPGIEFDLAQMFMELALKVVGKTLFDTDLDHEAGVVAHEISNIMDVYNFMMAVPAPQLMLHLPWPQVIKFRKARRRVDETVNRMIESHLHGPKRDCGDLLSMMIQAIPDVETPEGKEQLRDQVVTIFLAGYETTANALSWTFRLLGENPEVERRVLAEVDDVLNGRMASVEDVPQLKYIEMVLAESMRLYPPAWAMVRQGINDFQLGDYFLPGGTTVMMSQWVMHRSEEFWLDPLRFDPERFRPEAKAGRPKFAYFPFGGGGRQCIGEAFAWMEGALLLATLVQKYRFRLVAGQTFEPQSLITLRPRNGVRVVAEARG

SEQ ID NO: 8628 - protein, 388 aa, Pseudomonas aeruginosa PAO1
MRALTFHGSHDVRIDRVAEPRLQEPDDLLLRVTATAICGSDLHLYRGKIPMVEQGDILGHEFMGVVEEVGSAVTAVRPGDRVVVPFVIACGECFFCRLNLHAACETTNPGRGAILNKKQIPPGAALYGYSHLYGGVPGGQAEYVRVPKANSGPFVIPDVMEDERVLFLSDILSTGYQAVRNAGVRQGSSVAIYGAGPVGLMAAACARMLGAERIFIVDHHPYRLDFAARTYGAIPIDFDQEDDPAAAIIERTDGHRGVDAVIDAVGFEAKGSVTETVLTALKLEASSGKALRQCIAAVRRGGTVSVPGVYAGFIHGFLFGDAFDKGLTFKMGQTHVQALLPALLEHIGNGDLHPEAIISHRLRLDDAPEGYALFDEKREDCRKVVLRP

SEQ ID NO: 8629 - protein, 149 aa, Staphylococcus aureus subsp. aureus MSSA476
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLDSAEREINLWFNENEITSYASPRDAWLYE

SEQ ID NO: 8630 - protein, 301 aa, Zea mays
VPRGRPHIKSFRAVATDKGEWETSATGQRTESEGRGDGEGASDGGEMLAVFDPTVAKCPEGLRSPPVAGAAAGAGGAGAGALMKGFSDSHDGAVTVSLGPSGALAYSAANQSPLVPRLFGAVNDIFCLFQGHIENIANLKQHYGLSKTANEVTILIEAYRTLRDRGPVPASQVVRDLSGKFAFILYDTLSKSTFVAADADGSIPFFWGVDYENHLVFSDDVGILKTGCGNSYAPFPKGCFYTTSGGLQSFEHPLHEVKAVPRVDSQGQMCGSIFKVDSESKKKQDASIPRVGSAADWSNQF

SEQ ID NO: 8631 - protein, 497 aa, Ustilago maydis 521
MFKSFGKIMGGSSRKGKSKLQDGDDSVDASNGLPGSDSSNLLRAKSKDSLAVTENGSGNFANNGSSAPAKIEKRGGVSRHESPLPSPSPSARNVLEGQEESSEVGSSAVARSAPASDVGGPRPANDAASQSTSVPTANTILSNPLAQSGSTGFPSSVGKNAQAAAGGDQVRTFDIDDMISRLLEAGYSGKIPKPALKNAEITAVCQAAREIFLSQPTLIELSPPVKIVGDTHGQYHDLLRLFEMCGFPPSANYLFLGDYVDRGKQSLETILLLLCYKIKYPENFFLLRGNHECANVTRVYGFYDECKRRVNIKIWKTFIDVFNTLPIAAVVASKIFCVHGGLSPSLSNMDDIRRIERPTDVPDYGLLNDLLWSDPSDTALDWEDNERGVSYCFGKAVIQQFLAQYDFDLICRAHMVVEDGYEFWNERTLVTIFSAPNYCGEFDNFGAVMSVSEDLLCAFELLKPLDGAALKKEMAKNKRRSLLQHQSPPARGSQQSY

SEQ ID NO: 8632 - protein, 409 aa, Shewanella sp. ANA-3
MAKHSLDKDKIKILLLEGVHQSAVDVFERAGYTNIEYHKASLGDEALLESIKDAHFVGIRSRTQLTAEVLKRAEKLIAIGCFCIGTNQVDLATAELLGIPVFNAPFSNTRSVAELVLGEIIMLMRGIPERNAIAHRGGWMKTAAGSYEVRGKTLGVIGYGHIGTQLGILAETLGMRVVFFDIEDKLPLGNAQQIHSMEQLLAQSDVISLHVPETAQTKDMISTAEFAAMRKGSIFINASRGTVVDIDALTVALKERHLAGAAIDVFPVEPQSNDDEFISPLRGLDNVLLTPHVGGSTAEAQENIGIEVAGKLAKYSDNGSTVSAVNFPEVSLPMHKGISRLLHIHQNRPGVLIKINKAFSEKGINIAAQYLQTTAEIGYVVMEVDTHQAEEALVELKAIEGTLRTRVLF

SEQ ID NO: 8633 - protein, 894 aa, Acidobacteria bacterium Ellin345
MNAPLGVKVAYLYRWSNETGEPRAKREGPLRRTSQSSAVTGLESMASSSNLLPNVRPAELLREAIYRHIRYTLVLRNPRLLGPVELLTPVSLAVRDRIVDRMIETEERVRSKDSKRLYYLSMEFLMGRSLNDNLHNLGITELMREVLASIGMSLDDVLACELDAGLGNGGLGRLAACFLESLATLGMPGYGYGIDYEYGLFRQEINGGFQREKPDRWKANGTPFEIGRPDRALSIPLYGRVETSRDNHGNLRQIWTSQKFVLGIPSDMPVVGWGGETVNFLRLFAARASEDFDIEIFNRGDYIRAVEQKIGNENISRVLYPSDSVMSGKELRLVQEYFLVACAIGDLVRRYDLDHKGYEQFPSKVAIQMNDTHPSLAVAELMRVFIDEKGLEWEQAWELTQATCAYTNHTLLPEALERWSVSLMERVLPRHMQLIYGINHQFLRSISEYSFTDPDLMRRTSIIEEAADKQVRMAHLAIIGSHAVNGVAALHSELVKSTLVPDFAKLWPERFSNKTNGVAPRPWLHKSNPGLAALLTETIGERWVTDLSLLRGLQKFADDAAFRAKFREVKQHNKNRLAKVIFDQTGVQVYTSSLFDVQIKRIHEYKRQLLNVMRIIDQYLQCVDHGVEIKVPRTFVFAGKAAPGYWAAKQIIKLIHNVASVVNSDPRMKDRIKVAFLPDYRVSLAEIIIPAADVSEQISTAGMEASGTGNMKLSMNGALTVGTYDGANIEILEEVGEENFYLFGLRVEQIEEMKRKGLYNAQEYYAKNERTKAVMDSLGSDRFSPQEPGLFRWIVDEILYRGDRYFHLADLPSYVEINESVDEDYLDQELWSRKAAINVARIGKFSSDRTILEYARDIWHIGPFEQPWVPKPKPEAILTAAPPASASESSSVVG

SEQ ID NO: 8634 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRRSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 8635 - protein, 331 aa, Kluyveromyces lactis NRRL Y-1140
MVRVAINGFGRIGRLVLRIALSRPNVEVVAINDPFISVDYAAYMFKYDSTHGRFAGEVSHDENSLIIDGKKVLVFQERDPATLPWGEHNVDIAIDSTGVFKELDSAQKHIDAGAKKVVITAPSSTAPMFVVGVNEDKYNGETIVSNASCTTNCLAPLAKVVNNAFGIEEGLMSTIHSITATQKTVDGPSQKDWRGGRTASGNIIPSSTGAAKAVGKVLPELQGKLTGMAFRVPTVDVSVVDLTVKLAKEATYDEIKAVIKKASENELKGILGYTEDAVVSSDFLGDTNSSIFDAAAGIQLSPKFVKLVTWYDNEYGYSTRVVDLVELVAKN

SEQ ID NO: 8636 - protein, 112 aa, Zea mays
MASSSGTAATNAGDTAATTAITVERKPAAARLSELGVRSWPKWGGPPGRYPLSYGARQTCYIVRGKASAAVEGSPEAGVQFGAGDLVVFARGTRCTWHIAAAVDMHYAFDPP

SEQ ID NO: 8637 - protein, 299 aa, Rhodomonas salina
WDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLCYVALDFEQEMQTAAQSSSIEKSYELPDGQVITIGNERFRCPEVLFQPSFIGLESAGIHETTYNSIMKCDVDIRKDLYGNIVLSGGTTMFSGIADRMQKEITALAPSTMKIKIIAPPERKYSVWIGGSILASLSTFQQMWISKQEYDESGPSIVHRKCFQA

SEQ ID NO: 8638 - protein, 409 aa, Aeropyrum pernix K1
MNWLLPQKDPTLDIQERVVEIEGETAFAYLAVARKLIQEGRRVISFGIGQPDFPTPHHIREAAKKALDEGFTGYTETAGIPELREAIAWYLNSRYGADVSPEEVIATTGAKTAIFLGMALYLRPGDEVIIPDPSYYAYAQVAKLFGARPVYVPMKFEPGLGFRFDIEGIERAVSEKTRMIVVNNPHNPTGSVFPPDQVEAIHDIARRRGLIILADEIYDNFLYTEKPFKSTLSLPDWRENLVYVNGFSKTFSMTGWRLGYVVLRREVIPKALDLAVTIYSCPPSIAQKAGVAALRGDWGPVREMVEEFRSRARILYDILSQAEGIEPYLPEGAFYMFPRVAGLLRKTGLSVEQLAEKLLYSYGVLVLPGTSFPESVGREHVRLSFATATSDVKEGAEIIVRASRELSSG

SEQ ID NO: 8639 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 8640 - protein, 382 aa, Thermoplasma acidophilum DSM 1728
MLSERMQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 8641 - protein, 223 aa, Acinetobacter sp. ADP1
MSLYATQDEKKQAAAKAALKHLPKGGILGVGTGSTVNFLIELLPELQLEAAVASSEATAKRLKELGIEVVDMNHVGGLDAYVDGADEIDRHMHMIKGGGAALTREKIVASIAKKFVCIVDDSKWVEQLGRDFPLPVEVIPMARSAVARKLVSLGGDPVYREGVVTDNGNVILDVYNLNILNALELEKTINDIPGVVTNGIFALNAASIAIVATNNGIEERTAV

SEQ ID NO: 8642 - protein, 414 aa, Burkholderia xenovorans LB400
MNAPVPIEVLRQHLIDPEICIRCNTCEETCPIDAITHDDNNYVVKADVCNGCMACVSPCPTGAIDNWRTVLKADAYSIDEQFSWDELPAQNTTANAALDATAQANGDDETGETASGIEVDAARGSTVPPWSAAKPYVNLYTHKAPTTATVVGNYRLTDELADSDIHHIVLDFGTLPFPVLEGQSIGILPPGTTKDGKPHHARQYSLASPRDGERPRYNNVSLTVKRVTRDYQDNATDGVCSNYLCDLKKGDKVTVIGPFGSTFLMPNHPDSHLLMICTGTGSAPMRAMTEYRRRRRLKGATGKLMLFFGARTKEELPYFGPLTNLPKDFIDTNLAFSRTPGQPKRYVQDAMRERAVDIAQLLKSDGTYIYVCGLKGMEDGVLQALQEIAERNGLDWATLWPRLRREGRLHLETY

SEQ ID NO: 8643 - protein, 276 aa, Mycobacterium sp. JLS
MGAPLVALNDGNSIPQVGLGVWQTPPEDTERAVAAALAAGYRHVDTAAAYGNEEQTGRAIAQSGLDRSQVYLVTKLWNSEQGYDATLAAFEASVDRLGVDYLDLYLIHWPVPEKNLFVDTFRAFARLREDGRIRSIGVSNFEPEHLRVLIDSTGIVPAVNQIELHPLLPQRELRELHAQLGIATEAWSPLGQGSLLAHPTVTGVAESHGKTAAQALIRWHMQLGNIVIPKSVNPQRIESNFDVFDFELSEQDMASISSLEDASRLGPDPKTFNFTG

SEQ ID NO: 8644 - protein, 126 aa, Listeria monocytogenes str. 4b H7858
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAVHTNRNVIHGSDSPESAKRE

SEQ ID NO: 8645 - protein, 389 aa, Chlamydomonas reinhardtii
MAAMMMRQKVAGAIAGERRSAVAPKMGRAATAPVVVASANASAFKGAAVTARVKASTRAARVQSRRTAVLTQAKIGDSLAEFLVEATPDPKLRHVMMSMAEATRTIAHKVRTASCAGTACVNSFGDEQLAVDMVADKLLFEALKYSHVCKLACSEEVPEPVDMGGEGFCVAFDPLDGSSSSDTNFAVGTIFGVWPGDKLTNITGREQVAAGMGIYGPRTVFCIALKDAPGCHEFLLMDDGKWMHVKETTHIGEGKMFAPGNLRATFDNPAYERLINFYLGEKYTLRYTGGIVPDLFQIIVKEKGVFTNLTSPTTKAKLRILFEVAPLALLIEKAGGASSCDGKAVSALDIPILVCDQRTQICYGSIGEVRRFEEYMYGTSPRFSEKVVA

SEQ ID NO: 8646 - protein, 145 aa, Triticum aestivum
  misc_feature (15)..(15): Xaa can be any naturally occurring amino acid
  misc_feature (89)..(89): Xaa can be any naturally occurring amino acid
  unsure (1)..(145): unsure at all Xaa locations
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 8647 - protein, 495 aa, Ashbya gossypii ATCC 10895
MGFQSFKPTFRNEDLVRRGAYINGEWITSAKESFNVTDPATDQVIAELPDFDSGEAEAALKAAHASFQSYKKTSPTQRSEWLRNLYDLIMENAEDLAAIVTWENGKSLREALVEIRYGATFFKWFSEEALRLYGTTIQPSNPGNRAFTIRQPVGVCALICPWNFPNAMISRKAAPALAAGCTVIIKPDPQTPLSSLALAHLAEKAGFPPGVINVVPTSKYTKDIGVLLCESSLVRKVSFTGSTAVGKILMQQAASTVKKVSFELGGNAPVIIMGDADMEKTVEEVLATKFRGMGQTCICANRLYVHRSIIDDFSSRLVKKVEGLKLGNGFQEGVTHGSLINNAAIEKVERHAKDAIERGAKVLLPGGRAPELGPHFYSPTVLSDVKPDSVLTREETFGPLCAMIPFDTVEEVVGYANDTQYGLASYVFSENIKTVYSIAEALDFGMVACNTGLFSDSMVPFGGIKESGFGIEGSLHGINDYTVLKTVTIGNVPTL

SEQ ID NO: 8648 - protein, 271 aa, Corynebacterium glutamicum
MPMSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 8649 - protein, 319 aa, Glycine max
MWWPFSRKEKEGSGFSSSSTAEEVTEGIDGTALTAIVTGASSGIGAETTRVLAMRGVHVIMGVKNMNAAKNIKETILKGIPSAKVDAMELDLSSMTSVRKFASEFISSSLPLNIFINNAGIFGTPFMLSEDNIELQFATNHIGHFLLTNLLLDTMKKTTHESKKQGRIVNVSSQGHQFTYREGILFDKLNDQSSYQAFRAYGQSKLANILHANELARRLKEDGVDITANSLHPGAIATNIHRYNSVLTGLPGVVKKLLSYVVKNVQQGAATTCYVALHPQVRGISGEYFADSNIAKANSQGRDIDLAEKLWDFSMNLTK

SEQ ID NO: 8650 - protein, 264 aa, Shewanella sp. ANA-3
MSKVTSSTLLKYKQEGRKFTALTAYDASFASAFDGEGIDVLLVGDSLGMVLQGHDDTLPVTTAEIAYHTRCVRRGIERSLLIADMPFMSYATPEQAMENATALMQAGANMVKLEGGHWLLETVTKLTERGIPVCAHLGLTPQSVHVFGGFKVQGRDAENAQRILDEAKALEAAGAQLLVVECIPASLATAITQALTIPVIGIGAGATTDGQILVMHDVLGISSGYIPRFSKNYLKQTGEIRSAVRAYIEEVANGSFPSADHTFN

SEQ ID NO: 8651 - protein, 400 aa, Deinococcus radiodurans R1
MTLIESSREPGDKLAVLSCRCDKSVTVHRVHWAHQRNHNQAGRVKFAAPGGRFLGGWPFFFGLEQFSELRRRRNSTATRSILRPARWFALAPLAKKRCTLFVKCSRVQSPGPALFMVGVMNTQQGAQDLTGRRILITGATGGIGLETARELAGRGAQVVIVGRDPGRTARVAAEVGAAGTLLADLSELVQVERAAAEYRERFGELDVLVNNAGALHRERQESREGIELTWALNHLAPFLLTRELLPLLRRSSETRRVPARVVTVASAAHVVGRIRFDDPEFRRGYAAWPAYAQSKLANILFARELARREPSVLSVSLHPGMVASGFGKNGGGRFAQAYGLLDRFSLTPEQGAQTSLHAVSAPVHTGGYYANARRVTPAPQALDDGAAARLWALSEGYLQV

SEQ ID NO: 8652 - protein, 342 aa, Streptomyces coelicolor A3(2)
MKALVKENAEPGLWLADVPEPTIGSGDVLIKVLRTGICGTDLHIRAWDGWAQQAIRTPLVVGHEFVGEVVDTGRDVTDIKAGDRVSGEGHLVCGKCRNCLAGRRHLCRATVGLGVGRDGAFAEYVALPASNVWVHRVPVDLDVAAIFDPFGNAVHTALSFPLVGEDVLITGAGPIGLMAAAVARHAGARNVVITDVSEERLELARKVGATLALNVSDATIADGQRELGLREGFDIGLEMSGRPEAMRDMIANMTHGGRIAMLGLPAEEFPVDWARVVTSMITVKGIYGREMFETWYAMSVLLEGGLDLAPVITGRYSHRDFEAAFADAASGRGGKVILDWTA

SEQ ID NO: 8653 - protein, 487 aa, Xanthomonas campestris pv. vesicatoria str. 85-10
MMAPTMSVTSAISQWPDVDQLYRRFDALVKQPMRPVRREGMDKVMRYFEQRCQGSKQLGDAAQRVIPGGVQHNLAFNYPFSLAMRSAEGAYLTDVDDNRYIDFLQAGGPTLLGSNPPALRARVNEVLDQCGPVTGLLHEYEVKLAELVCASMPAVEMVRLLGSGTEAVMGAVRLARAYTRKRWIIKIGGAYHGWSDQLVYGLRLPGTGRMEAIGIPRGATAHTQECLPNDLDALRRKLQFNRLRGGTAAVLLEPLGPESGTRPVHADYNRQVRALCDEFGALLIFDEVVTGFRLGPGGAQGYFGVAPDITVLGKCLAGGYPMAGAIGGRREVMMSLVGGIGTTARRAFVGGTLSANPLSCVAGYYALLEAQQNDAAGRAGRAGDRLRAGLEAIIQRRGLPYVVYNMGSIVHLQTSGVLLLDTGNLYKLWRVRNEAKARKHMMEEMGAAYSAHGLITLAGSRIYTSMADTDAVIDEALNRFDDVFALV

SEQ ID NO: 8654 - protein, 410 aa, Arabidopsis thaliana
MNCLFLFKSKKPRKQQKDNNKNKRKGKELLQNSAPELTNRSETSSFNLQTPRSLPSPRSIKDLYTEREQNLRVFSYEELSKATYVFSRKLVIGEGGFGIVYKGKILSNGDSSDPPLVVAIKKLNRQGLQGHKQWLAEVQFLGVVNHPNVVKLIGYCSEDGETGIERLLVYEYMSNRSLEDHLFPRRSHTLPWKKRLEIMLGAAEGLTYLHDLKVIYRDFKSSNVLLDDQFCPKLSDFGLAREGPDGDNTHVTTARVGTHGYAAPEYVQTGHLRLKSDVYSFGVVLYEIITGRRTIERNKPVAERRLLDWVKEYPADSQRFSMIVDPRLRNNYPAAGARSLAKLADLCLKKNDKERPTMEIVVERLKKIIEESDSEDYPMATTTTKESSQVRRRQVAKPEKQSLRGVSVRG

SEQ ID NO: 8655 - protein, 483 aa, Pseudomonas fluorescens PfO-1
MSVRRTKIVATLGPASNSPEVLEQLILAGLDVARLNFSHGTPDEHKARAKLVRDLAAKHGRFVALLGDLQGPKIRIAKFANKRIELKIGDQFTFSTSHPLTEGNQQVVGIDYPDLVKDCGVGDELLLDDGRVVMRVETATATELNCVVTIGGPLSDHKGINRRGGGLTAPALTEKDKADIKLAAEMEVDYLAVSFPRDAADMNYARQLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRIGKEFERCDESIALATMYTANHFPGVKAIIALTESGYTPLIMSRIRSSVPIYCFTPHREAQARAAMFRGVYTVPFDPASLAPNEVSQKAIDELVKRGVVEKGDWVILTKGDSYHTTGGTNGMKILHVGDPQV

SEQ ID NO: 8656 - protein, 216 aa, Solanum chacoense
MFKSLLTSTLFIVLFSLSSTYGDFDKLQLVLTWPPSFCHANNCQRIVPKNFTIHGLWPDKEGPQLLKYCKPKLTYNYFSDKMLNDLDKHWIQLKIDQASARKDQPAWKYQYLKHGSCCQKIYNQNTYFSLALRLKDRFDLLRTLQIHRIVPGSSYTFEEIFDAVKTVTQMDPDIKCTEGAPNLYEIGICFTPNGDSLVRCRQSETCDKTGKIFFRP

SEQ ID NO: 8657 - protein, 180 aa, Glycine max
EFPHIPPIPSDSGITFNEQPLMIALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 8658 - protein, 476 aa, Rhodopirellula baltica SH 1
MQDYRHTKIIATIGPATESPEKLAALIEAGVDVMRLNMAHGTPEWVGEIVARIRKVSKDISRHVAVMMDVKGPEIRTGAVEDAIELKAGDELVLFTEDCADQSAVESDGTPRVSVNYLGLPGAIDLDSTILVDSGLLHWHVLKKDATTVRCRVITPGVLESRRHINLPGVQVNLPAITDKDRTDLAAGVKAGIDFVALSFVRQAEDVRTLRAFLDEHGSPARIISKIEDQAGVRNMKAIIRQSDAIMVARGDLGVEIDYHRLPLVQTDLIRACQEDGKPVIIATHLLESMIQSPVPTRAEVSDVSNAIREQADAVMLSGETTTGKYPLESVGVLQNIVASIEPTVSRQLNSKIVLREPKSMMLRSACTLAQEMGDSGIVVFTRSGFLAYVLGALRPRGVPIFAFTDVEHTFRHLMLPWGVEPFFMEFSEDHDQTITNALEVLKESGWCKPGVWLGVITNALADEKIIDTLQLRQVQ

SEQ ID NO: 8659 - protein, 262 aa, Triticum aestivum
TAVGLDFDRESLEWCLENNLSKIGADGSSRLLLFDGNVLQPNESRLVKQKISDLVQGLNVTSDDGCTEKNSCEQSDSSFTKCEANSTMSDAVLPGRDIICAFNYSCCCLHKRKDLVLYFRHAFNALSKRGGIFVMDVYGGTSSECKLRLQRRFPSFTYFWEQEEFDIITRETRISLHFQVGKKQMIRHAFTYHWRLWSIPEIKDCLEEAGFKSIHVWVREMPDTKSSGNAEYTADRDVKYEELQHFNQADAWNAYVVGVANI

SEQ ID NO: 8660 - protein, 639 aa, Thermoplasma acidophilum DSM 1728
MGFHDYIEETKNIFNRLYPDNKITDIDYEGPTIVVYTKDPELFAKRDDLVRQIAQEIRRRIAIRSDPSILLPEDQARESIEKIIPKEAGLEDIYFEPDTGEVIIELDEPSIVTARGTDYVQEIKSRTQWSPRIVRAPPMYSRTVKEVREFMREVKQERREFLHNLGVKLSGPPMVGETWVRLTALGGHSEVGRSATLVSTKNSKVLIDCGMMNVGPDADPWDAAPYLYVPEVQPLSTIDAVILTHAHLDHSGLLPLLFKYGYDGPVYMTPPTRDLAALLQNDYIKVARMEGGKVPYESKYIREELKHTITLRYGETTDITRDMRLTFYNAGHILGSASGHLHIGDGLYNVVLSGDVKFEKTWLFNPANNKFPRAETFMTESTYGGRDDYSFTREEATQTLIDVINRTHDRGGSVLIPVFAVGRSQEVMIVLEDAMRNGRIPQMDVYLDGMIMEAPAIHAAYPEYLNKELREAIMVKKENPFLSPIFKKVETRDQREEIAENPETTIVLATSGMMNGGPVMEYFKAWSADPKHTLVFVGYQADGTLGKKIQSGAQEITLSGEGKNVTYPVKMDVETAEGFSGHSTKKQLLAYIATMQPKPKKILVNHGDNGKTAEFARLVRQRFNIEAYALKNLETIRLL

SEQ ID NO: 8661 - protein, 1047 aa, Cryptococcus neoformans var. neoformans JEC21
MSVSILRRAARLPLSRQHQPLFARPLSISSIVLRPTSTSPTRSSTTATQPHPRSPSESFHPAPTSVFTPLDTFLPRHLGPREADIQAMLEVLGHKTLDEFVATTIPSEVRIDQLTNKEEKGKGLRALSELELRRRIEEIAAMNRPVKSYIGMGYHNAIVPPVIQRNVFENPAWYTAYTPYSPEQSQGRLESLINFQTVAISLTGLPIANASLLDEGTAAAEAMAMCLASVAKPKFNKGKKVFLVSPNVAPQTIEVLQTRASGFDIDLRIAESDANFLSEVESLGEAQLMGALVQYPDVNGEIGDWEEVATKVKATGAKMVVTTDLLALTMIKPPGEWGADIVCGNSQRFGVPAGYGGPHAAFFACTDDLKRKMPGRLVGLSKDSQGAPAYRLALQTREQHIRREKATSNVCTAQALLANMAAMYAVYHGPEGLRRIAGKVHSLTRVLSESLASLGFTTVNKAFFDTLTIDVSSAGVTAADVHTASVKAGINFRKIDDKTIGITLDESVGPLDLTDIINVFYAVKGQPAVEPEVLEALAQKLELSAESVTSPIATLARTTPFLTQPVFNKHHSETDMLRYMMHLQEKDYSLVHGMIPLGSCTMKLNSTSSMVPLSWKEFGGLHPFAPTDQAKGYEVIIKELENDLSLVTGYDATSVQPNSGASGEYAGLRVIQAYHESRGEGHRDVCLIPLSAHGTNPASAAMVGYKVVPIKALNDGSLDLADLKEKAEKHKDKLAAFMVTYPSTFGVFEEGIEEACQIVHDNGGQVYVDGANCNSLIGLTSLGRVGGDVSHTNLHKTFSIPHGGGGPGVGPISCKSHLAPFLPSHPIVPTGGSTPITAVSAAPYGSASINTISWAYIKMLGGEGLTTVSKIALLNANYIAERLKPYYNLRYSNKNGRVAHECLIDLAEFEKSAGLKVPDFSKRLQDYSFHPPTAQWPISTCWLIEPTESESKEEIDRFIEALISIRKEIDEIVSGEQSKDDNVFKNAPHPLSLLTADKWDRPYSREKAVFPVPGLKKSKFWPSVGRLDDAAGDLNLICECGSVEEYA

SEQ ID NO: 8662 - protein, 550 aa, Arabidopsis thaliana
MNHVPSDQSFYIESEDEDDRKDYVEEDGGSHSDSSDDVYDENQAHIKPSSYTTAWPQSYRQSIDLYSSVPSPGIGFLGNNSMTRFGSSFLSSGLIRRHTPESLPTVTKPLLEEQADEQALPKHRLSSQGLLSPIPSRRGSMRKDEKSSMVSHEIPMSRNSSYGQAVLNGLNVLCGVGILSTPYAAKEGGWLGLMILFVYGLLSFYTGILLRYCLDSESDLETYPDIGQAAFGTTGRIFVSIVLYLELYACCVEYIILEIDNLSSLYPNAALSIGGFQLDARHLFALLTTLAVLPTVWLRDLSVLSYISAGGVIASVLVVLCLFWIGLVDEVGIHSKGTTLNLSTLPVAIGLYGYCYSGHAVFPNIYTSMAKPSQYPAVLLTCFGICTLMYAGVAVMGYTMFGESTQSQFTLNLPQDLIATKIAVWTTVVNPFTKYALTISPVAMSLEELIPSRHIRSHWYAIGIRTLLVFSTLLVGLAIPFFGLVMSLIGSLLTMLVTLILPPACFLSIVRRKVTPTQMMLCVLIIIVGAISSVIGSYSALSKIVEKLTN

SEQ ID NO: 8663 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 8664 - protein, 279 aa, Bdellovibrio bacteriovorus HD100
MKKEMSHRKKVRRRVNKKSTALVFDKYELYRKAVQSAENDVVFIWNTFRELKGKQPRVFREDFCGTFALSTEWIKLHPRHEAVGVDLDPEPMAYGKANYLTKLKPEQQKRMKLVEGNVLDPNLAKADIVAAMNFSYFCFKKRDVLKKYFANVLKTLNKDGMFLVDIFGGSQCYEAIEDAIKHEGFTYYWDQTNFDPVTNEALFHIHFKVGGKKIEQVFTYDWRMWSISEIRDIMEEVGFKKSHVYWEGTAPDGSGDGNFTRVDHGEACQSWIAYVVGEK

SEQ ID NO: 8665 - protein, 90 aa, Arabidopsis thaliana
  misc_feature (23)..(23): Xaa can be any naturally occurring amino acid
  unsure (1)..(90): unsure at all Xaa locations
MLSYATMVASPAHATMVAPLRGXKYSAGFPSTRKANNYITSITSNRGRVNCMQVWPSILKKKFETLSYLPDLTDSQLANEDDYLIPNKSI

SEQ ID NO: 8666 - protein, 235 aa, Pinus pinaster
MSSRLFRCSCPNCQDSCCFFSEIFSFTRRKGNSCSASSCRGKVSSLVSLSSHGDYQSAYRQWISGALALPAAVYMLQDPSAEAAELERTFIAIKPDGVQRGLISEIVSRFERKGYKLVAIKLVVPSKQFAEQHYEDLKERPFFNGLCEFLSSGPVLAMVWEGQGVIKYGRKLIGATDPQNSEPGTIRGDLAIIVGRNIIHGSDGPETAKNEINLWFKPEELVNYAHNSEKWLYGK

SEQ ID NO: 8667 - protein, 137 aa, Botryotinia fuckeliana
MTGGKSAGGKAGTTKNAQSRFHPKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQSLLPKKTAKTAGGKPASQEL

SEQ ID NO: 8668 - protein, 669 aa, Cryptococcus neoformans var. neoformans JEC21
MPKTNKGGKGQKNKVYALPTAQKKKGLDVPKFQMKAKAASQAQLAPTSLGALSSNDQDISNSSFDLGNVTFHDVIDTSLTKDSSSKAFMRELRKVIERSDVIIQVLDARDPEGTRSRWVEDEVRKRDMQGKKLLGVLNKIDLVPRANLEAWLKHLRHSFPTMPFKSSTQSQKQHLSQNAVPLAQPSTVPGKQAVLQELPTTSASLGAPALLHLLKQYALSTPHSSLTVGVVGYPNVGKSSLINSLKRSRACAVAAMPGKTRVVQEVALDKGVKILDCPGVVLEDVGSHMEGEEGRRRQAEIMLRNCVKAELVQDPISPVEVILNKVEPAQLQKLYNIPAYDDVRDFLIKMALIRGRLGKGGVPDLEASAVQVLRDWNSGKISYYTTPPKFHPSSAPAPAPVVTPVLAPNEAAGDMEMGGDKVGDAKILTTLSEAFTIEGLFDNLGDDAAWEGEGVVKEEGIAEDADLIAPEPVIPPALVPEQTAPRASLTKRPFMGSEDESDADSDASDSFRPRTTLGPSPASFQSTSSNALHFPAQPQTAQANRLFTAEELAVLPSGLLDRKKVKSLAKKAKKRRAAVERTEGELMAGFMDMEMDEPGAREETEVQMPAFEQKSKKDKRKEKKETQAKQRKEMTKVVAEMEIDEDARKEAEFANFLANMNADGSDEEL

SEQ ID NO: 8669 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 8670 - protein, 476 aa, Acinetobacter sp. ADP1
MSQKKSVIFKNLLPVIKQYQQAGFTHEKIVALLKDQHDLDLVTTETFKSYLYRYAKVTPTPSESLKMTNTIQTPREIKKSSKLEHVCYDIRGPVLRAANEMEEQGHKIIKLNIGNPAPFGFEAPQEIINDVALNLPNAIGYTDSKGIFPARKAICQYYQQKGIRDMHVNDVYVGNGVSELIVMAMQGLLNDGDEMLVPMPDYPLWTAAVNLSGGTAIHYKCDEENSWYPDIVDMESKITPNTRGIVVINPNNPTGSVYPRHVLQQIVALAKKHDLILFADEIYDKIIYDGIEHVALASLAGDQLCISFNGLSKSYRVAGYRSGWMAITGDKSRAKDYIEGLDMLASMRLCANHQAQYAIQTALGGYQSINDLIRPSGRLYEQRNIAWEMLNEIHGVSCVKPEGAMYCFPKLDPNIYQVEDDEQLMLDFLRAEKVLLVQGTGFNWPTHDHFRLVFLPAENELREAITRLSRFLATRR

SEQ ID NO: 8671 - protein, 560 aa, Synechococcus sp. WH 7805
MEFELRTSRALPESVDQSTQSQTLFDTIPDALKAIRNGECVVVVDDERRENEGDLICAAQFATPEQINFMATEARGLICLAMQGDRLDSLDLPLMVDRNTDANQTAFTVSIDAGPEHGVSTGISAEDRSRTIQVAIQSESRPSDLRRPGHIFPLRARPGGVLKRAGHTEAAVDLAQLAGLNSSGVICEIQNADGSMARLPELQDYARQWGLRLISIADLIRYRLENERFVVRQAQASLPSQFGSFQAIGFRNALDGSEHVALVKGTIGSMKEPVLVRMHSECLTGDAFGSLRCDCRGQLEAALRRIEQEGEGVLVYLRQEGRGIGLINKLKAYSLQDGGLDTVEANEKLGFAPDLRNYGVGAQILSDLGIHRLRLLTNNPRKIAGLGGYGLEVVDRVPLEIDPGDYNAQYLATKREKLGHLFEERPERSHWVIGLDTDATGETVLSKLVQRMEQLALEHKLQLQAEHNPRLLALWERPRFVWSIQNSDPTLSVVQKLLVTMASWQETSRIGVLHAVKTIQISHPPQWLNREERSLESLRSTMEKADWFQRENQPALIHWS

SEQ ID NO: 8672 - protein, 295 aa, Listeria monocytogenes str. 4b F2365
MSKDIATPGRTTEILKKYGFLFKKSLGQNFLIDSNILTRITDTAEITKETNVIEIGPGIGALTEQLAKTANEVVAFEIDQRLLPILDDTLSAYNNIQVVHGDVLKADVEEVIAEQFAKPDLPLKIVANLPYYVTTPIILKLLHDNIPADSMTFMLQKEVADRISAVPSTKSYGSLTIAIQFYMEAELAFIVPKTVFMPQPNVDSAVIHLKRRKEPLAEVNDEEFFFEVTRASFAQRRKTLWNNLASKFPALKPRKDELVEGLNAIGIDLIRRGETLDIPEFAKLSNFLGDFLKEK

SEQ ID NO: 8673 - protein, 256 aa, Colwellia psychrerythraea 34H
MTRQAIVAANWKMNGDSALVDTMVSGLADIELSSHVDVVICPSFPYLSELNQKIKAANLNEAIHVGSQNVSEHESGAYTGEVSTAMLQNLAINYVIVGHSERRSIFKETSTQVAKKVHAALNAGLTPILCIGESEAERATGETETVLSAQIQPVIDEIGIEKFKDVVIAYEPVWAIGTGKTASSAMAQETHQFIRKFLAQQNEQVADKVPLLYGGSVNAANCEELFAQTDIDGGLIGGASLKAEQFKIICSAAKGK

SEQ ID NO: 8674 - protein, 579 aa, Ustilago maydis 521
MPAFPSSSAANSAGRHIELRSDNAYVQHLVHVINTVLERTGLALPVLVLTLLFLTIKYHNRTIFAKPPRKELYSPPAWPLIGHTLQAMKYTDNILDWFLEQSRKHPVGFSASIAGTGSGQMNFIYRPEYIEYVQKTNFENFEKGQAVKTRFSDLLGQNGIFNSDGHVWKTQRKMASHIFSVYQFRTWVQTVVQREMDSVVGILDALTEGKSSSDPATLLLPDLFFRYTLSSFGKMAFGSDIDCLSADPSCLEREVEFSNAFDFVQMVIDKRFRKPMWQLIERFSSEGRKNARMVKKINSFSGQIIEQRLREREAGIQKEKMTSDGKEGKDLLDLFMDITTDRDDLISVVLNFIIAGRDTTAQGLSWLFYELMKNPQYVEEIRSEIRNVLGNTDGSIRKLDYDTTKDLVFTQACFNEAIRLHPPVPKNGKRAIKDDVVVPQGPTAAGLPPIKIYAGELLSWSDWVIARNPEVWGPDCCEFKPMRFIETVTNEDGTKTRSLKNFGQWKFHVFNGGPRLCLGMTLANYEALSIIAAVMNRYDFGWGTKAQGQTADWPLKYLPSVTHPSQMYTATVVRRDELM

SEQ ID NO: 8675 - protein, 185 aa, Oryza rufipogon
FGSVYRGRLSIKGTVTEAAVKQLDRNGMQGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSLQARPSDFGLAKVGPVGDRTHVSTRVMGTYGYCAPEYALTGKLTTCSDVYSFGV

SEQ ID NO: 8676 - protein, 212 aa, Triticum aestivum
  misc_feature (107)..(107): Xaa can be any naturally occurring amino acid
  misc_feature (124)..(124): Xaa can be any naturally occurring amino acid
  unsure (1)..(212): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWTMWKLPMFGXATDATQVINEVEEVKKEYPDAYVRIIGFDNMRQGQCVSFIAFKPRGCEESGKALNSSLTTGQYIKCHGQFWQPLNIAFGFSLPPFNLS

SEQ ID NO: 8677 - protein, 359 aa, Brassica napus
  misc_feature (268)..(268): Xaa can be any naturally occurring amino acid
  unsure (1)..(359): unsure at all Xaa locations
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGXGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 8678 - protein, 165 aa, Zea mays
MAAEKRTIGMGMDYSPSSKAAARWAVDNLIKAGDRLVLVHVLPKGVDSSHKELWKTTGSPLIPLSEFMEMNLQARYGLNPDKETLEILRAVSKSKQVEVLAKVYWGDAREKLCEAVDDLKVDSFVLGCRGLGPLKRALLGSVSNYVVNNATCPVTVVRGPTGLSA

SEQ ID NO: 8679 - protein, 497 aa, Brucella melitensis 16M
MCLKRHIGEGAATRIRAQCDYAFTNIRGACMNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVPGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGGRASVVMVFIFFAFVLWALTQEPDTLAAMKVTPLWFVLLGIAYWVMKLKQKQS

SEQ ID NO: 8680 - protein, 185 aa, Glycine max
MISFQCSDKLGLSLELGSFMAGVMISTTDFAQHTLDQVEPIRNLFAALFLSSIGMLIHVHFLWNHVDILLASVILVVVVKTAVAVLVTKAFGYSLKTSFIVGISLAQIGEFAFVLLSRASNLHLVEGKMYLLLLGTTALSLVTTPLLFKLIPAVMNLGVLMHWFPSESSSQIEGKASVIEGNRML

SEQ ID NO: 8681 - protein, 177 aa, Zea mays
  misc_feature (113)..(113): Xaa can be any naturally occurring amino acid
  misc_feature (168)..(168): Xaa can be any naturally occurring amino acid
  unsure (1)..(177): unsure at all Xaa locations
MQGAVLVAIAAAIGNLLQGLDNAAIAAAVLYIKREFHLETDPALEGVVVATSLFGATIVTIFSGPVSDVIGRRPMLIVSSLLYFAGGLLMLWSPSVPVLLVARLVDGFGVGLXVTLVPVYISETAPPEIRGFLNTLPQLTGSLGMFLSYCMIFYMTLGDSPSWRYMLXVLSVPSLDY

SEQ ID NO: 8682 - protein, 228 aa, Chlamydophila pneumoniae J138
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQHGKNVFVSAHGNSLRSLIMDLEKLSEEEVLSLELPTGKPVVYQWKNHKIEKHPEFFG

SEQ ID NO: 8683 - protein, 497 aa, Oceanobacillus iheyensis HTE831
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 8684 - protein, 168 aa, Glycine max
MIFSPSVTTVNRAGAGVVALFTGLMSMAGFPTENTNSDITYIASNCGRVQCVRVWPPFGKKKFETLFYLPDLDDAQLAREVIYLLRKGWIPCLEFELEHGFVYREHNRSPVLYYGLYWTMWKLSMCGCSDASHVLRDLLDAKSAYPCGFMRIIICHNVTQVHRISFIV

SEQ ID NO: 8685 - protein, 86 aa, Glycine max
MSSGIRAWSVAASVGIVEALKDQGICRWNHALRSAQHHLKNHVGSFSQANKLSSSAMISTTLKHEKANQSEESLRTVMYLSCWGPN

SEQ ID NO: 8686 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 8687 - protein, 424 aa, Myxococcus xanthus DK 1622
MDTPVKKHPSLPRPIQGELKLDRSNQLLAEARRLVPGVTQSMMKRPEMFALGAFPVFLAKGKGALVEDVDGQEYIDFIGGLGANMLGHNDPAVVNAIREHLEEGVLHSLPTPVEVSAAQTLVDLIPGAEMARFFKTGADATSAAVRLARHITGKQKIITVGYNGWHDHFMFDTPGVPAALAALTLRMPLFTPPDEPALLASIEKNASELALVLLSVPYNRPLTPAFLQQVRATCTANNVLFALDEVVTGFRLAVGGAQEFFDVRADFVTLSKSIAGGMPLSAIAGPAKHLSRLSELQVSTTFGGELLSLYVCDAVLKGYRDGAYIQHLAHLGRKLREGVNAQAEAAGSSLRVIGYDAIPFFLFAKDPTEHAKQMQPFQAGMARRGILLRRDVTFLSTAHTEEQIDYAIEMTGEVLRSLAQPAAA

SEQ ID NO: 8688 - protein, 458 aa, Erwinia carotovora subsp. atroseptica SCRI1043
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 8689 - protein, 118 aa, Triticum aestivum
MRHKLHTFFCSMFAEPLFFSLAQSRDSYSDMLEGGNFSNQETLYEVLSVRKDATYDEIRAAYKSAVLNTHPDKAQMALNPLVSSSERNEFLSVQKAWEILRYPKSRAEYDKQLQSSRQ

SEQ ID NO: 8690 - protein, 144 aa, Coxiella burnetii RSA 493
MAIERTLSIIKPDAVAKNVIGQIYSRFEKAGLKIIAAKMCHLSKPQAEKFYAVHKDRPFYPDLVKFMTQGPVMIQVLEGENAIVKNREIMGATNPKEALPGTIRADFADSIDANAVHGSDGPETAKEEIAFFFKPDESFNSIGV

SEQ ID NO: 8691 - protein, 431 aa, delta proteobacterium MLMS-1
MGIERSRELFARACKYIPGGVNSPVRACKAVGCEPLFVERASGSKVYDADGNEYVDFVCSWGPMILGHNHPAVVAAIRETLENGTSFGAPTSKEIELAELVVDALPSVDKVRFVSSGTEATMSAARLARGYTGRSKVIKFDGCFHGHADSFLIKAGSGVITLGIPGSPGVPEDIVKNTLSIPYNDAEILEKTLRDPELDIACVIIEPVAGNMGVVPPAPGFLETLRQLTSELGIVLIFDEVITGFRLSLGGAQQYYGVIPDLTCLGKIIGGGLPVGAYGGKREIMDQIAPDGPVYQAGTLSGNPLAMAAGAATLRELGRAGFYDELEEKSARFAARLADLAQRHLPGKTTLNRVGSMMTTFFNPGPVNDHATATLSDTEMYAAHYRNMRQQGIWLAPAQYEAAFISAAQSEQDLELALEKTEWSFKKLRKR

SEQ ID NO: 8692 - protein, 468 aa, Methylococcus capsulatus
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGANGNGMHVHQSVAKDGKNLFSGDLYGGLSETALHYIGGYISMPKALNAFCNASTNSYKRLVPGFEAPVMLAYSARNRSASIGIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTACDEHSSVEFDMYYSL

SEQ ID NO: 8693 - protein, 176 aa, Haemophilus somnus 129PT
MENILQLNKGDLCFTEYQFAGRGRRGREWQSPFAGQLMVSFYWTFNPTVSLNGLSSVLGLATAEVLNEMGAEVKLKWPNDLLLFGRKLAGILVEIVNAKNGLLNFIVGIGINLSLPQENKIDQPWAELLETLPEIDRNDLAIQLVKKWYQYLTIFEQQGMHAFFQRWIKLDYFFGQ

SEQ ID NO: 8694 - protein, 511 aa, Streptomyces coelicolor A3(2)
MSTPEPVLAGPGILLVLDGWGSADAADDNALSLARTPVLDELVAQHPSTLAEASGEAVGLLPGTVGNSEIGHMVIGAGRPLPYDSLLVQQAIDSGALRSHPRLDAVLNEVAATSGALHLIGLCSDGQIHAHVEHLSELLAAAATHQVERVFIHAITDGRDVADHTGEAYLTRVAELAAAAGTGQIATVIGRGYAMDKAGDLDLTERAVALVADGRGSPADSAHSAVHSSERGDEWVPASVLTEAGDARVADGDAVLWFNFRSDRIQQFADRLHEHLTASGRTVNMVSLAQYDTRTAIPALVKRADASGGLADELQEAGLRSVRIAETEKFEHVTYYINGRDATVRDGEEHVRITGEGKADYVAHPHMNLDRVTDAVVEAAGRVDVDLVIANLANIDVVGHTGNLAATVTACEATDAAVDQILQAARNSGRWVVAVGDHGNAERMTKQAPDGSVRPYGGHTTNPVPLVIVPNRTDTPAPTLPGTATLADVAPTILHLLGHKPGPAMTGRPLL

SEQ ID NO: 8695 - protein, 462 aa, Geobacillus kaustophilus HTA426
MEQKQPQLHRGLEERHISLMSLGAAIGVGLFLGSASAIEMAGPAILLGYAVSGAIMFFIMRALGEMAVEHPVAGSFSRYAYQYLGPLAGYLTGWNYWFLWVVTCIAEITAVGIYMQFWFPDTPRWAWALAALVLMTFINFLAVKAYGEFEFWFALIKIVTIVAMIIIGLGMILFGIGNGGVATGISNLWKHGGFFPHGISGVLMSLQMVMFAYLGIEMIGVTAGEVKNPQKSLTKAINSVFWRILIFYVGALFVIMSIYPWNEIGEKGSPFVLTFEKIGIHAAAGIINFVVLTAALSSCNSGIFSTSRMLFNLAEQQEAPSAFGRLTKRGIPGAALIATALVMLVGVYLNYVSEKVFQWVTSIATFGAIWTWAVILLSQLKFRKQLSAEQAQRLTFKLPLYPYSSYVSLAFLIGVAALMAYFPDTRIALIIGPAWLLLLTAVYFAKGMHRRQHGQAEEKQAG

SEQ ID NO: 8696 - protein, 371 aa, Brucella melitensis 16M
MSYNQKQVVDAICAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVMRGPDVAAFAEEHKLHRVTVADLIAYRQRKETLVRRIGDAPVETCAGKAHAYSYELPWEPMQHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 8697 - protein, 614 aa, Staphylococcus epidermidis RP62A
MEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDVSLYYRKDLSDSRKLSDDITMIEIADYEEDLLKRLGLFERDIVVCSTNDDNINKSVALMAKNHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 8698 - protein, 271 aa, Staphylococcus aureus subsp. aureus MSSA476
MKLVFYGAGNMAQAIFTGIINSSNLDANDIYLTNKSNEQALKAFAEKLGVNYSYDDATLLKDADYVFLGTKPHDFDALATRIKPHITKDNCFISIMAGIPIDYIKQQLECQNPVARIMPNTNAQVGHSVTGISFSNNFDPKSKDEINDLVKAFGSVIEVSEDHLHQVTAITGSGPAFLYHVFEQYVKAGTKLGLEKEQVEESIRNLIIGTSKMIERSDLSMAQLRKNITSKGGTTQAGLDTLSQYDLVSIFEDCLNAAVDRSIELSNVEDQ

SEQ ID NO: 8699 - protein, 590 aa, Kluyveromyces lactis NRRL Y-1140
MTITKFVSEHPQTDPKWWKEAIVYQVYPASFKDSNHDGWGDIKGIDSKLEYIKELGANAIWICPFYDSPQEDMGYDISDYEKVWPRYGTNEDIFNLIDRAHGLGIKIIVDLVINHCSSEHAWFKEARSSLDNPKRDWFIWKAPKGFDSNGKPIPPNNWRSFFGGSAWEYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKEQEITQLFEFEHVSVGRKPGNVGVVNFKLSEFKDGIAAAFQFIDKTDSWSTVYIENHDQPRSVTRFGDDSPEYREISAKLLALLETSLTGTLYVYQGQELGMINFRDWPIEKYEDVEVKGMYKMMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANEKLFAFTKKYGEKVLYVVLNFSKEEIEFSFLEGYNSYDYIFGNYPEAEIDTGSNKLQPWEGRFYYAN

SEQ ID NO: 8700 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 8701 - protein, 470 aa, Bdellovibrio bacteriovorus HD100
MTGKDVLKFANEKGAKMVDLKFCDMLGTWQHLTVPLHQLTAEAFEEGYGFDGSSIRGWKGIEESDMIIMPDPSTAMMDPFMQVPTLSLICDVCLPETLQAYNRDPRQVVKKAIAYMQSTGIADTAYFGPEAEFFIFDDIRYEQTNNSAFYMIDSDEAVWNTGRDEGGKNLGYKIRPKEGYFPALPTDSQQDLRTEICLELERCGMQVERHHHEVASSQGEINFRFDTALNMGDKMMWFKYIVKNVAKRYGKTVTFMPKPIFGDNGSGMHIHMSLWKDGKNLFAGNKYAGLSEMALHYIGGVLKHAPALCGIINPTTNSYKRLVPGFEAPTKLAYSFKNRSAAMRIPNSGPNPKAKRIEFRTPDPSANIYLAEAAILMAGLDGIINKINPGDPLDKDIYGLPPQEAAAIPSVPGTLEESLNHLMKNCSFLKKGDVFTDDLIETWVQYKIDKEVRPVQQRPVPYEFHLYYDC

SEQ ID NO: 8702 - protein, 566 aa, Streptomyces coelicolor A3(2)
MIVNEPVPDTFEDTPAKDRDPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRRNPDGPYGDYYVWADDDKQFQDARIIFVDTEASNWTYDPVRKQYYWHRFFSHQPDLNYENPVVQEEMISALKFWLDLGIDGFRLDAVPYLYQEEGTNCENLPRTHDFLKRVRKEIDAQYPDTVVLAEANQWPEDVVDYFGDYAAGGDECHMAFHFPVMPRIFMAVRRESRYPVSEILAKTPAIPSGCQWGIFLRNHDELTLEMVTDEERDYMYAEYAKDPRMRANIGIRRRLAPLLDNDRNQIELFTALLLSLPGSPILYYGDEIGMGDNIWLGDRDAVRTPMQWTPDRNAGFSSSDPGRLFLPTIMDPVHGYQVTNVEASMASPSSLLHWTRRMIEIRKQNVAFGLGTYTELPSSNPAVLAFLREHEDDLVLCVHNFSRFAQPTELDLSAFDGRHPVELFGGVRFPAVGDLPYLLTLGGHGFYWFRLRKDAA

SEQ ID NO: 8703 - protein, 456 aa, Mesorhizobium loti MAFF303099
MLDKKTNIATDDPKAWLAQHGINEVECLVPDMNGVLRGKALPTAKFLKALEDRALYLPSSAFLVSIDGRYSGSIDEGFAYSDPDMRMVPDVSTLCLAPGAGAGKAYVFADAFHMDGRPWMASPRHVLRAVLDLYRQRGWRAVVAPEVEFYLTAPNPDPDRPLTAPVGANGRAEGVQHPYDMVALEEFEPVIRRVYDYAAAAGLPLDTLIHESGTAQLEINLLHGDALPLADQVLLFKRLTRQAAQQCGMHATFMAKPIAAQAGSSMHLHMSVVDEAGNALFASDDDADTEMFGHFIGGLQTYVPEIMPLFAPNVNSFRRIRPNHSAPANIEWSHDNRSCGLRVPAGGRSARRVENRLPGADSNPYLAIAGSLLAGYLGVQQKLARSAEASGNAYKIKSTLPKTMEEALDRFTACEPVRKLLGEDFSQTYLRVKSVELDLFQSVVTSWERDHLLLKV

SEQ ID NO: 8704 - protein, 549 aa, Staphylococcus aureus subsp. aureus MSSA476
MNKQWWKEAVAYQVYPRSFNDSNHDGIGDLPGMIDKLDYLKDLGIDVIWLSPMFKSPNDDNGYDISDYQEIMDEFGTMEDFDCLLKGVHDRGMKLILDLVVNHTSDEHPWFIESKSSKDNPKRDWYIWQDPKPDGSEPNNWESIFNGSTWEYDANTEQYYFHLFSKKQPDLNWGNPEVRDAVFEMMNWWFDKGIDGFRVDAITHIKKTFEAGDLPVPEGKTYAPAFDVDMNQPGIQTWLQEMKDRSLSKYDIMTVGEANGVSPDDADDWVGEENGKFNMIFQFEHLGLWNSGDSHFDVNSYKSVLNRWQKQLENKGWNALFIENHDQPRRVSTWGDDDKYWYESATSHAAVYFLQQGTPFIYQGQEIGMTNYPFESIETFNDVAVKNDYQIVKAQGGDVDALLAKYKDENRDNSRTPMQWDDTLNGGFTNGEPWFPVNPNYKTINVAQQLEDEHSVLQFYKDLIQLRKSNDVYVYGQFDLVDAENSQVFAYTRTLNEKQVLIVGNLTNHEAELTVPFDLSHGEVKLFNYDAKVNLKQLRPYEACVIELN

SEQ ID NO: 8705 - protein, 266 aa, Glycine max
MAIPYPHFIATEKAAMDAGLLHPSSPSVILTQDDLKKIAAYKAVEYVESGMILGLGTGSTAKHAVDRIGELLRQGKLKDIVGIPTSTKTHEQALSLGIPLSDLDAHPAIDLAIDGADEVDPFLNLVKGRGGSLLREKMVEGACKKFIVIVDESKLVNYLGGSGLAMPVEVIKFCWRFTAARLQKLFEEAGCVARLRTFGEKEKEEPYVTDNGNFIVDLYFERSIGDLKAASDAILQLAGVVEHGMFLDMATTVIVAGELGLTVKNK

SEQ ID NO: 8706 - protein, 358 aa, Rubrobacter xylanophilus DSM 9941
MNMGPQHPAMHGLLRLILELDGETIVRCDPVMGYLHRCQEKIAENRTYPAVIPLTDRLDYFANMHNEHGYCLAVEDLLGVEIPPRAEYIRVLMCELMRIASHLPSIGFLLLELGAFTPILYAFRERERIQNFFEAVTGARMMFHYIRIGGVKADLPPDIPEKIWEYVEGLEKRIKPDFIDLIEGNEIFIERTRGISRLTQEEAIELGLTGPPLRCTGVAFDVRRDYPYSVYPELDFEVVTDTAGDVEASYRVRIKEVYESIKIIRQCLEKMPEGEVMGDVGRRVRPPEGEGFGRVEGPRGEFAVHVVSDGSDTPYRVHYRDPSFVNMQLLQEKMPGHYLPDIMPIMGLVDPVSGGWDK

SEQ ID NO: 8707 - protein, 112 aa, Acidovorax sp. JS42
MIDHVRPAQLADWLTANAGSRPLVLDVREPWELQTASVTPQGFELVAIPMGELAARLDELDPARPVACLCHHGMRSLRVAGFLAHQGFDQVANITGGIEAWSHERDPAVPRY

SEQ ID NO: 8708 - protein, 248 aa, Debaryomyces hansenii CBS767
MARQFFVGGNFKMNGTRESVSKIVDGLNKAELPSNVEVVIAPPAPYIALAVNENKQKTIEVSAQNCFDKASGAYTGEISPEQIKDLGATWTLTGHSERRTIIKESDDFIASKTKFALDQGLSVILCIGETLEERKANVTLDVCARQLDAVARVVSDWSKIVVAYEPVWAIGTGLAATPEDAQETHKAIREHLSKSIGADAAEKTRILYGGSVNGKNAPEFKDKADVDGFLVGGASLKPEFVDIIKSRL

SEQ ID NO: 8709 - protein, 356 aa, Mycobacterium sp. JLS
MMLDFDEHMYHRRIMQEAFTRTRLAGYVEHIDRVASQVIANDWVENDARFLFYPAVKELTLDIASVVFMGHEPGTDKELVTKVNDAFTMTTRAGGAIIRTGLPPFKWWRGLQARKVLDNYFEQRVKEKRGSEGTDMLTVLCHTADEDGNTFSDQDIVNHMIFLMMAAHDTSTSTLTTMAYHLSRNPEWQERCREESERLGDGPLDIEALEKLETLDLVINESLRLVTPLPFNVRQTVRDTELLGHYIPANTDVVLWPSVNHHLPELWTDPEKFDPARFTEPRNEHKQHRYAFAPFGGGAHKCIGMVFGQLEIKTVMHRLLRRYRLEPPRPGYVSKLDYAGMPVPMDGMPIVLRPLR

SEQ ID NO: 8710 - protein, 173 aa, Flaveria trinervia
MASIPATVAAVPQTNMVAPFTGLKANAAFPVTKKVNGFSTLPSNGGRVQCMKVWPPVGKKKYETLSYLPELTEAQLAKEVDYLLRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 8711 - protein, 814 aa, Arabidopsis thaliana
MGKIGIVFFASLLFLLIIFPSCAFAAITRASPLSIGQTLSSPNGTYELGFFSPNNSRNQYVGIWFKNITPRVVVWVANRDKPVTNNAANLTINSNGSLILVEREQNVVWSIGETFSSNELRAELLENGNLVLIDGVSERNLWESFEHLGDTMLLESSVMYDVPNNKKRVLSSWKNPTDPSPGEFVAELTTQVPPQGFIMRGSRPYWRGGPWARVRFTGIPEMDGSHVSKFDISQDVAAGTGSLTYSLERRNSNLSYTTLTSAGSLKIIWNNGSGWVTDLEAPVSSCDVYNTCGPFGLCIRSNPPKCECLKGFVPKSDEEWNKRNWTGGCMRRTNLSCDVNSSATAQANNGDIFDIVANVKPPDFYEYLSLINEEDCQQRCLGNCSCTAFSYIEQIGCLVWNRELVDVMQFVAGGETLSIRLASSELAGSNRVKIIVASIVSISVFMILVFASYWYWRYKAKQNDSNPIPLETSQDAWREQLKPQDVNFFDMQTILTITNNFSMENKLGQGGFGPVYKGNLQDGKEIAIKRLSSTSGQGLEEFMNEIILISKLQHRNLVRLLGCCIEGEEKLLIYEFMANKSLNTFIFDSTKKLELDWPKRFEIIQGIACGLLYLHRDSCLRVVHRDMKVSNILLDEEMNPKISDFGLARMFQGTQHQANTRRVVGTLGYMSPEYAWTGMFSEKSDIYAFGVLLLEIITGKRISSFTIGEEGKTLLEFAWDSWCESGGSDLLDQDISSSGSESEVARCVQIGLLCIQQQAGDRPNIAQVMSMLTTTMDLPKPKQPVFAMQVQESDSESKTMYSVNNITQTAIVGR

SEQ ID NO: 8712 - protein, 122 aa, Vibrio vulnificus CMCP6
MKILIVDDFSTMRRIVKNLLRDLGFNNTQEADDGLTALPMLKKGDFDFVVTDWNMPGMQGIDLLKNIRADAELKHLPVLMITAEAKREQIIEAAQAGVNGYIVKPFTAATLKEKLDKIFERL

SEQ ID NO: 8713 - protein, 145 aa, Rickettsiella grylli
MTIQRTLSIIKPDAVKKNLIGKITTIFENAGLKVIAARMTLLKREHAEKFYEIHKNRPFFNELIDFICQGPVMIQVLEGPDAILKNRELMGATDPKQASPGTIRALFAENVSKNAVHGSDSIATAQQEIAFFFTPDQCFGSMTHD

SEQ ID NO: 8714 - protein, 284 aa, Streptomyces coelicolor A3(2)
MTPDHAHTPEGTEPMTQKVAVLGTGKIGEALLSGMIGAGWAPADLLVTARRRERADELRARHGVTPVTNAEAAKAADTLILTVKPQDMGTLLDELAPHVPADRLVISGAAGVPTSFFEERLAPGTPVVRVMTNTPALVDEAMSVISAGTHATAAHLTHTEEIFGAVGKTLRVPESQQDACTALSGSGPAYFFYLVEAMTDAGILLGLPRDKAHDLIVQSAIGAAKMLRDSGEHPVKLRENVTSPAGTTINAIRELENHGVRAALIAALEAARDRSRELATGTKD

SEQ ID NO: 8715 - protein, 129 aa, Cicer arietinum
MSISSVKSIQPRISFLVIFALFPLIIISMSDSALDSVSSSSSAPAVHIIYTEQPHEEEPETYHIRTLTAVLGSEEAAKEALLYSYKSAASGFSAKLTPDQVAQISKQPGVLQVVPSQKLQLHSGPNKLL

SEQ ID NO: 8716 - protein, 271 aa, Glycine max
MSVSCSNCFPDDDHSFLLCGEDSSGIMDSSPECSSDLDSSPPSEAESIAGFMEDERNFVPGFEYLNRFQSRSLDASAREESVAWILKVQAYYAFQPVTAYLSVNYLDRFLNSRPLPPKTNGWPLQLLSVACLSLAAKMEESLVPSLLDLQVEGAKYVFEPRTIRRMELLVLGVLDWRLRSVTPLCFLVFFACKADSTGTFTRFLISRATEIIVSNIQEASFLAYRPSCIAAAAILTAANEIPNWSVVKPEQAESWCQGIRKVSIYSIYAWF

SEQ ID NO: 8717 - protein, 298 aa, Glycine max
MQICVHSCVMNVCMICSERYAVVTGANKGIGFETVKELASNGVKVVLTARDEKKGHEAFERLKECGFSDLVIFHQLDVTESASISSLVEFVKTNFGKLDILVNNAGISGANLDEVEGSTFKWEELTQTNEMTEKCLTTNYYGAKKTTEAFLTLLQLSNSPRIVNVSSQAGLLKNISNEWAKGVLDDADNLTEERIDEVLKEFIKDFKEGSLATKGWPTFLSAYIVSKAAMNSYTRILAKKHQNMCINSVCPGFVKTDINKNTGILTVDQGAASVVKLALLPDGSPSGLFYIRQELSNF

SEQ ID NO: 8718 - protein, 397 aa, Methanosarcina barkeri str. fusaro
MLVNDEVLLDYGIKTGDIPEYPLNSMEPKVVLISHGHLDHCGAVPNLMYQDPEVFMTPPTADFTFLLGKDTLKLAESTLSGVAPFDPDDLQKLARRTQKIDCGETFKSHGYRICFYNAGHIPGASGIFLESESGESLFYTGDFNLKETRLVPGAAEFPETDTLILESTYFGEEHIPRKETEERFIESVLSTLDIGGTALIPAFAIGRTQEILMLLDAHGIQAYVDGMGRDVYKILKKYPEYLKNPELLDRAFGRAIPVKNHQRDSVLKEPSVIVTTAGMLNGGPVLYYLSRLYKDPSSKVLLTGYQVEGTNGRLALEHRMIETNGDVLALKPRVEQYDFSAHSGDSELKKLVKDFCRKGTERIFVMHGDKTESFAQWISEEIGVDAYAPANGESFTF

SEQ ID NO: 8719 - protein, 500 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 8720 - protein, 347 aa, Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 8721 - protein, 315 aa, Haemophilus influenzae R2866
MKIVFLDSTAIPKHISIPRPSFEHTWTEYDHTSSAETIERAKDADIVITSKVIFDRETLKQLPKLKLIAITATGTNNVDLVAAKEMGIAVRNVTGYSSTTVPEHVIGLIFSLKHSLAGWLRDQREAKWAESKQFCYFDYPITDVRGSTLGVFGKGCLGTEVGRLANAVGMKVLYAEHKDATVCREGYTPFDEVLKQADIVTLHCPLTETTKNLINAETLSKMKKGAFLINTGRGPLIDELALVDALKTGHLGGAALDVMVKEPPEKDNPLILAAKTMPNLIITPHIAWASDSAVTTLVGKVMQNIEEFVQQLNQK

SEQ ID NO: 8722 - protein, 259 aa, Oryza sativa
MASGRIALLCLLGLLLVAASPAAIAAKDDKIFYQITFMWPGAYCAQTKAGCCMPKTDVAPASDFYVAGFTVYNATTNSSLSSCSNTPFDMNQIGDVTRLMQYWNNIRCPSKSGQKGWKNAWETSGVCSDLTESAYFDTALALRDKINPLSRLVSNGIKPDFGLYSVKKIKEVIEEGIGAPALIQCSKGPFNKFQLYQIYVCVAEDAKTFVECPSPRKPYTCGDDILFHPFKKWMLKTNSTKSYAAADAIDQLLEAVMEI

SEQ ID NO: 8723 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 8724 - protein, 386 aa, Kluyveromyces lactis NRRL Y-1140
MFRKAIAIGGISLRRTFASSMIRKANQPGMMKAMVYYGANDLRFEDRAIPKIIDQRDAIIKMTNTSICGTDVGIWKGKSPEIEEIAVKNEGSFNGRVLGHEGTGIVTEVGDAVRNIKKGDKVIISCITRCGTCENCARGMYAHCMNDGGWALGYSIDGTQAEYVRTPFADTSLYALPEGLSDENAVLLSDALPTAHEIGVQMGNVKPGDSVAILGAGPVGMGCVLTSQLYSPSLLIVVDMDDNRLEMAKEMGATHTINSGKEDAVAKILEITNGRGVDCAMEAVGAQPTWDICQQIIKEGGHLANVGVHGKPVDFAIDKLWIKNLTITSGLVNTNTTSMLMKNCCSGKLQSDKLVSHHCNFKDMANNYNIFKHAAKEKALKLLISF

SEQ ID NO: 8725 - protein, 1092 aa, Arabidopsis thaliana
MAEDFARAVDDGLKLAKRIYFGKDRAVAAPRPPAPMDRSSTTQPYLPTAPMVYAVIPDPGIVDNPDLPSYQPHVHGRCDPPALIPLQMNSIELDVDCYLDTALVTVTGSWRVHCVMGSKRCDCRIAIPMGEQGSILGVEVEIPRKSYTTQLITAEDGNEFEKTALPETGGFLKPNIFTLTIPQVDGGTNLSIKMTWSQKLTYNQGQFFLDIPFNFPEYVTPAVKKISKREKIYLSVNAGTGTEVLCKGCSHQLKEKLRSAGKLRFAYEADVLKWSNTDFSFSYTASSSNIVGGLFLQSAPVHDVDQRDIFSFYLFPGKQQKTKAFKREVVFVVDISKSMTGKPLEDVKNAISTALSKLDPGDSFNIITFSNDTALFSTSMESVTSDAVERGIEWMNKNFVVADGTNMLPPLEKAVEMLSNTRGSIPMIFFVTDGSVEDERHICDVMKKHLASAGSVFPRIHTFGLGVFCNHYFLQMLANISCGQHESVYNTDHIEERMDKLFTKALSTILVNIAIEPLQSLDEVEVYPSNIPDLTSASPLMIYGRYRGKFPENVIAKGLLGDLSSFSTDLTVQSAKDMPLDKVFAKNVIDLLTAEAWFSEDKQLKEKIAKLSIQTGVLSEYTRMIQLENTEELKPSETGGKKKTTSNGEKQKMISRTIPLQSLGIGFGDKTATRENVPPGFGEQKAPDAAEKFVKAASSCCVSLCNKCCCMCCVQCCSKLNDQCVLVFTQLFTAIACIACFECCSTVCCSGDDGWVQRKLSGKKRVPTSDSSQEPSSPPLSKEVQGLPQDEETFLAIGTLGNNIFPKQEEEEEETDSSKDITPVNTDVTIGKKKSLSFLLKKMFVCTSGFKTPPPLLDLSRGDSLHNTRMEKMLRTILNKKIHPQRSNSIAKKYLESNHKIMDEARSSVDANKWVKTDSEYFNVVKKICLLINRGEEEKGRSGIGKLRSQKGKCEWRRLSFRIPMSWAAPDDIFFSTSLAAYLDKKLLVLLRDGRKLMGLLRSFDQFANAVLEEAYERVIVGDLYCDIPLGLYIIRGENVVLIGELDVEKEELPAHMVQVPEAEIKRAQKAEKEEMLLKGTMRKRMEFLDLD

SEQ ID NO: 8726 - protein, 504 aa, Rhodopseudomonas palustris CGA009
MQSRRPVMLVILDGWGWREDPADNAVLQAKTPTFDALWTNGPHAFLRTSGKSVGLPNGQMGNSEVGHLNIGAGRVVMQDLPRISDAIANGEIERAPGLVAFIDKLKASGGTCHLMGLVSPGGVHSLQDHACALAKILAKAGVKTVLHAFTDGRDTPPKSAVDDIVRLRAELPPNVPIATVSGRYYAMDRDNRWERVSKAYGVIADADGPRFADANAVIADGYAAGVNDEFIVPAVIGDYQGMRDGDGVLCFNFRADRVREILAALLDSAFAGFPRKQVKQIAAAAGMTQYSTALDALMGTIFPPQSLVNGLGQVVADAGLHQLRMAETEKYPHVTYFLNGGEEVPYPGEDRIMVPSPKVATYDLQPEMSAPELGDKAVAAIESGKYDLIVLNFANPDMVGHTGSLPAAIKAVETVDTQLGHIVAAIRKAGGALLVTADHGNCEMMRDPETGGPHTAHTTNPVPVLLVGDNGPLADGQLSDLAPTLLKLMELPQPAEMTGKSLIG

SEQ ID NO: 8727 - protein, 211 aa, Triticum aestivum
  misc_feature (202)..(202): Xaa can be any naturally occurring amino acid
  unsure (1)..(211): unsure at all Xaa locations
MMHGPAGGSGGGGGHGLGGTRVPTWRERENNRRRERRRRAIAAKIYTGLRAYGNYNLPKHCDNNEVLKALCNEAGWVVEPDGTTYRRGCKPPPQARTDPMRSASASPCSSYQPSPRASYNPSPASSSFPSSGSSSHITLGGGNNFIGGVEGSSLIPWLKNLSSNPSFASSSKLPQLHHLYFNGGSISAPVTPPSSSPTHTPXMKTDWESQC

SEQ ID NO: 8728 - protein, 451 aa, Streptococcus agalactiae 2603V/R
MNVVLKQRIPLKIKRMGINGEGIGFYKKTLIFVPGALKGEEVFCQISSVRRNFAEAKLLKINKKSKNRVEPPCSIYKECGGCQIMHLQYDKQLEFKTDVIRQALMKFKPEGYENYEIRKTIGMSEPEHYRAKLQFQVRSFGGNVKAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKEDDDLIDAYCGVGTIGLAFAGKVKSVRGMDIIPEAIQDAKENALYMGFTNTHYEAGKAEDIIPRWYSEGFRANALIVDPPRTGLDDKLLNTILKMPPEKMVYVSCNTSTLARDLVTLTKVYHVHYIQSVDMFPHTARTEAVVKLQRKE

SEQ ID NO: 8729 - protein, 418 aa, Ashbya gossypii ATCC 10895
MSIEEARKLAGRKDYAAAEAEYLALLNDAENQDKKRAQLQEQCILELGRMYAEAHDADKLAAFIPRSRDFMMQFAKSKTAKVLKTLIDQFDRIPDTLEKQIEVCKESIAFAQAEKRVFLKHSLSVRLATLYYQKGQYHDSLQLINELLKEFKKLDDKSSLVEVHLLESKVYHKLRNLAKSKAALTSARTSANSIYCPTLTMAELDLTSGILHCEDKDYKTAFSYFYESFEGFHNSADTSGKACQALKYMLLSKIMLSLIDEVNTILNAKYTKETYQSRGIDAMRAVADAYSHRSLLEFNTALKHYDRELMGDDLIRSHFNALYDTLLESNLCKIIEPFECVEVSHISKMIGLDPQQVEGKLSQMILDKVFYGVLDQGNGWLYVYTTPDQDATYDSSLELIVKLNTVVEQLFDKASVLN

SEQ ID NO: 8730 - protein, 325 aa, Cryptococcus neoformans var. neoformans JEC21
MSLGRTLKLNNGVVAPQIGFGTWQAAPGEVEKAVEEAIKVGYRHIDCALIYRVFDATGVYGTVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 8731 - protein, 404 aa, Tropheryma whipplei TW08/27
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRIAGRMIHSSFELAELVLSETLVATVPGEAFGTKGHLRLSYALDETSLLEGTGRLVEFFDTANSDMTKVF

SEQ ID NO: 8732 - protein, 484 aa, Burkholderia thailandensis E264
MRNESHTDRERRRSTKIVATLGPSSSTEAAIEALARAGADVFRLNFSHGTHADHASRHAAVRAIEARIGHPIGILLDLQGPKLRVGQFAGSRAQIAKGQPFVFDRDPAPGDSRRVSLPHPEIFDAARPGHLLLVDDGKLRFRVEAVSAARIETIALLDGIVSDRKGVSVPDATLAIPALSAKDRDDLEFGLSLGVDWVALSFVQTAQDVRDARALIGSRAAIVAKIEKPQAVENIADIVDAADAVMVARGDLGVEMSLEDVPSVQKRIIRLARAAGKPVIVATQMLESMTLAPTPTRAEASDVASAVYDGADAVMLSAESASGQYPVEAVGFMRKIIATTEADPIQPQLMKAIVTAHAPNATDAIGAAIEVVSDTLRLGVAVTYTASGATAIRLSRLRPSTAILSLTPRADIARRLTLAWGVRSRVALEATGIENIVEIAIEAAHAEGFATDEYPIVVAAGVPFGHPGSTNLMRIVWPTEMTRQ

SEQ ID NO: 8733 - protein, 369 aa, Colwellia psychrerythraea 34H
MNLNTPQEIIADIALGKMVILMDDEDRENEGDFIMAAEKVTPAAINFMATHGRGLICMPMSREKCETLKLPLMVDKNEAQFSTNFTVSIEAATGVTTGISAADRATTVLAAANKEATHLSIVQPGHIFPLIAKDGGVLNRAGHTEASVDLARMAGFESAAVIVEILNEDGTMARRSDLEVIAQKHDIKMGTIADLIEFRNATETTIERVSQCKLPTAFGEFDLTVFKDTIDGQAHFALTKGEIKADEPTLVRVHLENTFRDLLFSQRESISTWPIANALEKIAKEGGVLVLLGKHESPNELINLVEKYAKIDAGETVKETNRHIGSRNVGVGSQILANLGVSKMRLLSSQTKYHSLSGFGLEVVEYIAD

SEQ ID NO: 8734 - protein, 476 aa, Rickettsiella grylli
MKRFKRTKIVATLGPATDSVAVLQKMIAAGLDVVRLNFSHGKADDHIKRADYVRKYAKAANREIAIMADLQGPKIRISCFKKGAIFLKKNALFILDADLDEEEGDECVVGIDYKELPRDVHSGDSLLLDDGRIVLKVKKIQKNKIFCRVEVGGKLSDNKGINRKGGGLSAIALTEKDKKDLKIAVKLDADYIAISFPRSAADINLARSLLKKAKGHAGLIAKIERSDAIPVIDEIIRASDAVMVARGDLGVEIGDAELPAVQKHIIQRARSLDKAVITATQMMESMIHSAIPTRAEVFDVANAVLDGTDAVMLSAETAIGDHPALVVEAMARICLGAEKQAKTRISRHRVECQFSRPDEAIAMAAMYTANHYDIKAIIALTESGATPLWMSRIRSGLPIYGLAHNLKTTRRLALYRGVYPLYFNIDELCPENIAHLAIKELKKHKILKKGEHVLITYGDLLKTTGGTNTLKILEVD

SEQ ID NO: 8735 - protein, 594 aa, Synechococcus sp. WH 7805
MAVIDLNRRTKIVATIGPATESAERIRELIQAGATTFRLNFSHGDHSEHATRMATIRQVAHELGVHIGILQDLQGPKIRLGRFEEGPITLGKGDHFSLTSKKVRCNQTVATVTYDKLADEVTAGSRILLDDGRVEMRVDRVDLADQTLHCVVTVGGVLSNNKGVNFPDVQLSVRALTPKDRQDLAFGLQQGVDWVALSFVRNPSDMQEIRELIRKHGFTTPVVAKIEKFEAIDQIDAILPLCDGVMVARGDLGVEMPAEEVPLLQKDLIHKANSLGIPIITATQMLDSMASSPRPTRAEVSDVANAILDGTDAVMLSNETAVGDFPVEAVETMATIARRIERDYPQRPIDTHLPSTIPNAISGAVSSIARQLNAAAILPLTKSGATAHNVSKFRPSTPILAITSEVAVARKLQLVWGVTPLLIETQKSTTATFTLAMGVAQEMGVLKDGDLCVQTAGTLAGVSGSTDLIKVGIVSAVLGRGTGIGNGSISGKVRIARTASDCARLEPGEILVASDTNADYLDAFREAAAIITECGGEESHAAVIARRLGLSVITGVANATRDLREGEVVTLHIKEGAVHRGTGSNMLMKLDTML

SEQ ID NO: 8736 - protein, 479 aa, Salmonella enterica
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTAGDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRPWGKYNVIDSGKNYLVRCITVKPGEKFVAQMHHHRAEHWIVLSGTARVTKGEQTYMVSENESTFIPPNTIHALENPGMTPLKLIEIQSGTYLGEDDIIRLEQRSGFSKEWTNERS

SEQ ID NO: 8737 - protein, 269 aa, Azoarcus sp. EbN1
MTAPTTEQPFTAAAIAAPLGTLASAFDVRLLGECASTNSELIDAPPADDGRIPVVVADRQTAGRGRRGRLWQSWPGGSLTFSALWRFQPGAPVPAGLSLVAGLAVVRALEKLGVEGLQLKWPNDVLVHGDKLAGILVELLPGRARTPAAVVGIGLNLRLPAGTSIPDQPGVTDLAAHLAELPDRSALLASLLAELHALFETYAAAGFPALRGAWQQRNAFADLPVRVSGEGRELDGICAGVDEDGALLIRSDDGLVRILSGEVSLRVRQ

SEQ ID NO: 8738 - protein, 621 aa, Klebsiella aerogenes
MDSHTLIQALIYLGAAALIVPIASVLGLGSVLGYLIAGCIIGPWALRLVNDAEAILHFAEIGVVLMLVAMGLELDPQRLWKLRASVFDGGALQMVACGVLIGLFCMLLGLRWQVAELIGMTLALSSTAIAMQAMNERNLTVSQMGRSAFAVLLFQDIAAIPLVAMIPLLAASGGATSLMAFALSALKVAAALALVVVLGRYLTRPLLRFVARSGLREVFSAVACSWSSALGLLLEEVGLSMAMGAFLAGVLLASSEYRHALENDIEPVKGLLLGLFFIGVGMSIDFAPWSPNPLRIVILLVGFPAIKMLMLWLIAQPLGVPRAQHRWFAVLLGQGSEFAFVVFGPARMADVLDGEWPKALTLAVALSMATTPILLVLLTRLEKSSSGQARDADEIDEEQPRVIVAGFGRFGQIAGRLLLSSGVKMVILDHDPDHVDTLRKFDMKVFYGDATRVDLLESAGAEKAEVLINAIDDPHVSLELVARVKEHFPHLQIISRARDVDHYIQLRQAGVEAPERETFEAALKSGRMTLEALGLGAYEARERPDLFRRFNLQMVEEMVAMAENDPRRGVAVFKRTSDMLTGIINEDRHHLSLVQRHGWQGTEEGRHTGDIADEPENKPSA

SEQ ID NO: 8739 - protein, 454 aa, Magnetospirillum magnetotacticum MS-1
MIRTLWEAGADVFRLNFSHGSHDDHLERFKEIRRLEAELGRPIAILADLQGPKLRLGVFKAGKVVLKPGQTFRLDLSPEPGDTTRAPLPHPEILSALTPGSELLLDDGKVRLRVEACGSDFAETVVVVAGPLSDRKGVNVPDAVIPLSALTEKDRHDLAFALELGIDWIALSFVQRPEDVEEARALIGERARILSKLEKPSAIDRLDEIVALSDAVMVARGDLGVELPPEDVPGLQKRIIRSCRAAGKPVVVATQMLESMIEAPTPTRAEASDVATAVFAGADAVMLSAESASGRYPVEAVTMMSRIISRAESDPNYLDGLGSGCAKPEANDADAISAAVCQVTGIVSVAAIVAYTTSGFTTLRIARERPASPILSLTPNAATARHVALAWGVHSVHTEDAANVEDMVAKASGIATREGFTEDGKPLVIIAGMPFGTAGSTNLLRIVRVPRTSL

SEQ ID NO: 8740 - protein, 257 aa, Porphyromonas gingivalis W83
MESKKNSWSEGYLIHLPETASTNSYLSDLLMQDPDLPAWTVVMTDNQTAGRGQQGNSWFASPGLNLTFSVLLRPTMLPAQQQFDLSRLCALSVLHTLYDLLPSAEMLSIKWPNDIYYGDRKIAGILIEHSLTGSNLDYSILGVGLNINESDYPSYLPNPTSVRIILGHSVDRIEIFRSFMQEMRSLYRHIEEHTADQLHTRYMQCLYRRVGYHPFQNKEGRFDAIIADVLPSGELLLVRADGRKSSYAFKEIAYVLC

SEQ ID NO: 8741 - protein, 52 aa, Brassica napus
MAKLYVQAFPPADLNKNTEWFMYPGVWTTYIIIVFFSWLLVLSVFGCTSWHR

SEQ ID NO: 8742 - protein, 269 aa, Triticum aestivum
  misc_feature (259)..(259): Xaa can be any naturally occurring amino acid
  unsure (1)..(269): unsure at all Xaa locations
MAGTISRIRLENFMCHSSLHIELGEHVNFITGQNGSGKSAILTALCIAFGCRAKNTQRAATIKDFIKTGCSYAAIAVDINNQGEDSFKPDVYGNLIKLERRITESSSSTILKDQHGRKVANRKDDLNEIIEHFNIDVENPCVIMSQDKSREFLHSGNDKDKFKFFFKATLLQQVNELLETIRDQLNNADSVVQELEKSIKPVMRELDELREKIKNMEHIEEIAHDIDNLKKKLAWSWVYEVDQQIEEQTVRLQKLKERXPACQERIDRN

SEQ ID NO: 8743 - protein, 226 aa, Anaplasma marginale str. St. Maries
MGVPSASRQSACVFGERMFLISERLKSVQPSPTLEVSRLAAELRSQGVDVISLGAGEPDFDTPDHVKEAAIAAIHAGKTKYAPVDGIPELKEAVVLSIQSDYGLAYSTDQVLIGSGAKQCIYNLFMATLDPGDEVIIPAPYWVSYTDIVSISGGKPVVVDCGEEFKLTADLLERAITPRTKWLIINSPSNPTGVVYSRDDLRAIADVLLKHPTVYVMTDDIYAKLV

SEQ ID NO: 8744 - protein, 367 aa, Thermoplasma acidophilum DSM 1728
MAEWTEVNFGPQHPSMHGVLRLRVKLDGEIVKEVEPIIGYLHRNAEKIGELQFYCDNMIYFDRMDYVAAMNMEVGYLEAAEKLLDIEVPERAQWIRVMMAELNRIASHLVWLGAFGLDLGMLTPFFYCFKEREKILKIFTEVSGSRQQLNYMSIGGVYQDVTDEALDHIKTFIREFPKELNKIESLFVKNDVFISRTKGIGILSKEMAIDYGVTGPMLRASGVEYDVRKAQPYLVYDKVNFDIPVSFKGDNLARFLVRVEEMRQSVKIVEQTIQKLPAGPYFNQKAKKPLMIRLRGQGEVYARTESPKGEFGVYLIGDGSLRPYRVRVRSPTFKNLSVLPALAKDQMIADLISIGGSIDLVFGEVDR

SEQ ID NO: 8745 - protein, 480 aa, Bifidobacterium adolescentis
MRKAKIVDTIGPATESLEGITSLVEAGMDVARLNRSHGTPEDHLKVYNNLRAAAKATGRNVAALVDLQGPKIRCGWFKKNADGEDKVQLTEGQEFVITTDDIEGDEHITSTTFKGLPGDCHAGDPILIDDGKVRLEVTKVEGNNVYTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVARGDMAVECPLEEVPLATKRCIELARQYAKPVIVATEVLGSMVSSPVPTRAEASDCANAVLDGADATMTSNETAVGKYPAVTVNTMSRISTFATEHGFDRIPELKNLDMSSTGAVSSAAVDLADKLNAKAIVAYTQTGSTVHRVSRERPATPIYGITNNEHTFHWLALSWGTESFLVDEDYHDKSRKDLMVFTDKVLKDAGKVSDGDKIVVLSSAQGEHQPGRTDSIYVHTVGACD

SEQ ID NO: 8746 - protein, 408 aa, Flavobacteria bacterium BBFL7
MNQQNKLKILNDPIYGFITIPNEDLFTIIEHPFFQRLRRITQMGLSYLVYPGAHHTRFHHALGCLHLMQKAVQVLRSKDVEISYDEEGALYKAILLHDIGHGPFSHAMEHSFVNNVSHEDISILFMEALNTEFNGSLTLAIKIFKGEYHRPFMMQLISSQLDMDRLDYLKRDSFYTGVAEGNINSQRLIAMLNVKDDELVVEQKGIYSVEHFLSSRRLMYWQVYLHKTGIGAEHLLQSVFVRIKELLQKGEKLEIPADLNFFLQHDVTLDDFNLETLQRFSRLDDTDLVTTLKYGAQHEDFVLKELCQMILNRQLLKIKFTKQPVSDSKLNKKIKILKSVYDLSDHEAKYFIFSGAVHNLAYAKAKPIKILLKNGKLVELIKAGEEASFKALAKQVTKYYYCYPKVQD

SEQ ID NO: 8747 - protein, 75 aa, Zea mays
MRQQRGGVGAGRREDDPGLLTRAVDRAFRFVRLAEFEIFFVLFFLIAFFLFKDLMSQPQYNQLFVKKPDLDNPWP

SEQ ID NO: 8748 - protein, 173 aa, Triticum aestivum
  misc_feature (105)..(105): Xaa can be any naturally occurring amino acid
  unsure (1)..(173): unsure at all Xaa locations
MAVRAVTMLAVAALVVVAAVLAGGASAQSTSGCTQTLIGMSPCLNYITGNETAPSKSCCSQLAAVVSSKPECLCVALNADPAALGLGHRRQDPAPSAFPDQCGVXTPPLSNCASAPTASPSSGSPAGQTPTSSGAGSKSTPTADVGSGGGSLQSSAGIVAGFIVAAVYAVSAM

SEQ ID NO: 8749 - protein, 284 aa, Glycine max
MDSYEATRIVFSRIQNLDAENASKIMGLLLLQDHGEKEMIRLAFGPEALVHSVILKARKDLGLPSNSPPTPSTPPSPSPFISRQNSNTSSRLSVSGINLPPPLTIPNPSASWPTMSELQTDLVAGSSTSLSSLPFYANGGSDPIDEFQLQDQLSFLNDGSNTSISHKNNPDLFYPTYSDFSSSPTTAADPTLFPSYGWGGSLHRRSCSVNDACLGTEDPNSGLGWKPCLYFARGYCKNGTSCRFLHGGLGDADAAMVGSPSKIEMMEQCHELLRSKSGQQQRLA

SEQ ID NO: 8750 - protein, 376 aa, Debaryomyces hansenii CBS767
MSRNLPLLASAEVVKHNTQNDCWVTLYNRKVYNVSGFIDQHPGGGDIILPYAGKDVTAIMADTISHEHSESAYEMLDDEMLVGYLATDEEERELLNNKNNTPVEVRLEDSSSVDLYEFHDSLPPAEKLAIQTDYEEDIKKHKFLDLNKPLIPQMLCSTFSKEFYLDQVHRPRHYGKGSAPLFGNFLEPLSLTPWWVVPAVWLPPNFYIFYVGFVNQDKLVALSFWVMGLFVWTLVEYCMHRFLFHLDGYLPEHPVALTLHFLLHGVHHYLPMDGYRLVLPPTLFVLLAYPFYKLVFAIFPFYMACSGFAGGTLGYILYDVIHYVIHHTKLPQFLQDIKTYHLEHHYKNYEMGFGVTSRFWDVIFETEITSTFQKRN

SEQ ID NO: 8751 - protein, 741 aa, Medicago truncatula
MNVPATRKDLMIVNMGPQHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGMRMMHNYFRIGGVAADLPYGWIDKCFDFCNYFLTRVIEYQKLITRNPIFLERVEAVGVVGREEVINWGLSGPMLRASGIQWDLRKVDNYECYEEFDWEVQWQKEGDSLARYLVRIGEMMESIKIIQQALEGIPGGPYENLEIRSFDREKEPEWNDFEYRFIGKKSSPTFELPKQELYVRVEAPKGELGIFLLGDQNGFPWRWKIRPPGFINLQILPQLVKRMKLADIMTILVQDINYFSGLESFKEVYGILWILVPILILVLGITISVLAIVWLEREISAGIQQRIGPEYAGPFGILQALADGTKLLFKENLIPSRGDIRLFSIGPSISVISILISYSVIPFGYNFVLSDFNIGVFLWIAISSIAPIGLLMSGYGSNNKYSFLGGLRAAAQSISYEIPLTLCVLSISLRAIRLSNSLSTVDIVDAQSKYGFWGWNLWRQPIGFIVFLISSLAECERLPFDLPEAEEELVAGYQTEYSGIRFGLFYVASYLNLLISSLFVTVLYLGGSNISIPYIFVSEFFEINKTYGVFGTTIDLFITLAKTYFFLFVSIITRWSLPRLRMDQLLNLGWKFLLPISLGNLLLTTSSQLFSL

SEQ ID NO: 8752 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 8753 - protein, 164 aa, Arabidopsis thaliana
  misc_feature (33)..(33): Xaa can be any naturally occurring amino acid
  misc_feature (152)..(152): Xaa can be any naturally occurring amino acid
  misc_feature (157)..(157): Xaa can be any naturally occurring amino acid
  unsure (1)..(164): unsure at all Xaa locations
SSTIARFTWGTACAVSAVTRKANNYITSITTTXGRDSCMMVWPPIGKKNVETLSYLPDLSDVELAKEGDYLLRNKWIPCVEFELEHGFVYREHGNTPGYYDGRYWTMCKLPLFGCTDSAQVLKEAEECRMEYPGAFIRIIGFDNTRQVQCIXFIAYXPPSFTEA

SEQ ID NO: 8754 - protein, 321 aa, Synechococcus sp. WH 7805
MPLPAFLGPAAIGVAAAAGAYVLWSRRNRAYLSSESVASAYDAWTEDRLLETLWGDHVHLGHYGAPPRNKDFRRAKADFVHELVRWSGLDQLPPGAKVLDVGCGIGGSARILARDYGFDVLGVSISPAQIRRATELTPEGMTCRFAVMDALDLELNDGEFDAVWSVEAGPHMPDKQRYADELLRMIRPGGMLAIADWNRRDPLDGPLNRQERWVMHQLLTQWAHPEFASIRGLQHNLETSVYSKGPIAVANWNQQTLPSWNDSILEGLRRPSAVLRLGPSAIVQGLRETPTLLLMRWAFARGMMQFGVFRLNGDQERSELG

SEQ ID NO: 8755 - protein, 520 aa, Burkholderia thailandensis E264
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 8756 - protein, 894 aa, Zea mays
MADSGGSPAMEGDGVRLDTETEGGVSGNSLVTPPPALMGPDIAEMSIGEEGEQRVRPPMSNISSREMDTPQILRSHAKNIDPTIVPTVGMTFKDVDDAYKFYKRYAYEVGFPLKKYREKTFSKWINCSREATKIELVNLEHNHEFITDEAEKQHLRCNKIRDAEYINFVGAMHDSRVPQHCIVDFISEMHDGPENVPVTAQDLKNMRAARRRENCSNDVAKLLAFFRECKKQNPQFFCDFQLDDDGKIVSIFWSHASMQGEYADYGDAVTFDTTHKTNIYDKPLGMFVGANSHLQCTMFGFVLLGDETVQTFEWAFNSFKTCMGCEGPRVMLTDQDPAMPIALRTVFPKTVHRLCLWHVQNRFMPFLNEIYARFAVKDFKTTFQSIIHHPLTPHEFECAWEMMLEEFNLHEDITLRKLYEIRKEWIPAFFKNDFCGVMVSTQRSESMNRLVKQSHVDANTPLHEFAKQMMKMLHSRKMKESKEALVSKAQRTTNTLYRFEVRVSRAYTRAIMNRFEESMKYATAYKILKDPDGCDNEWIVQHTKRSNKIVWGQHQFKISADIEAGEYTCECKQWEHTGLLCVHLLRAFMHLQIEKIPSKYILQRYTVSSRKDVLFERIDKSFRGKDGVTKSYRQKMLLTKTMKVVRQACMSKAGYDKAIDVLDELDVVLSRLEPDIGCNESTDVSDNEEDKEEELNKINASDGMEDDNTITCHNKDSHNTRTGCEHALTIITTGNQENNMRFSHEVGDTSSPCHVAHEQMENIAASSEAKKRLDFNVDVINLSMPDRARPKGRTIKNSEDRIMRLGAKGEKKKNRRCHLCGIADGHNSRTCLSVEENRARLAKLSNRKRGRPAGSRLNNKTTAPQWNETSTAKKHRIDEEVENEEADEHMDLGE

SEQ ID NO: 8757 - protein, 277 aa, Pavlova lutheri
TRLVLTSALFAFSPQSVTSRLNRSALRTPAQQVVMATQDELKKLAGYKAVDDYVRSGMVVGLGTGSTAAFAVERVGMKLKSGELKDIIAIPTSVRTKEQAEALGIPLVTLGTHSDLDVAIDGADAVDPRLNLIKGGGGALLREKMVEVCAKKFIVIVDDTKLCAGLGPSFPLPVEITPFCWEHTLRKVAACPAAAGCEAKLRLGSAATGSKVDGTDPAVTDNDNYIVDLFFKQPIADPVALAAQLKATVGVVDHGLFCGMTTACIIAGKDGISVQTP

SEQ ID NO: 8758 - protein, 469 aa, Azoarcus sp. EbN1
MNAQEVMKMIQENEVRFVDLRFTDTRGKEHHVGLPVSAFEEDHFEHGHPFDGSSLAGWKGIQASDMILLPEAGSAYIDPFFDETTVVLTCDVIEPSDGKGYDRDPRSIAKRAEAYLKSTGVGDTAFFGPEPEFFIFDSVEWSVDMSGVYSKIISEEAAWSTADKFEGGNTGHRPRIKGGYFPVPPVDSLNDIRAAMVLALEACGVPVEVHHHEVANAGQCEIGTKFSTLTKRADWTQVLKYIVHNVAHQYGKTATFMPKPIVGDNGSGMHVHQSIWKDGQNLFAGNGYAGLSEMALYYIGGIIKHARALNAITNPGTNSYKRLVPHYEAPTKLAYSARNRSASIRIPYVANPKGRRIEARFPDPLANPYLAFSALMMAGLDGIQNKIHPGDPADKNLYDLPPEEDAKIPTVCTSLDQALEYLDNDREFLTRGGVFSNDFIDAYLALKGEEVDRMRITTHPVEFDMYYSL

SEQ ID NO: 8759 - protein, 466 aa, Tropheryma whipplei TW08/27
MRTNFEWFEEAKRFIPGGVNSPVRAYAAVGGTPRFLAKAQGAYVTDIEGREYVDLVSSWGPLILGHAHPKVIDAVINTAHRGMSYGAPTTLEVELAELVCNRICNAQGIKPVERLRLVSTGTESCMTAIRLARCFTGRDLIVKFSGHYHGHADPFLIDAGSGLVGHPSSGGVPESVAKNTLVVPYNDLAVLEYLFEAYPNQIACIITEACPANMGVIPPDPGFNARVADLGHSHGALIIFDEVITGFRVGSGGFWALETSLASQQPTQAVSEGSVSDSAYSAYVPDLFTFAKVLGGGLPIGAIGGRAEIMDLLSPSGPVYQAGTLSGNPLATAAGLATLRLADSNIYEHMNRVARALINEIQSAFHDAGVPCTVQSAGNLFGISFSAIAPRDFTQATSQEHWRYSNFFHSMLNSGVLLPPSVYEAWFVSAAFDDRAIERVVNALPDAVRAAGSAPARPKGFEPPTF

SEQ ID NO: 8760 - protein, 345 aa, Streptococcus agalactiae 2603V/R
MKVATFIEPGKMVITDTPKPVIEQETDAVIKIVRACVCGSDLWWYRGISKRESGSFAGHEAIGIVEEVGTKVTDVSKGDFVIVPFTHGCGQCPSCKAGFDGNCTNHQAAKNVGYQGQYLRYTNANWALVKIPGQPSDYDNETLNSLLTLSDVMATGYHAAATAEVKEGDTVVVMGDGAVGLCGVIAAKMLGANRIIAMSRHKDRQELALTFGATDIVEERGDEAVKRVLDLTNQAGADAVLECVGTEQSVDTATQIARPGAVIGRVGIPQNPDMNTNNLFWKNIGLRGGIASVTTFDKSVLLDAVLTHKINPGLVFTKSFVLDDIQKAYEAMDKRDAIKSLVIVD

SEQ ID NO: 8761 - protein, 299 aa, Archaeoglobus fulgidus DSM 4304
MRISRESTDYRVYRILSENPLSGEKLAKKLGISRTAVWKAVQKLKECGVYVESNASGYTIAGEEELNPYEVARLAFESGFKEVHFYDVTDSTNSRAKEYGKPDALFFANRQTAGRGRHGRKWLSEEGGLYFSVTLSPPLDYSELPKLTLIAGLSVAEAIPQSEIKWPNDVLIKGRKVCGILSELHGEVERPLVIVGVGINVKNPHPENGISLSELYDVSRREVFEQVIRNFSKNYRMLLDGRWCELRRRIERRCSSVGKAVRVTTPSGVAEGIAEAISEDGSLVVSGKKIYAGDCIHLR

SEQ ID NO: 8762 - protein, 348 aa, Listeria monocytogenes
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPNELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 8763 - protein, 472 aa, Mycobacterium leprae
MTRRGKIVCTLGPATQSDELIRALVEAGMDVARMNFSHGDYSDHKAVYDRVRVASDATGRAVGVLADLQGPKIRLGRFATGSTYWADGETVRITVADCHGSHDRVSTTYKNLARDAVVGDRVLVDDGKVGLVVSAIDGDDVVCTVTEGGPVSNNKGMSLPGMHVSAPALSDKDIEDLTFALNLGADLVALSFVRSPSDVELVHKAMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADALMLSEETSVGKYPLAAVKTMSRIVCAVEENSTAAPPLTHVPRTKRGVISYAARDIGERLDAKALVAFTQSGDTVRRLARLHTPLPLLAFTAWPEVRSQLAMTWGTETFLVPKMLSTDGMIRQVDKSLLELGRYKRGDLVVIVAGTPPGTVGSTNLIHVHRIGEDDV

SEQ ID NO: 8764 - protein, 432 aa, Oceanobacillus iheyensis HTE831
MKFTNSEKLHQEALQHIVGGVNSPSRAYKAVGGGSPVYMERGQGAYFWDVDDNKYIDYLAAYGPIITGHAHPHIAKAIAHAATTGVLYGTPTCLENEFAQMLKEAIPSLEKVRFNNSGTEAVMTTIRVARAYTGRTKIIKFAGCYHGHFDAVLVEAGSGPSTLGTPDSAGVPASTASDVITVPFNDIEAYKAALNKWGDQVAAVLVEPIVGNFGIVEPFKGFLQEVNELTHRAGALVIYDEVITAFRFTYGSAQQIYGVEPDMTAMGKIIGGGLPIGAYGGRKDIMEQVAPLGPAYQAGTMSGNPASMAAGIACLEVLKEEGVYEELDRLGKRLEEGILEQAREHGIHITVNRLCGALTVYFGVDQITNYAEADASDGEAFAKFFQLMLREGINLAPSKYEAWFLTTEHKDSDIENTIDAVGRSFAEMAKTL

SEQ ID NO: 8765 - protein, 134 aa, Debaryomyces hansenii CBS767
MRFTRVLRQAEEVLVKAASGNPTGLTGIYQHPNPRPALIALYNHTLTVLDTKFPKESVYKQSVEALTRNRLKVVQEEEITENIENKIGGGLIEEIIIQAHEELGLANDLSLLKCWEELEEKPLDDQWVYFGKKI

SEQ ID NO: 8766 - protein, 150 aa, Virgibacillus halodenitrificans
TKERTFLMVKPDGVQRNLVGEVVKRFESKGLKLAGAKLMVISKDGAAAHYAELGGGPFFGGLVGGATSGPVFAMVWEGLNAAATARQILGATNPSDAAPGTIRGDFGVSAGRNAIHGSDSAGSAAKEIGAFFGGGEAASGTPAAAADIYG

SEQ ID NO: 8767 - protein, 160 aa, Pyrococcus horikoshii OT3
MFQMSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 8768 - protein, 471 aa, Campylobacter coli RM2228
MIINGVNVFRLNFSHGTHEYHKNNLETIRKVSRELNTRVGILQDISGPKIRTGELKTPFELKKGDRLDFYYEKIIGEQIAPNHYKLSINQSEILNMLKLDEYVYLYDGSIRAKVTAKDSEKIETLIENDGFLNSNKGINFPNTKINIDVITQKDKKDLLWGIENEVDFLAISFVQNAHDIDEVREILAQNNAKISIFAKIEKFDAVENIDEIIASSDGIMVARGDLGIEVPYYKVPNIQKAIIHKANNASKPVITATQMLFSLAKSKTATRAEISDVANAVLDGTDAVMLSEESAVGIDPANAVDVMCQTIIETEKRYPYNKFNEFENLDNTDKIMRSSAHLATDLNADAIFSLTSSGKSAIKISRYRPDMEIIAVAHSEKTLNSLSIVWGVNPAILVNKSEDLTDLLRDSVKSSVEKGFMNKEKCYLLTAGFPTGVEGTSNLIRILAKSKLLTILNRLKFLSLFKSTSKI

SEQ ID NO: 8769 - protein, 520 aa, Oryza sativa
MGKFRKLGRHAAHRVSMLRTMVSQLVKHERIETTVAKAKEVRTKADQMVQLGKEAAFSTHGAAAIAGAALSPPPSESRRPRLAQRTATAPPGIGRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 8770 - protein, 273 aa, Pseudomonas aeruginosa PAO1
MSSHRPQHRLSVPDIQRRKGAGSLVALTAYSTPMARLLDPHADLLLVGDSLGMVLYGMPSTLGVSLEMMVAHTLAVMRGSRRACVVADLPFASYQESPRQAFRNAARLLADSGAQAVKLEGGEEMEETVDFLVRRGIPVLAHIGLMPQQVNAMGGFKAQGRDPESAERVRRDGLAMQRGGAFAVVIEGVGEPLARRLSEELAIPCIGIGASPACDGQVLVSEDLLGLSGEQVPRFVERYARLDREIDEAARRFAEDVRERRFPEARHCFAMRE

SEQ ID NO: 8771 - protein, 101 aa, Synechococcus sp. WH 5701
MALVLKQTAMASGITVTSNPDPAQLVSLGVSNWPTWGCEVSTFPWTYDEQETCLLLEGDVTVTPDGGKPVRFGAGDLVVFDAGLSCTWDVHAPVQKHYRFG

SEQ ID NO: 8772 - protein, 283 aa, Oryza sativa (japonica cultivar-group)
MVVRAGAYDDELIKTAGDLGDGRVERDVREEAGVDRNRQAYRTLLVTAPGLGQYISGAILFEETLYQSTVDGRRIVDVLAEQGIVPGINVDKGLVPLAGSDPESLEDGLVPIVEPEILLDGEHRVERTFEVAQKVWADTFFHMSENNVMLEGILLKPSMVTPGAESKDGAATPEQVAAASRRRCPASCSSPAASRRWRRRGNLNAMNQAAPSANPWRWRVSFSYARALQNTCLKTWGSRRENVAAAQGELAGAARQVHQRRRGRRGQRGHVRQELHLLKIIFD

SEQ ID NO: 8773 - protein, 352 aa, Zea mays
MAHAALLHCSQSSRSLAACRRGSHYRAPSHVPRHSRRRRRAVVSLRPMASSTAQAPATAPPGLKEGIAGLYDESSGLWENIWGDHMHHGFYDSSEAASMADHRRAQIRMIEEALAFAGVPASDDPEKTPKTIVDVGCGIGGSSRYLAKKYGAQCTGITLSPVQAERGNALAAAQGLSDQVTLQVADALEQPFPDGQFDLVWSMESGEHMPDKRKFVSELARVAAPGGTIIIVTWCHRNLDPSETSLKPDELSLLKRICDAYYLPDWCSPSDYVNIAKSLSLEDIKTADWSENVAPFWPAVIKSALTWKGFTSLLTTGWKTIRGAMVMPLMIQGYKKGLIKFTIITCRKPGAA

SEQ ID NO: 8774 - protein, 276 aa, Oceanospirillum sp. MED92
MNDHRYPVPSYFDFLIQDFHEGMGNRMVHLGHWDQPTATQQVNGASFAAAQKALEQELIRMGQLEDGLSVLDVGCGFGSTLQTIDSQFAHMQLLGLNIDPRQIAICEQIKATGHNTLSWQQGDACSMPFPDQCFDRIFCIEAMFHFPSRQKFFNEVARLLKPNGLLIASDIACTKTVDHQSIPGFAIEAALFDGYGPWPDLWGDEGSHSVMASKSGLKLEAFRDVSKETMPSHQLTVSSRADGRKDPGSSAQRAAMMLKWLQQQDILQYCYFTLRK

SEQ ID NO: 8775 - protein, 404 aa, Frankia sp. EAN1pec
MGGSVSAWSGRDSHPHVPACSLEPRAVQARDVVRPSSRAGHGPAPPGRPPPRQAPRKRPMRATYMYGAGDVRITDVGDPVLEQPTDALVRVVLACICGSDLHPYHSLAATPAGVPMGHEFIGVVEEVGGEVSTLRAGDLVIAPFAWSDGTCEFCREGLHTSCRTGGFFAAGGVGGGQAEAIRVPQADGTLVKVPVPEDSAILPSLLTLSDVFGTGYHAAVRAGVNPRTTVTVIGDGAVGLMAVLSARRLGAEQIILMGRHKARTDLGLEFGATDVVAERGEEGVARVRELTGGDGSHAVLEAVGYRAAYDQALGVVRPGGVISRVGVPQYADAPIGFPSLFGRNITLTGGPAPVRAYIETLLPAVLDGEVEPGKVFDRTVSLEDVPAGYRAMDDRKALKVLVRP

SEQ ID NO: 8776 - protein, 469 aa, Candida albicans
MATASTTTVYGGDEINAIVLDPGSYTTRIGYAGDDFPKVITSSYYGQVKNDKKKIFGESINVPRANYDIKPILKESIIVDWDAAIEQYQYYFDQQLKVVGPEQPILITEPIWTETSYRQQLVETFFENDEFRGIYIAKSPTCASFQQGRSNCLVVDLGHDSVLVTPVIDGICLLKSSMKTNYGGKFLSNEIQDYLIDTKKVVMEPSFKIKSKIPTTYPDPPKYELKNNNTIPTSSSSSLSQSFLEFQNEKIYHNFKEILEVPEKNSSSGTTTTTTTTNKDSSRLFELPTGQSIVIDRFKIAESIFDPTIYKFTNSKLSFPPNNGEISITQANEYRPLKRVRKNDDDEEEDSNQSTPKPEVNIRGISQLISHTLSNIDIDLRASLANNIIVTGGVSLISQLTERLYLELSNNNPGLKIRLHAVGNSTERINQAWIGGSVLASLGTFHQMWVTKEEYNEVGVDRILNQRFR

SEQ ID NO: 8777 - protein, 317 aa, Capsicum annuum
KVGINGFGRIGRLVARVILQRDDVELVAVNDPFITVDYMTYMFKYDSVHGQWKNNEVKVKDEKTLLFGEKPVTVYGIRNPEEIPWAEAGAEYVVESTGVFTDKDKTAAHLKGGAKKVVISAPSKDAPMFVVGVNEKEYKPDLNIVSNASCTTNCLAPLAKVIHDRFGIVEGLMTTVHSITATQKTVDGPSAKDWRGGRAASFNIIPSSTGAAKAVGKVLPSLNGKLTGMSFRVPTVDVSVVDLTVRLEKEATYDEIKAAIKEESEGKLKGIVGYTEDDVVSTDFIGDNRSSIFDAKAGIALSKTFVKLVSWYDNEWG

SEQ ID NO: 8778 - protein, 469 aa, Neurospora crassa
MSHQQPLSSSVQPTDIYGGDEVSALVLDPGYCNTRAGYAGEEMPKQVLPSFYGHINGRDVFGDEYIVPKPGFEVRNYMNRDSVVEDWDAATRMWEHVLVKRLQPERSTPPSKKGINISDDGDVPMEDDGNNNEDATDALEKPLAENPLLMTEAPWNSPKAREKAIEISMETWGVPAFWLSKTPVLAAFAAGKATALVIDVGGANTSVTAIHDGMVLKRSIQRSPVGGVWLSSQICKMWDGSEPKVDVVPRFMVESKKPVEAGAPAEANLRKFNFDIHPSFRAYEEERVLTEFKESVVEVWRGPQRFTTPGNEDAVRTQPGRVFEMPDGSNQMWREQRFKVSEGMWDETAAYNSTDEEGRVTKAQTIPALIKAALEGVDVDLRPNILGNVVVTGSTSLLNGFNDRLNHELAQMYPGVKIKIHAAGLTTERRFGAWIGGSILASLGTFHQMWISRKEYDENGAGIVEKRCK

SEQ ID NO: 8779 - protein, 313 aa, Capsicum annuum
GFGRIGRLVARVALQRDDVELVAVNDPFISTDYMTYMFKYDTVHGQWKHHELKVQDEKTLLFGEKSVRVFGIRNPEEIPWAEAGADFVVESTGVFTDMDKAAAHLKGGAKKVVISAPSKDAPMFVVGVNENEYKPDLDIVSNASCTTNCLAPLAKVINDRFGIVEGLMTTVHAMTATQKTVDGPSMKDWRGGRAASFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKKFVKLVSWYDNEWGY

SEQ ID NO: 8780 - protein, 226 aa, Zea mays
  misc_feature (97)..(97): Xaa can be any naturally occurring amino acid
  misc_feature (110)..(110): Xaa can be any naturally occurring amino acid
  misc_feature (117)..(117): Xaa can be any naturally occurring amino acid
  misc_feature (122)..(122): Xaa can be any naturally occurring amino acid
  misc_feature (138)..(138): Xaa can be any naturally occurring amino acid
  unsure (1)..(226): unsure at all Xaa locations
MSGSASRKLFQAARSIVLSASQRSSSVLAAEGRTAALTNFGRKILPSACSYHRQGSHAASGWGAIAAAVYMLQDQEAHTAEMERTFIAIKPDGVQRXISEIMTRFEKKLXAVPQLMXSKNLXKHYQFKGKAFFSGLCXFFSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 8781 - protein, 437 aa, Acidovorax sp. JS42
MAQGHLAPGPDQGYDLDANDETLPVLQQLRSRYGPICRVPSLTRPGDGLVIHDPDDIRRVLLTNRGNYVKGAGLERVRVLLGNGLIVSDGDLWVRQRRMIQPAFQGQATRGFAPVVRQVNADLLTRWSAHADSGEPIDLTHELSSVALEIVLRALFSADFDRLVETEGGSPFDLLTEESRRDLQFAARFRGLARFVRAIIETRRLEARVESDWLSMLMQARDKASGEPMPDRALLDEVMTLIVAGHETTASTLNWTWYLLARHPEAEAALHAAIANAAPTEAAPDQALATPFASADYVEQVLQEALRLYPPVWLFSRRAVQDDTLGGYHVPAGTDIFICPYLLHRDAAQWERPEEFLPARFMPDAAAGRHRFAYLPFSAGPRFCVGAGFAMAEMATHLTMVAERFRWVPVDAEPAEAEFQINLRTRHPLRMRLVSRR

SEQ ID NO: 8782 - protein, 312 aa, Medicago truncatula
MLLQTRNFTAPSCFTPTTKTNTKISTHPSNSISFRNTKCSVTVSTQLEQSKTENKIKKPFPAEVSRTIMDLARTGTLSTLTQQGYPLGVGVRFVVDSQDGNPFFYFNHNAIPTTNNNIDTPSSLHVKSGLRTPQCTLQGTLTNPQDPALIKRLVSLWKKRFGEEVNQDFMYFIAVDRVLHLDDFQEDGVWFTSLDYKNAQPDPLREFAENLVAEINTNNMEDITRFCNVYVDLDFQVTEAKVIWVDRLGLDMRLFSPNNGLFEVRIPFPREVTDEKGAKSTFNCMSQLAWEVERNFHPLDFEKVTELKHIKS

SEQ ID NO: 8783 - protein, 419 aa, Capsicum annuum
MAFSSLLKPTASLVRPSHRSQASCVGLQHSSNSVKLQSAIFGDVVSIAQSSSLQNSGACSIQPIRATATELPPTVPKSQTGGKTRVGINGFGRIGRLVLRIATFRDDIEVVAVNDPFIDAKYMAYMLKYDSTHGVFRGSISVLDDTTLEINGKQIKVSSKRDPADIPWGDLGADYVVESSGIFTTVDRASGHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLNKSASYDDVKAAIKYASEGPLKGILGYTNEDVVSNDFVGDSRSSIFDAKAGIGLSKSFMKLVSWYDNEWGYSTRVLDLIEHMALVAATS

SEQ ID NO: 8784 - protein, 182 aa, Triticum aestivum
  misc_feature (91)..(91): Xaa can be any naturally occurring amino acid
  misc_feature (108)..(108): Xaa can be any naturally occurring amino acid
  misc_feature (160)..(160): Xaa can be any naturally occurring amino acid
  unsure (1)..(182): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEXFNKVGFIFREHNASPGXYYDGRVLGQCGKLPYVPGATDATQVINEVEGGQERSTLDAYVRIIGFNNNAXKVQCVSFIAFKPTGCEGVPEGP

SEQ ID NO: 8785 - protein, 225 aa, Burkholderia xenovorans LB400
MSNLFALSSQQTHRSLTGRVQRALSAMRDGRPVVVVDDLDREDEADLVIAAERITVESMALMIRECSGIVCLCLTGETLQRLQLPPMVERNESRHGTAFTVSIEAKVGVTTGVSAADRVTTVRAAIADHARAEDLARPGHIFPLMARPNGVLERRGHTEGAVDLARMAGLKPAAVLCELMNEDGTMARGAQIVRFAAIHRLPVISIADIAAYRCAQELAVSATAV

SEQ ID NO: 8786 - protein, 371 aa, Acinetobacter sp. ADP1
MTKFTEITAAVTECKGADFELKQLKIREPQNDEVLVKIVATGMCHTDLIVRDQYYPVPLPAVLGHEGSGIIEAIGPNVKDLAVGDHVVLSYGFCGSCEQCSSGQPAYCQDFFGRNFSGGDPDGHSAVCSHDHHKIHDHFFAQSSFATYAISRENNAVKVSKDVPLELLGPLGCGIQTGAGAAINALKVAPASSFVTWGAGAVGLSALLAAKVCGATTIIAVDIVESRLALAKELGATHVINSKTQDPVEAIKEITGGGVKFALESTGRPEILKQGIDALGILGSIAVVGAPPLGTTAAFDVNDLLLGGKSIIGVVEGSGVPKKFIPALVSLYQQGKFPFDKLVKFYDFKDINQAAIDSHKGITLKPILKIG

SEQ ID NO: 8787 - protein, 255 aa, Brassica napus
GDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 8788 - protein, 150 aa, Triticum aestivum
MAEQTFIMIKPDGVQRGLIGEVISRFEKKGFYLKGLKLQNVEKSFAEQHYSDLSSKPFFAGLVEYIVSGPVVAMVWEGKSVVATGHKIIGATNPLASEPGTIRGDFAVDIGRNVIHGSDSVESARKEIALWFPEGIAEWRSSQHNWIYEA

SEQ ID NO: 8789 - protein, 144 aa, Zea mays
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPNYEEAEDDEAAREVVVGEVEVAKVAEGRDGVARVDVAPGLLQDQKQ

SEQ ID NO: 8790 - protein, 253 aa, Arabidopsis thaliana
MEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWFSIIFSVIYLLAQQPAFSKLGTAKKLTPMQLEDLLSDGNTTKYWLVGGFAACSSYWVRSSRCFPELSITYSNNLLSFGTVDLGLFPNTAAKFGISLAGGMSQLPTYILFEKGVEVSRFPDFYVDAAPSLPITKKLLCQHFELDRLLLDYINGT

SEQ ID NO: 8791 - protein, 526 aa, Vibrio vulnificus CMCP6
MSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 8792 - protein, 296 aa, Tropheryma whipplei TW08/27
MLRSLPQSKPLDDLIGRTIAVIGLGTMGAAIAEGIARARKAMNEEIPRGQFYCTKREYKFERNSVITSESVVLYIQDDPDANITVTQRSDLIIIAVRPEHIKHVLNSISPALDRKKLIVSLAKDVNLSNLAAMLPSGTAIVRCATNLPITVRHGFTGLSCNKHVLPSDVKAVYTLFELLGRCTMLSEEHLTIVSAITGFYPVYMLYMLTKIKEATEKLGLPRDISQAAVETAWIGYAQVVLKHKTTAKGLLRLIPRGPRSAVVKCLDRTDLGSVTYKVLLASIEQDSELLDGIIDQ

SEQ ID NO: 8793 - protein, 339 aa, Ustilago maydis 521
MAANIPSFTLNTGAKLPSVGMGCWQGQPGPGRDNELVDALVRAIKVGYRHLDTATGYRNEAEVGQAVRQSGVARSEIFVTTKLRPGGVHDVVQELENSLNELGIDYIDLWLLHWPQGFTKDDGGFGTGESFGLEHQKHLGPTFNETWAKMEDVFLNSHKGKVKAIGVSNFSIKNLEILAKTSKVTPAVNQIEAHPYLPEHELVKYCKHKSIHVTAYSPLGQYNASIHEDKDLNEIAKKHDVTAATVALSWAVQRGTSVAPKSTNEKRMKQNITLIKLTDEEMKQVDVISQDPTRSTRLNYFVVNKETGTVLGWTMDEMGWEVGFLEEPGKSTKRIAERK

SEQ ID NO: 8794 - protein, 149 aa, Zea mays
RAGVQYASKDVKALKSVADAHKDRSIHAYKKVLETYKEQLVDDPIVYAHLNQLYENLLEQNLLRLIEPFSRVQIDHVAALINLPRAVVETKLSELILDGKLKGILDQGSGDLIIFDEDTEDKTFETTLQVYKELNLVADKLYAKAARLH

SEQ ID NO: 8795 - protein, 380 aa, Methanosarcina mazei Go1
MTSARLKRVEESATIRISNIATRMIKEGTDVINFSLGEPDFDTPKNICDAAAKAMYEGKTHYAPSAGIPELRSAIAEKLRTENHLDVSEKDVLVTPGAKQGIFEIMMGSLDDGDQALLFDPAWVTYDACIRFAGADTVWVPTVPEKGFLPDNFAEYINDKTKLIVVNSPGNPTGGVFGKKTLQCIADIAIDHDLLVVSDEIYEKIIYDREHISIGSFDGMQERTITVNGFSKAYAMTGWRLGYLTAPPEIFKLLQKIQSHSVSSATTFVQYGGLEALQGPQEGVKAMVDRFKMRRDILIDGLNKMGLECKKPDGAFYAFANVSDYGNGTEVAEKLLKEAHVAVTPGIAFGSSGEDFIRISYATSIDRIREALDRLEKVFA

SEQ ID NO: 8796 - protein, 924 aa, Lathyrus sativus
MMELQVIWIIRLVVACVLCLCIFIISASSATEGFESIACCADSNYTDPKTNLNYTTDYRWYSDKSSCRQIPKILLSHRSNVNFRLFDIDEGKRCYNLPTIKDQVYLIRGIFPFDSVNSSFYVSIGATELGEVTSSRLEDLEIEGIFRAPKDNIDFCLLKEDVNPFISQLELRPLPEEYLHDFSTNVLKLISRNNLCGIEEDIRFPVDQNDRIWKATSTPLNALPLSFNVSIVDLNGKVTPPLKVLQTALTHPERLEFVHNGLETEDYEYSVLLYFLELNNTLKAGERVFDIYLNSEIKKESFDVLEGGSKYSYTVLNISANGSLNITLVKASGSKFGPLSPALKILQARPWIDETNQTDLEVIQKMRKELLLQNQDNEALESWSGDPCMLFPWKGVACDSSNGSSVITKLDLSSSNLKGTIPSSVTEMTKLQILNLSHNHFDGYIPSFPPSSLLISVDLSYNDLTGQLPESIISLPHLNSLYFGCNQHMSNDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALLIENNASEYMKSIDSLGGSNRYSIVMDKRGVPLTSTSAESTLPAQNVSHPQPR

SEQ ID NO: 8797 - protein, 179 aa, Zea mays
MVKRSKKSKSKRVTLRQKHKVLRKVKEHDMEKMVTKADPSKRIVLLHNKIDLVPKEAVEKWLTYLREEMPTIAFKCNTQEQRTKPGWKSSKLDKTNSIPQSSDCLGAENLIRLLKKYSRSHELKLAITVGIVGLPNVGKSSLINSLKRSRVVNVGSTPGVTRSMQEVQLDKKISDPAPW

SEQ ID NO: 8798 - protein, 226 aa, Malus x domestica
MGTGIIYMVMMVFSLILLILSSSTVGFDYYQFTQQYQPAVCHSNPTPCKDPPDKLFTVHGLWPSDSNGNDPKYCKAPPYQTIKILEHQLAIIWPNVLNRNDHEGFWRKQWEKHGSCASSPIQNQKHYFDTVIKMYTTQKQNVSEILSKANIKPGRKNRTLVDIENAIRNVINNMTPKFKCQKNTRTSLTELVEVGLCSDSNLTQFINCPRPFPQGSRYFCPTSIQY

SEQ ID NO: 8799 - protein, 299 aa, Gibberella zeae PH-1
MLAESVIEAVCAKTKELLMRESNVVHVRAPITVVGDIHGQFFDLIEIFRIGGYCPDTNYLFLGDYVDRGMFSVETISLLVCLKLRYPNRVHLIRGNHESRGVTQSYGFYTECSRKYGNANVWHYFTDMFDFLTLSVVINDQIFCVHGGLSPSIHSIDQIKIIDRFREIPHEGPMADLVWSDPDPERDEFSLSPRGAGYTFGAQVVKKFLAVNNMSHILRAHQLCQEGFQVLYDDRLSTVWSAPNYCYRCGNMASVLEVSDTGERFFNVFAAAPENDVHKDLQPGNEKSADGNALPDYFL

SEQ ID NO: 8800 - protein, 397 aa, Mesorhizobium loti MAFF303099
MKRIYVVGTADTKGEELAFLADAIAATGAAVSRVDVGTRDATIPVDISANDIAGHHPGGRDAVLGGNDRGAAVAAMGVAFARFAQSRNDIAAMIGIGGGGGTSIVTSGMRALPLGLPKIMVSTLASGDTAPYVDVSDIIMMPSVTDMAGLNRLSRVVLHNAAQAIAGMAARPAPPPDGKPSIGLTMFGVTTPCVTTIADALRSTYDCMVFHATGTGGRSMEKLADSGLLSGVIDITTTEVCDLLLGGVLPATEDRFGAIARTGLPYVGSVGALDMVNFWAPSTVPERYRGRLFYEHNPNVTLMRTSADECRAIGEWIGTRLALCDGPVHFLIPEKGVSALDIEGGTFFDREADAVLFEAIERTIKPNANRRVTRLPLHINDPEFAKAVAAFLDIARH

SEQ ID NO: 8801 - protein, 271 aa, Mesorhizobium loti MAFF303099
MIDKGVPIVGGGAGTGLSAKAEEAGGIDLIIIYNSGRYRMAGRGSAAGLLAYGNANEIVKEMAYEVLPVVRHTPVLAGVNGTDPFVIMPLLLAELKTMGFSGVQNFPTIGLFDGSMRQSFEETGMGFGLEVDMIAEAHKLDLLTTPYVFNPNEARAMTKAGADIVVAHMGVTTGGSIGATSAKSLDDCVTAIDAIADAARSVRKDVILLCHGGPISMPDDARYILDRCKGLHGFYGASSMERLPAETAIARQTADFKAVKLGEATMKKKKG

SEQ ID NO: 8802 - protein, 413 aa, Synechocystis sp. PCC 6803
MYSPGYVATSSRQSDAGNRLFVYEVIGLSQSTMTDGLDYPIRRSGSTFITVPLKRMNQEMRRITRMGGKIVSIKPLEGDSPLPHTEGIAKPSQSEGSGSEAVANPAPESNKTMTTTPKEKKADDIPVNIYRPKTPYIGKVLENYPLVREGAIGTVQHLTFDLSAGDLRYLEGQSIGIIPPGEDDKGKPHKLRLYSIASTRHGDFGDDKTVSLCVRQLEYQNEAGETVQGVCSTYLCNIKEGDDIAITGPVGKEMLLPPDEDANIVMLATGTGIAPFRAFLWRMFKEQHEDYKFKGLAWLIFGIPKSENILYKDDLEKMAAEFPDNFRLTYAISREQQNAEGGRMYIQHRVAENAEELWNLMQNPKTHTYMCGLKGMEPGIDEAFTALAEQNGKEWTTFQREMKKEHRWHVETY

SEQ ID NO: 8803 - protein, 270 aa, Anaplasma marginale str. St. Maries
MRTIRHKAYKSLGQNFILDPSMAEKIVSYAGSIEGYNIIEVGPGFGTMTEIILRSKVASLLAIEKDRRLSPMHKGLMQKYPNYRYIEHDVLEINLETMISAPSKMIANLPYNISVILLLRMLKYIHNFEKLTLMFQKEVAERLVAKPGTKSYSILSVLVQLLCDVEKVKDLQPGAFSPPPKVCSSVVNITPLGNLRFPVDYSYMLKMLKKAFGCKRKTVRNALGLPHQEFDALLAECRIPPSVRAENLSVEQLCAVSNFLQSRQYQFSTG

SEQ ID NO: 8804 - protein, 777 aa, Zea mays
MVFLNEDKAYEFYANYAETAGFSVRKGWLDKTAKNVTKSRAYVCSKEGFRPRSASIESKKPSLEARTGCQAHMTIKITASTKYVVTEFVADHNHDLETPLVDIQILKSEKLLAKVQQPPDPPKVVLIPNEYKNYTRTKRTKNMQLGDTQAICEYLQRMKGENPSFFYAIQVDEDDMFTNVFWADAKSIMDYNYFGDVVCVDTRYCTSDYGRPLLLFTGVNHHNQLIIFGSALIYDDSAQSFRWLFETFKSAMSGKQPKTVLTDQSAALSDAVSSWPGTIHRFSLLHLYLNATKISRDTLQGLETFASDFSRWLYEYEEDNFYSSWEILSEKYNIKDNEWFCKLYEDRERWALPYGRDTFCADIATTLRRDNTNTILTDLIKPEIDLQNFFNNYDKFLEEKRLAEQQADYLGAQITQRVAPLHLLWQAANLYTPTLFEMFRMEYEQISKCVVYSCGEIGPISEYQVTVKDRPQGQFVRFDSTECMVVCSCKKFEFMGLLCCHVLKILDLRNIKELPRHYILKRWRKDAQSESPENYGFAAIDEDPKFSLSKRYNALYRNLYKIAAKASESVEAYAFLENQYEQLVEQVEVLLQAKLHDKSSLSTVLKGNQPNMLNSEVNSSEHRRATGKKIKNVEVRRQQQSLDPNKKKKGRQVLLEPEIEIPLRVEPPTVSNDIQNHLRTTNQFLAPSHMMQAPYVAQQFGLGSLQGFPGMSPFGQIQEPTPLQQPHLQPPSFHSGPQITQAPPPDIQSLQFLSSNPQLGHQTTDQGQYTIPVWDFL

SEQ ID NO: 8805 - protein, 268 aa, Anaplasma marginale str. St. Maries
MVEHLTCNQGVVGSSPAAGSLVLSVELMSFLVVANWKMNGDTALVRDFLAAIDTSFASDLLNKGSLELVICPPFTLMSAFDSRCPSVRLGAQNCFSGVSKGCTGEISAAMLKECGCDYVILGHSDRRGTFAEENSDIRLKAESAIEEGITPIICVGETLQERNSGISSDILVEQCSKCCPKYGEFIIAYEPVWAIGGSTIPDLEIIRESFDTIRSHGSARTILYGGSVNQGNIRALKSQIDGLSGVLVGSAGTKVDEFCGIISNVLEL

SEQ ID NO: 8806 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 8807 - protein, 250 aa, Archaeoglobus fulgidus
MGLSRLGIETAYIGKVGSDEEGRILLADFEREGVSTDFVIRAEGRSGTAMIFVDEKGNRAILVDPGVNDTIAYDEIDVDSARKYDLIHLTSFICKNGLDSLNSQKRIVEEFDSVSFDPGMPYAERGLGDMEKILKNTTIFLPNRQEIEMLFSEDYRTAAERCIEMGIEIVAVKLGSEGCWIKKGDREVTVKPVSTKVVDTTGAGDAFNAGFLYGYLKGKDIEECGRLGNFVAAKCIEKYGAREGLPRSVD

SEQ ID NO: 8808 - protein, 183 aa, Pyrobaculum aerophilum
MPVEKTLLILKPDAVARGLVGEIISRFEKAGLKIVALKMVKASPEEIERFYPSSEEWLRSAGQKLLKAYQELGIDPRAKIGTDDPVEVGRIIKRSLVKYMTSGPIVVMVLKGNRAVEIVRKLVGPTSPHSAPPGTIRGDYSIDSPDLAAEEGRVVFNLVHASDSPSEAEREIRFWFREEEVLE

SEQ ID NO: 8809 - protein, 152 aa, Triticum aestivum
  misc_feature (69)..(69): Xaa can be any naturally occurring amino acid
  misc_feature (101)..(101): Xaa can be any naturally occurring amino acid
  unsure (1)..(152): unsure at all Xaa locations
MAPTVMASSATSVAPFQGLKSTAGLPVSRRSNGASLGSVSNGGRIRCMQVWPIRGHQEFETLSYLPPLXSTEASLSRSDYLDPSKWVPCLRFSKLGSSSRXAQPSPGYYDGRYWAMWNCLFPDHRRHVEGWKEVKKDTLTLFRIISQIVSHA

SEQ ID NO: 8810 - protein, 179 aa, Triticum aestivum
  misc_feature (80)..(80): Xaa can be any naturally occurring amino acid
  misc_feature (91)..(91): Xaa can be any naturally occurring amino acid
  misc_feature (109)..(109): Xaa can be any naturally occurring amino acid
  misc_feature (118)..(118): Xaa can be any naturally occurring amino acid
  misc_feature (131)..(131): Xaa can be any naturally occurring amino acid
  misc_feature (134)..(134): Xaa can be any naturally occurring amino acid
  misc_feature (137)..(137): Xaa can be any naturally occurring amino acid
  misc_feature (141)..(141): Xaa can be any naturally occurring amino acid
  misc_feature (143)..(143): Xaa can be any naturally occurring amino acid
  misc_feature (147)..(147): Xaa can be any naturally occurring amino acid
  misc_feature (151)..(151): Xaa can be any naturally occurring amino acid
  unsure (1)..(179): unsure at all Xaa locations
MAPTVMASSATSVAPFQGLKSTAGLPVSRRSSSAGLGSVSNGGRIRCMQVWPIEGIKKFETLSYLPPLSTEALLKQVDYXIRSKWVPCLEXFNKVGFVFREHNNSPGYXEGRYWTMWXLPISGATTPKKCXNKXEEXKKGXPXAYFXVNRXPKTCAKWNWVSFIPLRQPGLPRIWEGLK

SEQ ID NO: 8811 - protein, 328 aa, Petunia inflata
MAVNGASSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 8812 - protein, 359 aa, Arabidopsis thaliana
MSCFKSKFADELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALRRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 8813 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 8814 - protein, 1178 aa, Gibberella zeae PH-1
MTVASSLALVTGSTQGIGLAVAKELATKHNYHVLLGVRNTKAGEQIASDLRSEGHKVDVVELDLTSSESIDKAVAHIEQKYGYLDVLINNAGVLLDWDKDLTTWDIYHKTFTTNVIGTGCLTKGLLPLLRQAKTNPPRIIFVTSVMGSLEKATDESLFYYNIDYKVYDASKAAVNMLMFNFAREMDDVGGKVNSVCPGLVKTGLSGYHEMGTAPEVGAERIVELATTTDKKGPHKTISNSNGELPRYTACARKVDEKVAQGYPETSESLGTSFDFNDLMVDWVSSPSTISATQPITVYRDTSFWNISSDLQISMPPKSLSAKGDLTRVSNRLSSLQHASRIVMQMLYSYPRMMLRRQTFPPFIHPHWHQEHLPEALGNCMSIARLFESRTPETVSFLWKTIIAEQTRFREKVMIIYLIMAMTDSGTENRERVATLFETVELIGSRFLDLAGSYSTSEAAEPNTTWEVWIFAESRRRMSCLWLIISCVITIENGQTHSRCDELENLALPSSKMLWEARTLDEWQMEKNIFDAGSVAMTLGSHSSRDLANRSTRGPSDKSLVFNVMFIRHFHQTLSSSRFALPSTAMKQIGRQATLDGVFRPRSPKSKEFELPPSLPPTPPAPASPSPPASPARQERAVSFISITSDENEPDVQEYTGPPLCEEQQDLVDIIMSGKNVFFTGSAGCGKSTVLKAAIAQLEAAGKTVAITAPTGRAALNVDGITLFSFMGWGAIKHPKMSLAGLKDDICKKPNKKVRKILQATDVLIIDEVSMVENNFLTRMEAVLNHIRDQTRPWGGLQLIVTGDFCQLPPVLPFQHCCQCGTELDIPYQEADHPVDRIIECSCGHGPWNYEEDRWAFRSPAWEAAKFAYVNLKEIHRQSDRPFIEALQKCRLGIPLSSRELDMLLNHESEVENATRLVPTRVEAKKINAKKLEEITDYTSKDYTCEDGIWFPPSYDGPKDYLGERTKENTLKRFDDHRFNKKVELKQTQLVMLQVNLNLKKGLANGSQGEIVGWEKIDKDRLPSYEGKDGCLKEEHVLLFTEEYLRKFPNPDDQVWPVVRFNNGYRKTIYPVCVINHMGYQSQVLIYRTQIPLIPGWAITIHKSQGMTLDQVIVKLDKVFEVGQAYVALSRATSLRGLRIEEGNSHTLSAELGRNPEVHEFLERKFGRDLYADHAGSTI

SEQ ID NO: 8815 - protein, 551 aa, Azoarcus sp. EbN1
MHSRPVRQARRSAPRNPCLTPPRGRRPPLGRPGGRPDMQFSGLDCRFERLAAPLPMHRARVDATQWSALALAVATAKGRLVSLWGSDRRAMGDGFAVGAAYATAEGLLWAELGLDVVRPAYPDISRFFVPAVRMQRAAHDLVGIDAEDSGDSRPWLRHGAWPADYFPLRIENTGQERFAPQPDNYPFVFVEGDGVHEIAVGPVHAGTIEPGHFRFSVVGEKVLRLEERFGYTHKGIERRFMGMDIDEGARLAGRVSGDSTVAYAWAYAMAAESAAGVAVPERAAWLRALLLERERVANHLGDLGALGNDAAFGFALAQFSRLREDWLRANFEAFGHRLLMDCIRPGGVARDLDAAAAAQLRRDAVALVAEVAELKDIYDEHAGLQDRFVTTGRVAPELAARLGLTGLAGRASGQVADLRVDFPWPPYDKLAVTASTQFNGDVAARVAVRFDECFESLRLIDALLAALPDGPLDAPVAIRDAASGAGWIEGWRGEIFVALETDARGRIARCHCHDPSWQNWPVIEHASIDNIVADFPLINKSFNLGYSAQDL

SEQ ID NO: 8816 - protein, 508 aa, Synechocystis sp. PCC 6803
MPHHYDRVNINKLLTRTRITMVTTPDWVKKAVFYQIFPDRFAIGQQQAIAVAQQPKLEPWEAPPTVQGYKGGNLWGVIEHLDYLQDSGITALYLTPIFQSACNHRYHTHDYYQVDPLLGGNEALQALLTQAHRREMKVVLDGVFNHASRGFYFFNDILENGPHSPWLDWFHIEDWPLSAYDGSLPANYRGWVDLRALPQFNHDHPDVREYLMRVGEYWIAQGIDGWRLDVPDCVKAEGFWQEFRCRVKAINPEAYIVGEIWCDASPWLAGDQFDGVMNYRFTEPTVAFAIGDRLQKEHLRGEEYRPYPALTAEAYGERISQLLQQHPWEIQLTQLNLLNSHDTARLLTLANGDRPSVNLALLLMFTFPGAPCVYYGDEVGLPGEADPDCRRVFPAKTDWDLDCWEFYRQLIALRHRYQCLQLGDYKIIATAGMGYVFQRQYGDETLMVAVNSGDNIIEIILSPDIINLDKIDIAEPVFSANGETVIDRNTAGLLLTMAPQSGAAFAII

SEQ ID NO: 8817 - protein, 472 aa, Bacillus clausii KSM-K16
MNHALFINNECVATDDMIEVENPATKEVIGTVANGGKQEALAAVDAAAAALPEWRAKTAAERGAYLQKWYELIQREEEEIAKLMTLEQGKPFAEALGEVRYANSFLSWYAEEGKRVYGETVPAAATNKRIFVQKQAIGVIAAITPWNFPAAMLTRKLGPALAAGCTAVMKPSELTPFTAYRIVELAKVAGIPKGVVNMITGDAQQIGETWMADERVRKVSFTGSTRVGKLLMRQAADTVKKLSLELGGHAPFIVTAQADIQKAVDGLIASKYRNGGQTCVCANRIYVHESIKAPFVEAFAAEMKKLKVGNGMEPDSHIGPLINEAAVAKVQKHIEDAQAKGGEVIFGQEADATNGYFQTPALIANATDDMLCMKEETFGPLAPIATYTSTEDVIERANHSPYGLAAYVYSNDLSEAVTIAERLEYGIVGLNDGLPSVAQAPFGGMKESGLGREGGHWGIEEYVEVKYISLQL

SEQ ID NO: 8818 - protein, 258 aa, Arabidopsis thaliana
MASSSAAMSLESISMTTLNNLSRNHQSHRSSLLGFSRSFQNLGISSNGPDFSSRSRSTTSKNLNVTRAFFWNWGKKTENSRPSKIQELNVYELNEGDRNSPAVLKLGKKPTELCLGDLVPFTNKLYTGDLKKRVGITAGLCVLIQHVPEKSGDRFEASYSFYFGDYGHLSVQGQYLTYEDTFLAVTGGSGIFEGAYGQVKLRQLVYPTKLFYTFYLKGLANDLPLELTGTAVTPSKDVKPAPEAKAMEPSGVISNFTN

SEQ ID NO: 8819 - protein, 474 aa, Legionella pneumophila str. Paris
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDINGVSVAYPNLASELSIGDHLLINDGLIELEVIEISGSKIHCKVVEGGVLTDLKGLNRKGGGLAARTLTEKDRNDLRTAIEAEVDYISLSFVKDAEDIRQARALMKDYGAKITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWVSRHHSTVPIFAISANKRTIGRLSLVNNVFPIYIDFHQFNPEGLNQQILHELIKSGHLEKRGYVLLTRGTQIGMPGGTNCMEIIPVV

SEQ ID NO: 8820 - protein, 377 aa, Xylella fastidiosa Ann-1
MNSFAAVPVLIEEIRAGRMVVIVDDEDRENEGDLIMAAELVAPKDINFMVTHARGLVCLSLTRERCAQIGLSPMVQRNTTRLQTNFTVSIEAAEGLTTGISAYDRAHTIRTAVRPNAKPSDLHQPGHIFPLIAQPGGVLTRAGHTEAASDLPMLAGMEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVMLAAPRDSDVLLARLRSEPEVVSNVKDVGQWRRNGAGGQILADLGLAKLRVLGTPRRQIALAGFGLEVLEYVECRGGVPVAPQGVD

SEQ ID NO: 8821 - protein, 251 aa, Pseudomonas syringae pv. phaseolicola 1448A
MRRPMVAGNWKMHGTRASVAELIEGLGKQVLPGSVDIAVMPASLFTNQVIEGLRATSIIVGAQDAAIQAEQGALTGEIASSQLADAGCKLVLVGHSERRQLIGEQDDVLNKKFAAIQASGLTPVLCIGETLEERKAGQTLEVVGRQLDSVIAEFGVSALINAVIAYEPVWAIGTGLTASPQEAQEVHAAIRAHLAKENAEVAQGVRLLYGGSVKAANAVELFSMPDIDGGLIGGASLNADEFGAICRAAGN

SEQ ID NO: 8822 - protein, 431 aa, Deinococcus radiodurans R1
MGERKCGGWPPKVFLHSLSPGGAGGSTKAVVWHGIGDIRLDDVPEPKIEAPTDAIVRLTASAICGTDLHFIRGTMSDMVPGTILGHEGVGIVEAVGPEVRNFVPGDRVVIPSSASCGYCPPCREGNTSQCDNANPNGPSAGTAFYGGPKSSGPLNGMQAEKVRVVYANSSLVKLPDNVSDDQAIMISDIFPTAYFGAEIAGVKTGSVVVVLGCGPVGQFSIISAKLLGATRVIAVDRLDDRLDMARKNGAEVINFEKEDPVEAVKKLTGGLLADCVIDAVGVDAQHAHAGPAKPDAEKEQKFEQEVQEVAPDAKPEKDGQWTPGDAPSQASEWAIEMTKKAGQIGIIGVYSPQMTTYPIGKAMNKNLTIRMGNCNHRAIIPGLVDLVAAGVVDPARVLTEHEHLGSAIEAFEAFDKRQPGWIKVELEPQAG

SEQ ID NO: 8823 - protein, 148 aa, Sulfolobus tokodaii
MMSIQRTFVMIKPDGVRRNLIGEIISRFEKRGLKIIGLKMVKIDRPTAERLYEEHKGKSFFEELISYITSGPVVCMVIEGDEAVSVVRKMIGNTDPKEAPPGTIRGDYALSKAENVIHASDSEEKAKREMSIFFKEEELVTPLAQVHM

SEQ ID NO: 8824 - protein, 1095 aa, Oryza sativa
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRDANGHGTHTLATAGGSAVRGAEAFGLGGGTARGGSPRARVAAYRVCYPPFNGSDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKVRNFSWRELDVAPRAHERRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 8825 - protein, 244 aa, Oryza sativa
  misc_feature (123)..(123): Xaa can be any naturally occurring amino acid
  unsure (1)..(244): unsure at all Xaa locations
MKTVSLGAARPSPVKFRMPTRDNLVPIRVDVEVDGQRYRDAFTCYPCDPDSEIISFAKRTAKDLKLPANFVPQMLHSIQGQLAEFRSYKGEEMQIREKIVPLKIDLRINNTVIRDQILWDIGXLDSDPEEFARTLCDDLNIPDPEVGTAITVSIREQLYEIASQSVSAMREAARVSKKGRRAPEFASNSKAMNNSLDLFKYFGSKGSVVRKRKEWYLYEPVVDVITNEEVGVTDATEEINSRCD

SEQ ID NO: 8826 - protein, 482 aa, Ralstonia eutropha JMP134
MQLRDPSLFKALACIDGQWVGADSGATIEVTDPATGEIVAKVPDLRAAETERAIAAAERAQKGWARKTGKERAIILRRWFDLMIANTDDLAYLMTREQGKPLDEAKGEIAYAASFLEWFAEEAKRVDGEVLASPAADKRLVTLRQPVGVCAAITPWNFPAAMITRKAAPALAAGCAIVIKPAELTPLSAFALAELAHRAGVPAGVLQVVTGDARTIGAVLTASPIVRKLSFTGSTEVGRILMAQSAATVKRLSLELGGNAPFVVFDDADVDAAVDGAIAAKFRNGGQTCVCANRFYIQDGIYDAFATKFAQRASQLRVGNGLEQGVVIGPLIEEAAVEKVTSLVDDATSKGGRLLTGGLKHQLSGTYYAPTVIADATATMRVAREEIFGPLAPLFRFKRDEDAVAAANATEYGLAAYLYTRDIARAWRTAEALEYGMVGLNTGLISNEVAPFGGIKQSGLGREGSRHGIEEYLETKYLCLQM

SEQ ID NO: 8827 - protein, 570 aa, Trichodesmium erythraeum IMS101
MNKQQNQKFKFDPIDTALADIKAGKCVVVVDDEHRENEGDVICAAQFATPNMINFMAVKARGLICLALTGDRLDQLEVPLMVTNNTDSNQTAFTVSIDASPELGVSTGISAEDRARTIQAVINSNTKPEDLRRPGHVFPIRAKEGGVLKRAGHTEASIDLARLSGLYPAGVICEIQNPDGSMARLPQLVEYAQTHNLKLISIADIISYRIKHDRFVFREAVAKLPSQFGNFQIYAYRDTQNNLEHIAIVKGNPAEFSQRDIMVRVHSECLTGDAFGSLRCDCRMQLQAAMKMIEHAGAGVVVYLRQEGRGIGLVNKLKAYSLQDIGLDTVEANERLGFPADLRNYGVGAQILHDLGVNKMRLITNNPRKIAGLHGYGIEIVDRVPLLIETTDYNSAYLATKAQKLGHILLRSYLVTIAINWNNQKIEEETFDNSDHINMKSLAQQRYQYLEKLRSLIKEYDFLLQEETRPVATAVFAQAPLIVNFGLEQATLTTSKWYQESNNPYLVAIAKVLTEIAQWQNMLKLEFIIASGLDPMIALQIKLERQTLEITELSTAMEHLETQKIYSLKI

SEQ ID NO: 8828 - protein, 178 aa, Brassica napus
  misc_feature (151)..(151): Xaa can be any naturally occurring amino acid
  unsure (1)..(178): unsure at all Xaa locations
MEKKREGGGGGALERTSQIVSDPYYFLHFMAFFSYLPIRASAAPHTSHRLFDRELQAFLAFLMFSAIKMVREETWEAFVADSLLYAKIFLIGVSLVMDYRVGIWFCVIFSVVYLLAQQPAFSKLGTAKKLTPMQLEDLLSDGTTTKYWLIXYACSSSKCVRSSRCFPELSITYSNSLL

SEQ ID NO: 8829 - protein, 330 aa, Enterococcus faecalis V583
MSTKSQVLTLLMKQTPAFLSGEEMAQRLSLSRTAIWKAINELKKDGYQITSVQNKGYRLEKSDVLSAEGIQLALWPQTPPLTITVLETSESTMTDAKRAILDQTPDNTLIVADMQEMPRGRFGRPFFATPGKGIYMSMVLQPNQNFEEIAQYTVIMAVAVARAMDALAGVHTEIKWVNDLYLNGKKVCGILSEAMSNVETGQISNVIIGMGINFSITETEFPEDIRQKVTSLFPDGEPTATRNELVANIWNHFYQILDERSTKDFLEEYRQRSFVIGKDVAFTQNGQDFRGVATTINGNGELIVQLPDGTAKTLSSGEISLDQIGEWRRG

SEQ ID NO: 8830 - protein, 133 aa, Arabidopsis thaliana
  misc_feature (29)..(29): Xaa can be any naturally occurring amino acid
  unsure (1)..(133): unsure at all Xaa locations
MAPTVMASSATSGAPFQGLKSTAGLPVSXRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKEL

SEQ ID NO: 8831 - protein, 307 aa, Gibberella zeae PH-1
MPMTERELGQRVKALTKCVAANEPPENAIKLLETLKKDASPTEEMLRATRAGVFVGKLRSNPNKEIARAAAELVSKWKKLVEQEKSSKLQKSKVGSGSPAPAPASAPASSPAPPPSSSGNSGAKYKGDIEKRKYETDNVNVKRTDSAVRNSCIGLIYNGLAYRSTASENEVVNKAITVENAAFVKFKGETADYKKKIRSLFTNLKNKSNKELGKSVLSGEISPEKFVVMSDDELKSEEQRKKELELEKENMKMAQVPQEQKSISESLECGKCKKKQVSYTQAQTRAADEPMTTFCECMACGNRWKFS

SEQ ID NO: 8832 - protein, 133 aa, Cytophaga hutchinsonii ATCC 33406
MSKEIHFLLIDDDEDDREFFQFALEDINRNIGYTGVESGYDALHLLKNGPQPDYIFLDLNMPGMSGRECLMELKKDRVFSHIPVIIFSTSSDPYDREETKKLGAIDFITKPTKTSELVKSLNTFLSNHLSPKI

SEQ ID NO: 8833 - protein, 89 aa, Brassica napus
MSSRSKAWLVAATIGAVEASKDQLGLCRWNYMIRSVNQRIRNNVRSATQANRFSSSSTTVVSSGKDGDKAKQAEDSLRTVMYLSCWGPN

SEQ ID NO: 8834 - protein, 691 aa, Ustilago maydis 521
MSSDPVGAAIALAGIPDEPSSLHSKALRPSINLSHRGSLESKPSSDSILLPEEHEDEEDFVVFEDRNTLPAPKLADGDFDELEATSSRNDVEKRSTLGSIARASVESLSFGYRDHLLPLTLSGDGDESLGGDYGEREGSVSATARGSRSTLGSTSSSRRRRHNRGYSRDRLAERRVTLIDGIALTIGVQIGSGIFSSPGVVTLNTGSIGASIVVWLLSGLLAWTGASSFAELGASIPLNGGSQAYLNYSFGPLSAFLYTWSALTALKPGAGAIIATIFGEYVARIIFHATGKVADHPHETGLDGIPAWSIKLLAVAIVALITAAHAFSNKLGTRTQIATTVVKLLALTAVPILAIVQAARGKTSPSSQQAFSSLSAMFAGSSTSPSSYALALYSGLWAFDGWDQSCFVAGEMKRVEKDLPRVIHMSLATVILIFLSAVVSYFVVLPAELVKRTNTVALDFGSAIFGTVGGIVFAVLVAFSCFGALNGQIYTTARLILAASREGYLPERLGDLNRQTGTPIAALLLQLVLISAFVLFGSGFASLVNFYGVCSWTFYLASVLGLLVLRIKEPNLNRPYRTWLGTPILFAAVALFLLLMPIGSAPLEGLAALLFIGAGVPVYYLTQSRSGWVSNVPLLSRLKAWFARARGAGGVHDARGHHVVLPTTDAAAGETEQEDEEQIEMLPKKGTDHKA

SEQ ID NO: 8835 - protein, 271 aa, Mycobacterium sp. JLS
MRIIVTGGNSGVGRATASAMAAEGHEVVIACRTMSKGYDAAASMSGRVDVRELDLADLTSVRKFADTVDYVDVLVNNAGVLGLPLTRTADGFEAHMGTNHLGHFALTCLLGDRIRDRVVSVASTNYTTARMHFDDLNWQQRKYNPWSAYGESKLANLLFVHELVARGKTAYASDPGMTNTAITRDGSGVLQWAGRVISPHIAQSPDDGARSTIQAITTTLPNGTYLAPRGLMHQWGKPKPTKLKAKARDADSARRLWDLSAELTGCAWQEA

SEQ ID NO: 8836 - protein, 1115 aa, Pseudomonas fluorescens Pf-5
MAKKPRPTTFIKDPLWYKDAVIYQVHVKSYFDSNNDGIGDFPGLIAKLDYIKDLGVNTIWLLPFYPSPRRDDGYDIAEYRGVSPDYGTLADARRFIAEAHKRELRVITELVINHTSDQHPWFQRARKAKPGSAARNFYVWSDDDQKYDGTRIIFLDTEKSNWTWDPVAGQYFWHRFYSHQPDLNFDNPQVMKAVLSVMRYWLDMGIDGLRLDAIPYLIERDGTNNENLPETHQVLKQIRAEIDANYPDRMLLAEANQWPEDTQLYFGDVTGSDGDECHMAFHFPLMPRMYMALAQEDRFPITDILRQTPEIPANCQWAIFLRNHDELTLEMVTDRERDYLWNYYAADRRARINLGIRRRLAPLMERDRRRIELLNSLLLSMPGTPTLYYGDEIGMGDNIYLGDRDGVRTPMQWSIDRNGGFSRADPASLVLPPIMDSLYGYPSVNVETQSGDPHSLLNWTRRMLAVRKQSKAFGRGTLKMLSPSNRRILAYTREYTGPDGKQEIILCVANVSRSAQAAELDLSAFAGMVPVEMLGGNAFPPIGQLNFLLTLAPYGFYWFVLAAENQMPSWHVEPAQSLPDFTTLVLKKRLEELLEAPSRTTLEQEVLPNWLPKRRWFAGKDSAIDQARIAYGVRFGDPQHPVLLSEIEVTSAGRSERYQLPFGLLAEEQINSALPQQLAMARVRRGRQVGLITDAFALDSFVRNVLLALQGTTCLDSEQGQIRFEATAQLAALGLGADAEVRYLSAEQSNSSVVVGGSLVLKLIRKVAGGIHPELEMGAFLTAAGFAHISPLLGSVLRRDAQGEDHLLMIAQGYLNNQGDAWEWTQNNLERAIRDELAEAMSEQEQHYNALGELQDFAGLLGQRLGEMHLLLAAPSDNPDFAPEHATAKDAQAWNQQVAEQLERGLQLLQQHQAELAAGEQKLLGKLLQHKALILGHIQQLAKQLVGGVRIRVHGDLHLGQVLVIKGDAYLIDFEGEPARPLAERRGKHSPYKDVSGVLRSFDYAAAMALEAPAVDGAQGAAAGRRKVVTRYLAEARHAFVQAYRLATANLAHGWQDPAAADAALALFSLEKAAYELAYEAENRPAWLPVPLHGLVGLLRELKPFSDIESGGEQS

SEQ ID NO: 8837 - protein, 498 aa, Rhodococcus sp. RHA1
MPVTVLLDTGSVRGTLRTRHQFSNAGHIDTGVDMSVESLHTTADATIPHPRWRLPVVGDVFGISIRTPLQNSMEIGRKLGPIFERNVLGNRFVFASGADMVAELSDESRFAKHLAPGVASLREVGGDGLFTAYNHEPNWSKAHNLLAPAFTKSAMRSYHRTMLDVAGELTEHWDERVDGSPVDVSSDMTKLTLETIGRTGFSYSFDSFGRERPHPFVQAMVGALSHSQRTTFVKSSALGRLLMRRSDRRNIANLEHMAEVVDEVIRARRDSAEDGPEDLLELMLRAARENDPHRIDELNIRHQVVTFLVAGHETTSGALSFALYYLSRHPDVLAKAQAEVDAVWGDEEPAFEQIAKLRYVRRVLDESLRLWPTAPAYGREATVDTTLVGKYPMKVGDWVLVLIPALHRDPVWGDDPEAFDPDHFLPERIRSRPAHVYKPFGTGERACIGRQFALHESVLVLGTILRRYDIVGDPDYRLKVAERLTLMPEGFTLQLRRR

SEQ ID NO: 8838 - protein, 228 aa, Triticum aestivum
MATGHAFRRLARRMLSNVPESTVYGGPRPQEAAAARRVTVTTLRGKHRRGEPITVVTAYDYPSAVHVDSAGIDVCLVGDSAAMVVHGHDTTLPISLDVMLEHCRAVARGASRPLLVGDLSFGCYESSSTQAVDSAVRVLKEGGMDAIKLEGGAPSRISAAKAIVEAGIAVMGHVGLYAQAISVLGGFQPRGKTVIVLLRLKERLALQGAGCFSVVLEGGPTPVEEVAK

SEQ ID NO: 8839 - protein, 444 aa, Rubrobacter xylanophilus DSM 9941
MIEQRRPAVLPPELSDGSVTSVRVLYADLHGVARGKDVPIGEFERAVEHGLAFCSAIMGTDLRHTPVVGGEEGYPDLVAYPDLSTMTLVPWEPGVACCLADLRPVGDHAPPADPRGAVRRAVAAFEELGLSPVVGPELEFFLCERDPAGGVRRYVDNLSMVYTVGPQADPRGIVREIAEMLSGMGLGAFAANHEFMNSQYEINLHHADALAAADRAFRLKCAVKDVAAMRGLVATFMGKPFNDQGGSGFHIHFSLERGGENAFAGGEEGGVTGLLRHFVAGVLEHASGLMAFLNPTINAYRRLVPDSLAPTHANWGWDNRTAFVRIPPERGGATRVEVRVGDGSANPYLATAATLFAGLHGVRERLPLGPPVGGDAYALAGEKAGPPLPATLEEALDALEADEVLRGAMGEQIVGTFLALKRYEAERHRTWVSDWEISEYLHHL

SEQ ID NO: 8840 - protein, 570 aa, Saccharomyces pastorianus
MSHVNASYAHSQGSSTSVSRVEMEKPATKEVFEDPTPKKFELDDDEAGKTSSVFNPDLNLEEEVRALDELGDSFKRDRSFWGKMKALEFEVEFENKKNMVLMLGTFAAFAGILSGIDQSIISGASIGMNKMLHLSTHEASLVSSLMPLGAVAGSILLTPFSEYFGRKKSLAISCVFYTIGAIVCAAASNHHEMYAGRFLIGVGVGLEGGGIGVYIAESVPSSVRGSLVSLYQFNIALGELFGYIVGVIFFDVKGGWRYMVGSSLVFSTTLFIGLLFLPESPRWLMHKGRVGESWNVWKRLRDVKEEGNKIEFLELRDVASHDRELHANESRFQSLFDLVRVPRNRRALVYSCMMIGLGQLTGINAIMYYMSTLMKNIGFDDKQSVAMSMVGGAALLIGTVPAILWMDRFGRRTWAMTIIIFIVGLVLVGVGYQINLKTHMAAAEGVYLTGQIIYNMAFGSYAALTWVLPSESFSLGTRSAGMTVSSALLYLFAFTVTYNFEKMKEAMTYTGLTLGFYGGIALAIGIPYQLLCMPETKNRTLEEIDDIFEKPTSQIIKENIAYLKKGQLSY

SEQ ID NO: 8841 - protein, 283 aa, Aspergillus nidulans FGSC A4
MASPYVVLVTGGNNGIGYEACKAFYESPKSYIILMGSRSLEKGEAAIRKIKEVVPNSSNTLELIQLDVTSDESIQKAYEQILKSPGRLDALVNNAGIYFPLSTKGATFDFDYNASKVTLRECFNKAYDVNVTGATVLTHTLAPLLIKSSDPRLLFIAGLSMMTVAMKEYFPTPPLPAGWPKKVEFETIGYRCSKTALNMLMLDWNHKLKADKVKVWAVGPGMLETDLGGQRELAKKMGLGSATLGGTLIRDVVEGARDQDVGRKLQNERILRTLVHFTYSWTY

SEQ ID NO: 8842 - protein, 489 aa, Brassica napus
MKKSQINLPSFFSFLPLLCALPKLRSNPLLCFASAPPSRPVWDSSSIRSIMASDADMEDYGFEYSDEEQEEQDVDIENQYYNSKGNIETEPEEALSGFAEVVRMEPDKAEWGFKALKQTVKIYYRLGKYREMMDAYREMLTYIKSAVTRNYSEKCINSIMDFVSGSAGQNTGLLQEFYQTTLTALEEAKNERLWFKTNLKLCNIWFDIGEYRRMTKILKERLHPRLREDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYINDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDKWNTQLKSLSMSITNRVC

SEQ ID NO: 8843 - protein, 321 aa, Synechococcus elongatus PCC 7942
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 8844 - protein, 336 aa, Pichia minuta var. minuta
MAYNVGINGFGRIGRLVLRIALSRKDINVVAVNDPFIAAEYAAYMFKYDSTHGRYQGEVTFEGKYLVIDGQKIEVFQERDPADIPWGKEGVDFVIDSTGVFTTTAGAQKHIDAGAKKVIITAPSADAPMFVMGVNHKEYTKDLSIVSNASCTTNCLAPLAKVVNDVFGIESGLMTTVHSITATQKTVDGPSHKDWRGGRTASGNIIPSSTGAAKAVGKVLPALAGKLTGMSLRVPTTDVSVVDLTVNLKTPTTYAEISAAIKKASEGELAGILGYTEDAVVSTDFLTDNRSSIFDASAGILLTPTFVKLISWYDNEYGYSTRVVDLLEHVAKVSSA

SEQ ID NO: 8845 - protein, 368 aa, Corynebacterium glutamicum ATCC 13032
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 8846 - protein, 541 aa, Pichia angusta
MKLSMSVLALVATCIGSAQAAAIKKDTAGQHPLGMNSKFGDVFVEKGKSLLDRVSEVVSESSKNISPELRDIWNEMEAKFPDTLKNMKLKSEPVVKITKKPADFWDFNVFNEKFSNYKLRVKKTDPGALGLDHTRQYSGYLDVEDEDKHFFYWMFESRNDPANDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKIGAEVETYESCNFDVNRNFLFAGDWMKPYHKNVINLLEQGLPVLIYAGDKDFICNWLGNQAWSNELPWSGHEEFESAELYNLTLKDGTKVGEVKNAGKFTFARMFDGGHMVPYDQPESSLAMVNRWIAGDYSLGTKK

SEQ ID NO: 8847 - protein, 432 aa, Candidatus Protochlamydia amoebophila UWE25
MISRPISQQIYSNLNRVIPGGVNSPVRACANMGQIPMIIDHAYRDTLVDVDGKTYVDYCGSWGALIHGHAHPSILEAVQQRMKKGTSFGITTSIEGELAQEVIKLIDSVEKIRFVSSGTEATMSAVRLARGYTNKEFIVKFNGNYHGHADFFLVQAGSGVLEVSPSASSAGIPADIVKQTLCLPYNDIEACRQIFHHSDYRHKIAAIILEPIAGNMGVIPASQEFMQFLRKETLAMGALLIFDEVMTGFRVALKGAQDIYPVEPDLTCFGKIIGGGFPAAAFGGREEIMNLLAPLGSVYQAGTLSGNPIAMEAGLQSLRLIQQPGFYEELHRKTDLLLNPIKETIKKNNWPICIQQAGSMFTLFFCKNRVRNLEDALKANTTIFANFFRKLFDQGIYIPPSQHEAWFISQAHEESNLIKTQSAILTFLEENF

SEQ ID NO: 8848 - protein, 318 aa, Synechocystis sp. PCC 6803
MPEYLLLPAGLISLSLAIAAGLYLLTARGYQSSDSVANAYDQWTEDGILEYYWGDHIHLGHYGDPPVAKDFIQSKIDFVHAMAQWGGLDTLPPGTTVLDVGCGIGGSSRILAKDYGFNVTGITISPQQVKRATELTPPDVTAKFAVDDAMALSFPDGSFDVVWSVEAGPHMPDKAVFAKELLRVVKPGGILVVADWNQRDDRQVPLNFWEKPVMRQLLDQWSHPAFASIEGFAENLEATGLVEGQVTTADWTVPTLPAWLDTIWQGIIRPQGWLQYGIRGFIKSVREVPTILLMRLAFGVGLCRFGMFKAVRKNATQA

SEQ ID NO: 8849 - protein, 659 aa, Oryza sativa
MATMKLGSKPEIFVQEGLTWRCMTELESDVVVEVGEMSFYLHKFPLLSRSGVLQRMISEYQAPQEDGGGGGGMCTLQLDDIPGGAKAFELAARFCYDVKIELNAHNVVCLRCAAEYLRMTDDYAEGNLITQAESFLADVLANWKDSIKALETCEGVLPTAEDLHIVSRCITALASKACASDAAACSTGHAAASASAVAVAAKNASYDALWNGIGSGGTPRGGGGAAGAAAGCSGMDWWYEDVSFLSLPMFKRLIQAMEGKGMRPESIAGAIMFYAGRFLPGLKRNTSFSNASFGGDCGAGSRSITPRAANVSAPSEGDQRYFLEEIVALLPAKKGVASTRFLLGMLRTAMLLHASPLCRENLERRIGAQLEDACLDDLLVPNLGYTVETLYDIDCVQRILDYFMSSTDGLGTGYTSPAVVEEGSQLGALHAGSPSSLSPITMVAKLMDGYLAEVAPDTNLKLPKFQALAAVVPDYARPVDDGIYRAMDIYLKSHPWLSESEREQLCRLMNCQKLSLEACTHAAQNERLPLRVVVQVLFFEQLRLRTSIAGWFFVSGIAAAGGDGAPQPHPGGSAIVPKGAAAAGQSDADAEADEGKGKELPAEAITDVKARVSELEKECMSMKQEIRRLGKPRRSWSLLTRKCRFGTKVQQAQPTMSSK

SEQ ID NO: 8850 - protein, 498 aa, Wolinella succinogenes
MLKCPHQFTFSIRQSSSHSRRKDMADQSKVKEFFRFCQENEVEFVDFRFTDIKGVWHHVSYSMASIDEESFNGLPFDGSSIPAWQPINRSDMQLIPDPVSYFLDPFTADTTVVVFCDVWDIYKNQPYEKCPRSIAKKALKYLESTGLGDVAYFGPENEFFVFDSIKIQDSINCQSYEVDVEEGTWNSNRAYENGYNLGHRPGTKGGYFPVAPVDSMVDIRAEMVKVLNQVGLETFVVHHEVAQGQGEIGVRFGDLIKAADNVQKLKYVVKMVAHMNGKTATFMPKPLYGDNGSGMHTHISIWNKGENTFAGDAYQGLSETALHFVGGVLNHAKSAAAFTNASTNSYKRLIPGFEAPSILTYSAQNRSASVRIPYVQGAKAKRVEFRFPDSSANPYLAFSALLMAGIDGIQTKANPGEPMEMDLFELSLDEIREKGIKQMPHTLRSAVENMLADKDYLKKGDVFSEDFLQTYKAYKFETEIWPWEARPHPFEFISTYSC

SEQ ID NO: 8851 - protein, 262 aa, Corynebacterium efficiens
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 8852 - protein, 327 aa, Rickettsiella grylli
MSFLKSILTLLADGNFHSDKEISQCLGISCKRVPQVLKNSLDPSINLDRLNDKFFRIIGGLELLNTSSITNELGTLNQLLSHVKILMSIDSTNNYLLNKRIITKGNYAVFAEQQTAARGQFQRPWYSVFGKNIALSLLWSFSNLQKQLEGLTLIVGIAVVNALEEYGLKKIQLKWPNDIIYEGKKLAGILIESRLINTKRQKVVIGIGLNLYNPSTFFPINEQLVTSIFSISRLPPKRNVLAMLILKNLLQTLKLYEVKGLNYFMSEWQRLDGFMDKLLLIQNKNDRVEGIGKGINSRGQLCVQVKNTLHYFNNGEISVKLSNLLNC

SEQ ID NO: 8853 - protein, 260 aa, Listeria monocytogenes str. 4b H7858
MPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 8854 - protein, 188 aa, Glycine max
MRPLDEKETTMVFEKLFKFTGPNLKHLLERPSVEGPDPEPGRYCLRLHKNRVFYASESLVRRATAVSRTRLAGVGTPIGKFTHGGAFHLTVHALDLLAAHARRRIWLKPDTERSFLFGNSVPKSALARITENTKSGDGVVVMSMADVPLGFGVAARGAQDCRKADTNAVVVLHQSDAGEYLRKEEELM

SEQ ID NO: 8855 - protein, 106 aa, Arabidopsis thaliana
  misc_feature (28)..(28): Xaa can be any naturally occurring amino acid
  misc_feature (45)..(45): Xaa can be any naturally occurring amino acid
  unsure (1)..(106): unsure at all Xaa locations
RTRGIRTTATYTLSSATRAACPTQATLXAPINGLKNSGALPSHTXMANHYFTSITSNEGRDNCMHVRPPIGENKFETLSYLPDHIHFECSNAVDYLIRIMRVSRDQ

SEQ ID NO: 8856 - protein, 492 aa, Campylobacter coli RM2228
MRQKCILVITDGIGFNKEKDFNAFEAAKKPNYERLFREVPNSLIKTSGLAVGLPEGQMGNSEVGHMCIGSGQIIYQNLVRINKAIESCELEKNANLKKLLQKCKRVHVIGLYSDGGVHSMDTHFNALLEICAKNGNEVFAHAITDGRDVSPTSGLEFIRKLKNHCEEIGVHFATLCGRFYAMDRDKRWERVKEYYDCLLGKSKGVSNWVDYIEECYQNETTDEFIQAAKNENYKGMQEDDGLIFVNFRNDRMKQLIEVLNSQNFKEFEREKVFENLLTMSVYDDKFNIPVLFEKEEIKNTLSETISKAGLTQLHTAETEKYAHVTFFFNGGKEELLENETRVLIPSPKVKTYDEKPEMSAFEVCDVVKKGIEKGEDFIVVNFANGDMVGHTGDFNAAVKAVEAVDVCLGEVVECARKHDYAFIITSDHGNCEAMQDKKGNLLTNHTTFDVFVFVEAKGVDKLKENMGLSNIAASVLKILNLEIPKEMNEALF

SEQ ID NO: 8857 - protein, 435 aa, Wigglesworthia glossinidia endosymbiont of Glossina brevipalpis
MIKNSITNKLYVEAKKIIPGGVNSPARSFYFVKEIPVIAKRSKGPYIFDVDNNKYIDYICSWGASILGHNNYYITSKIIEYSKKGLNFGLLTEIEIKIARLISKYIPSIEMIRMVNSGTEATMSAIRLARSYTKKNKIIKFDGCYHGHADFLLANSNLDPYDLFSSNPISSGIPKNILKDTLICPYNDYESIEKIFDLYPNKIACIIVEPIAGNMGCVLPEKNFLYKLRMLCNKFNSLLIMDEIITGFRISLGGAQSYYNIYPDITCLGKIIGGGLPIGAFGGKKRIMNHVSPSGSVYQAGTFSGNPISMISGYACLKLLKSPDLYNKLNKKTEYLVNELRSSACDNKIPVVINSLGSMFSIFFTNLDKIKCYKDVSSCNYKKFILFFNEIKKLGILFSPSLFESNFITLMHKKKDLEKTIDSANKVFKILKNKV

SEQ ID NO: 8858 - protein, 516 aa, Oryza sativa
MGGALLSFLLSYPEFILAAACFLAFAAIRRARDARRRAAPVPVSWPVVGMLPFVVAHLGRLLDAAAAALPELGCTFMFRGPWLVGADFLVTCDPAVFRHCLVANFAGYDKGRDFAEMFDVVGDGLLVADAASWAAKRHLAASVFTSAAFRGFVLSTVERQTRRLLVPFLDHAGGVVELEDVFMRYSLDVSYTVAFAADLDSLSVASAAEPFPPFGEATRVTGEAVLLRHIAPAGWWKLMRWLNVGVERRLADAKAVLDEFVYREIANRRSRPAPAVAGGDDLLCMYMASPIDPAMSDQTLRDAAVGFMFAAKDLIAAALTWLFYMICTHPHVEAKILDELRSLHTTTTAGAVVFDADELRAATYLHAAVLETLRLYPSAPFEEKEAVGDDVLPGGTAVRKGTRVVFCLYAMGRVEGIWGSDCREFRPERWLSTGDGDGGAGKVRQEPSYKFAAFNAGPRSCLGKDLGLSNIKIAAAAIVYNFTVELVAGHVVEPKDSVVLHTKNGLMVRVKRRETA

SEQ ID NO: 8859 - protein, 440 aa, Triticum aestivum
  misc_feature (173)..(173): Xaa can be any naturally occurring amino acid
  unsure (1)..(440): unsure at all Xaa locations
MAIGGAAPHDSPGGLPDFEQPLLHAHGGLQAGKDPAAAHDHEAQCSPEAGGATSLRTCFNGLNALSGVGLLSIPYALAEGGWLSLVLLLLVAMVCCYTGQLLQTCMGASPDVRGYPDIGALAFGTKGRFAVSAFMYAELYLVAIGFLILEGDNLDKLFPGTSLSLGGVLVLSXKHLFIVLVSIFILPTTWLRNLGVLAYVSASGVLASVVLVFCVLWAAVVDGVGFQGKGTMLKVSGLPTALGLYTFCYCGHAIFPTLCNSMKEKDKFSKVLVICFVACTLNYGSMAILGYLMYGDDVESQVTLNLPEGKLSSKLAIYTALINPFSKYALMVTPVATAIEEKLLAGNKKSLNMLIRTFIVISTVIVALTVPFFGHLMALVGSLLSVMASMLLPCICYLKIFGTARCSRAEVALIVMIIVLGSLVAASGTYSSLQKIIHEF

SEQ ID NO: 8860 - protein, 391 aa, Alkaliphilus metalliredigenes QYMF
MKHRFLAKRYWNTMTTPMGAVVDLAKQYSDVINLSLGDPDYVTNQEVIQRAFEDAENGHTHYTDSLGDEELRHEIIKYYEEAYEYKVGSKEVMAVVGACHGMYLALEAILDDGDEVIIPAPYFTPYIQQVELVRGKPVILDTYEEDGFQIDINRLKGLINHRTKAIIINTPNNPTGACFSKETLEAVGKVAKEFDLLIIADDIYDAFTFSDPFLPATTMKGMQERTITIGSFSKDYAMTGWRVGYVLAPDFIIQCMRDINEGICFTVPSISQRAAIYALRMRETIQPPMIAEYKKRMYYAYERINAIPNMSVLSPQGSFYLFVNIKKTGLNSVDFCKELLEEAHVLAIPGIAFGGCGEGYIRLACTVGVAALKEAFDRIEKMKVCCAHNLQ

SEQ ID NO: 8861 - protein, 244 aa, Brucella melitensis 16M
MRIRGGRNGNSGMDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIELARAAIIAGTDGIRTMNRS

SEQ ID NO: 8862 - protein, 479 aa, Haemophilus somnus 2336
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDDEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTTTCRALVVE

SEQ ID NO: 8863 - protein, 469 aa, Brucella melitensis 16M
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEFRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 8864 - protein, 151 aa, Oryza sativa
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 8865 - protein, 223 aa, Prunus avium
MAMLKSSPAFLVLAFAFFLCFIMSNGSYVYFQFVQQWPPTNCRVRIKRPCSSPRPLQYFTIHGLWPSNYSNPRMPSNCTGPQFKRILSPQLRSKLQTSWPDVESGNDTKFWESEWNKHGTCSKETLNQMQYFERSYAMWMSYNITEILKNASIVPHPTQTWKYSDIVAPIKAATKRTPLLRCKQDKNTVLLHEVVFCYEYNALKQIDCNRTSGCQNQPAISFQ

SEQ ID NO: 8866 - protein, 312 aa, Rhodococcus sp. RHA1
MTQHRITSPFGAASTAAEVLEGIDLRGKRSIVTGASSGIGLETARALATAGADVTIAVRNPDAGRGVADDINTALGQERVAVRTLDLADLSSVHRFAEQWGSTALDVLINNAGIMATPLGRTRSGWESQFATNHLGHFALANALHDALAHANGARIVSLSSRGHLSSDIVFDDINFDNREYDPWLAYGQSKTANVLFAVEATRRRAHDGITANALHPGGIWTNLTRHLPENVYNSLRADPTAEYKSPQQGAATSVFVATSPLLRGIGGRYFEDSNQAVRYVGGPERVGVADYALNPESAQRLWTLSLAAVDG

SEQ ID NO: 8867 - protein, 316 aa, Brassica oleracea
MAEKPAPEQEQEQTRAMEPAVLDDIIRRLVEFRNTRPGSGKQVHLSEGEIRQLCAVSKDIFLQQPILLELEAPIKICGDIHGQYSDLLRLFEYGGFPPDANYLFLGDYVDRGKQSLETICFLLAYKIKYPENFFLLRGNHECASINRIYGFYDECKRRFNVRLWKIFTDCFNCLPVAALIDRILCMHGGISPELMSLDQIRSISRPLDIPDSGLVCDLLWSDPSGDVKGWGANDRGVSYTFGADTVAEFLQKNDMDLICRAHQVVEDGYEFFAERQVVTVFSAPNYCGEFDNAGAMMSIDESLMCSFQILKPSEKK

SEQ ID NO: 8868 - protein, 91 aa, Glycine max
MPSLQTALPPELANNATRLYRECLRRAKYIGHRKHNTELLVDLVRQQFKKNMHETDPEKIQKLKDDAARGLINHILYESEQMTGSKFSKSK

SEQ ID NO: 8869 - protein, 291 aa, Wigglesworthia glossinidia endosymbiont of Glossina brevipalpis
MKIKNNFSKKENIMKIFKKITFIGSGKIAESMIIGLINSKYPSDCIFVCSPDEKSRSAISERYLVKNFKENLIGSNIGEIIVLAVKPNIIPIVCEEIKNLTNIENKLIISVAAGININSIKKYLNNKKALIARAMPNTPVLVREGVIGLYAKKDIRTIHEKTIEQIFNRIGKIFWLSQEKEINYIISASSSATAYFFLMMDAMKNTAENIGINKSYSREVILQTAKGAIVLAEHFSEISFNTLKKHITSKKGTTEAALNSFKKNNFRKIVEISMKAAVSRAKEISIDVDKV

SEQ ID NO: 8870 - protein, 435 aa, Brassica oleracea var. alboglabra
MKGVGKPYENSHTSFLLVFFVLTLFSPAFSINTLSSIESLKISNSRTLVSPGNVLELGFFRTPSSSRWYLGMWYKKLSERTYVWVANRDNPLSCSIGTLKISNMNLVLLDHSNKSLWSTNHTRGNERSPVVAELLANGNFVLRDSNKNDRSGFLWQSFDYPTDTLLPEMKLGYDLRTGLNRFLTSWRSSDDPSSGDFSYKLQTRRLPEFYLFKDDFLVHRSGPWNGVGFSGMPEDQKLSYMVYNFTQNSEEVAYTFLMTNNSIYSRLTISSSGYFERLTWTPSSGMWNVFWSSPEDFQCDVYKICGAYSYCDVNTSPVCNCIQRFDPSNVQEWGLRAWSGGCRRRTRLSCSGDGFTRMKKMKLPETTMAIVDRSIGLKECEKRCLSDCNCTAFANADIRNGGTGCVIWTGQLEDIRTYFANGQDLYVRLAPADLV

SEQ ID NO: 8871 - protein, 527 aa, Campylobacter coli RM2228
MKKKIIVCDAILDKGVELLRKAEDIELIEAAKVPKNELMDMLADVEVAITRSSTDVDVNFLNHAKKLKALIRAGVGVDNVDIPECSKRGVIVMNVPTANTIAAVELTMAHLLSSARSFVNAHNFLKNERKWEREKWYGVELMGKTLGVIGFGNIGSRVAIRAKAFGMKILAYDPYISASKITDLDMEQAKSLDEILTQSDFITIHTPKTKETDGMIGANEIAKMKDGIRLINCARGGLYTEEALCEGLKSGKIAWLGIDVFKKEPATNHPLLDFENVSVTSHLGANTLESQDNIAREACEQALSAARGVAYPNALNLPIKTEDLPPFVAPYIELVSKMAFLAVQIDKNPIKSIKLEAEGAIGEYATSMLTFAAVGALSGILGEKINYVNAEFVAKEKGVDLSCETLPNSGYNNKLSVKIITENSNINVSGTVFNENEQRIVGLNGFQTDFKPKGKMIIFKNKDIPGVIAKISSVLASKNINIADFRLGRDGFGYALAVVLIDEKVQKEVLEELRQLEACIFVQYVEI

SEQ ID NO: 8872 - protein, 339 aa, Burkholderia vietnamiensis G4
MKPKIVLTHWVHPEIIDLLQSAADVIPNTTRETLPREDLLLRAKDADALMVFMPDTIDADFLGRCPKLKIVSAALKGYDNFDVDACTQRGIWFSIVPDLLTIPTAELTIGLLLGLTRHLMEGDRRIRSGRFQGWRPELYGIGLTGRTLGIVGMGAVGRAIARRLSAFDMKLVYCDNVALTDDLEQAWGARRLSLDELLATSDFVVPMLPMTPQNLHLFNADTIGKMQSGSYLINACRGSVVDESAVVEALRTGRLAGYAADVFEMEEWARPERPESIPQSLLDNTLQTFFTPHLGSAVKEVRIEIERQAATNILQALAGERPVGAINNPGGVNNQVQHP

SEQ ID NO: 8873 - protein, 179 aa, Malus x domestica
DPPDKLFTVHGLWPSNFNGPDPENCKVKPTASQTIDTSLKPQLEIIWPNVFNRADHESFWQKQWDKHGTCGSPTIIDKNHYFETVIRMYITEKQNVSYILSKANINPDGKGRTRKDIQIAIRNSTNDKEPKLKCQTKNGITELVEVSLCSNYFGKNFINCPNKTPGKTRYSCPTNDIHY

SEQ ID NO: 8874 - protein, 432 aa, Haemophilus somnus 129PT
MTTSATLFSRAQQVIPGGVNSPVRAFKGVGGTPVFIEKANGAYIFDTEGKQYIDYVGSWGPMILGHNHPSILSAVLKTAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDVEKFNLFFHKMLEQGVYLAPSAFEAGFMSLAHTDADIDRTLQAADIAFASLCSSSFS

SEQ ID NO: 8875 - protein, 600 aa, Vibrio vulnificus CMCP6
MALTSDFLQTSVVFLSAAVVAVPLAQRSGLGSVLGYLLAGVAIGPWGLGLISDVDAILHFAELGVVLLLFLIGLELNPKKLWQMRGPILGLGGAQVVITTLLIASIIQWFSVSWNTALVIGMGLALSSTAIALKVLEEQGLARTETGQSGFAVLLFQDIAVIPMLALLPLLAGSGMSGDWLSSLLTFSAVVGLLVGGHFLLRPLFRYVVLTGVRELFTVTALLVVLGIAMLMQQLGLSMALGTFLAGVLLAESEYRHELEIAIEPFKGLLLGLFFIAVGMAVNLGLLVVHPIEVISAVLGLVALKGAVLYLLGRVSRMRAKARSRMAAILSQGGEFAFVIFTAASKEGLLNPSEVSFLLVVVSLSMVTTPLLLNIQKWWYARTLNQESDVLAPDVVDTEPRVIIAGFGRFGQIVGRLLYANKIKVTVLESDASQIQLLRKYGYKVFYGDATQLDLLRAAGAAKAEALVICTDSPDQVMSIVELCQQHFPNLKVLARARSRVEAYQLLSHGVSTYSRETFLGALDLGRQTLVEIGMHPYQAKRAEAHFRKLDNAMLKELLPQHNQDKKLAQRAKEARKELEEIFAHEMENDHQSRNFWDER

SEQ ID NO: 8876 - protein, 179 aa, Malus x domestica
KDPPDKLFTVHGLWPSDSNGHDPVNCSKSTVDAQKLGNLTTQLEIIWPNVYNRTDHISFWDKQWNKHGTCGHPTIMNDIHYFQTVIKMYITQKQNVSKILSRAKIEPEGKPRKQVDIVNAIRKGTNDKEPKLKCQKNNQVTELVEVTLCSNRNLTGFINCPRHIPNGSRYSCPTKNILY

SEQ ID NO: 8877 - protein, 592 aa, Neisseria meningitidis Z2491
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 8878 - protein, 422 aa, Desulfovibrio desulfuricans G20
MERSRNLFERAQKLIPGGVNSPVRACLSVDSAPVFVERGQGSKLYSVDGREYIDFVESWGPLLLGHAHPAVNKAIHEAVDKGSSFGAPCEDEIRLAEAVVDAVPSIEMVRMVSSGTEATMSALRLARGYTGRNKLIKFEGCYHGHGDAFLASAGSGVATLSIPGTPGVPDTVVADTLLAPYNNLERVKALFENHGADIAAVIVEPTAGNMGLVRPAAGFLQGLRELCDRYGALLIFDEVITGFRLSYGGAQQYFGITPDLTTLGKIIGGGMPVGAYGGRREIMERIAPCGDVYQAGTLAGNPVAMAAGIATLAELKKADYPALEKRVDALASEIEAILKAKGVPVTVNRLASMFTIFFTEEPVTDYDSAKKADGTLYTRFYQQMRDQGIYLAPSGFECAMVSLAHTEDDFAAMLAAVRNVTF

SEQ ID NO: 8879 - protein, 348 aa, Sulfolobus solfataricus P2
MKAAVYKGYGLPLEIEEVPNPAPKEGEVLVKVASTGICHSDLHLLSGELVGPLPNGFIIGHEIAGWVEKIGENVKNPYGLKEGDPVLVSWIVPCGICRYCANGKENYCKDNAKRLVGLIGINGGHAEYLTVPEIAVIPLAKNLDPYYSSPIACAYGTAYNALKSANATSGKSVVIVGAGGVGSAAIQLANSIGLNPIVAVDIDENKLKSAKLLGATHIINANENDARAKVLEALEDGADIVYETKPYPDFKLSLEVVKSGGTIVVTGLGGFSTLAQIPVTLFVSRGITLIGSLGYRPRIDLPDLVSLASSGKIDIKKLVSHIYTPDMINEAYENLKKGLHIRAIIRWN

SEQ ID NO: 8880 - protein, 131 aa, Candida albicans SC5314
MSGGKGKAGSSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQSLLPAKKAKAGAASQEL

SEQ ID NO: 8881 - protein, 140 aa, Brassica napus
  misc_feature (36)..(36): Xaa can be any naturally occurring amino acid
  misc_feature (50)..(50): Xaa can be any naturally occurring amino acid
  misc_feature (71)..(71): Xaa can be any naturally occurring amino acid
  misc_feature (81)..(81): Xaa can be any naturally occurring amino acid
  misc_feature (125)..(125): Xaa can be any naturally occurring amino acid
  misc_feature (130)..(131): Xaa can be any naturally occurring amino acid
  unsure (1)..(140): unsure at all Xaa locations
PPVPFEHACPVNKDVLPTGHKVDANSKIIIPLYALXRMKAVWGQDASEFXPERWVSNTGSLRHEPSFKFLXFNAGPRSCLXKQLAMNMMKTVIVEILQNYDIHVIKGQKIETFPGLMLLMTHGFXVTITXXDSALQSIVN

SEQ ID NO: 8882 - protein, 64 aa, Malus x domestica
FTIHGFWPNYNDGSYPSNCDSDNPYDESKDLISRLQADWPTLACPSGNGSKFWAHEWNKHGTCS

SEQ ID NO: 8883 - protein, 256 aa, Yarrowia lipolytica CLIB122
MGKAEFGTPKYIANRMKSRGLQKLKWFCQVCEKQCRDENGYKCHVQSESHQRQMLLLGENARKHIGQYSRDFQTDFLSQLRMSHGEKRVNANRFYNEYIQNKEHVHMNATQWASLSAFVKHLADKKICHVEETDKEGLTIAYIDNSAASLERKQMAAKKSGAEDTETMERKRIEAEVKKAKENGVVEEVKEAVLTKTDAPIQLSLGLKKAETQPEKPKVKKNPFGAAKSKVSKPKPEKAEKDDVFKKLMLQDMKRR

SEQ ID NO: 8884 - protein, 285 aa, Alkaliphilus metalliredigenes QYMF
MDLKINWYPGHMKKTKELLKDQLKLVDVVYELLDARIPISSRNPSINEIIGNKPRVIILNKFDLADQEVTNRWVKYFKAQGIEAIPVNCLNSKGLKEAIEEGQKMFQEKKDLMIKKGRKERPIRIMMVGIPNVGKSSIINQLAGRKSARTGDKPGVTKAKQWIRLKGNMELLDTPGILWPKFEDQNVALKLAFTGAIKDEIMDVEDLAFRLVEKLMLENMTNLMNRYKLDSEPAGALEMMDAIGIKRGAILPGREIDYLRVSNIILDEFRAGIIGRISMEVPPKQ

SEQ ID NO: 8885 - protein, 317 aa, Staphylococcus epidermidis ATCC 12228
MTKVYIAGAIPEVGLNLLKEHFEVDMYDGEGLIDKETLKKGVEHADALVSLLSTSVDKDIIDSANNLKIIANYGAGFNNIDVEYARQQNIDVTNTPHASTNATADLTIGLILSVARRIVEGDHLSRTTGFDGWAPLFFRGREVSGKTIGIIGLGEIGGAVAKRARAFDMDVLYTGPHRKEEKERDIGAKYVDLDTLLKNADFITINAAYNPSLHHMIDTEQFNKMKSTAYLINAGRGPIVNEQSLVEALDNKVIEGAALDVYEFEPEITDALKSFKNVVLTPHIGNATFEARDMMAKIVANDTIKKLNGDEPQFIVN

SEQ ID NO: 8886 - protein, 162 aa, Haemophilus ducreyi
DQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 8887 - protein, 67 aa, Zea mays
MICLVLTIFANLFPAACTGAHERTFLAVKPDGVQRRLVGEIVRRFERKGFKLVALKLVPASESARRE

SEQ ID NO: 8888 - protein, 418 aa, Prochlorococcus marinus str. MIT 9312
MSIKRIFHDPIHKEIVFDSEKPEELMIMELIDTIVFQRLRRIKQLGAASLLFHGAESSRFTHSIGVFCIARKIYQRLIESKSSFCENKFVLYGAALLHDLGHGPLSHTSETIFDHNHEQWSQNLVKNYSPINSILKKYDNELPIQIGELFESKQLFSRPLKTLISSEIDCDRLDYLLRDSYNSGTKYGLVDLERIISALTFSPDGNIAIKPKGVIAIEHFLVLRNFMYRTIYNHKINEISTWILEKIISKIKDNFDNKLWLDKSLQKWIFSPEKVDFDDFIRNDDVTFYYHLIRWKDESFEPLSTLCKMFIDRDLLKASDISFLNKIDRLEILAFARKLCEANNYDAEIFCGIKERSFKGFESSNALKIWDGNYQSSLENKSSLIKTLMKSEESSFIIYPDIIKNKIKNQISLIRNNY

SEQ ID NO: 8889 - protein, 621 aa, Zea mays
MGTSVQVTPLSGAYGEGPLCYLLAVDGFRFLLDCGWTDLCDTSQLQPLAKVAPTVDAVLLSHPDMMHLGALPYAMKHLGLSAPVYATEPVFRLGLLTMYDHFLSRWQVSDFDLFTLDDVDAAFQNVVRLKYSQNYLLNGEGVVIAPHVAGHLLGGTVWKITKDGEDVVYAVDFNHRKERHLNGTVLGSFVRPAVLITDAYNALNNQGYRKKQDQDFIESLIKVLATGGSVLLPVDTAGRVLELLLLLDMYWDERRLQYPIYFLTNVSTSTVDYVKSFLEWMGDQIAKSFESSRANAFLLKKVTLIINKEELEKLGDAPKVVLASMASLEVGFSHDIFVEMANEARNLVLFTEKGQFGTLARMLQVDPPPKALKVTMSKRIPLVGNELKAYEEEQERIKKEKSLKASLVKEEELKASHGSNTKASEPMVIDASSSRKSVNASHFGGNNDILIDGFVPPLTSVAPMFPFFENTAEWDDFGEVINPDDYMMKQEEMDNTLMLGPGDGLDGRIDDGSARLLLDSTPSKEDEKLILLPPSSTPPPHKPVLVGDLKLSDFKQFLENKGWQVEFAGGALRCGEYIMVRKVGDSILKGSTGSQQIVIEGPLCEDYYKIRELLYSQFYLL

SEQ ID NO: 8890 - protein, 398 aa, Anaplasma marginale str. St. Maries
MLPMSDTRSSRIKPMTLNFGPQHPAAHGVMRLILEMSGEVIERIDPHIGLLHRGTEKLIEYKTYLQALPYFDRLDYVSPMSQEHAYSLCVEKLLQCVVPPRAKYIRVIFCELTRVLNHLLNVSSQALDTGATTPLLWMFEERERLLSFYERASGARFHAAYIRPGGIAADVPDGLLDDIHAFTESFPKLLDDVDGLLTENSIWKQRNVDIGVVSKAQALDWGFSGPMLRACGIPWDLRKSQPYEIYETLDFKVPVGSNGDCYDRYLVRMAEMRESISIIRQCLNGIPEGPVKTDDRKIAPPRREELKYSMEALIHHFKLFSEGYKVPEGEAYVAVEAPKGEFGVYIVSDGTNRPYRCRIRAPGFAHLQAIDAMARGHMLADLTAIIGSLDIVFGEIDR

SEQ ID NO: 8891 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 8892 - protein, 495 aa, Vibrio vulnificus YJ016
MGHVKALGYKHRLSNCNYIDRRVSSMKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVAGKELALESGLGSKGDIVVMVSGALVASGTTNTASVHVL

SEQ ID NO: 8893 - protein, 350 aa, Debaryomyces hansenii CBS767
MNTSIPQTMKAIVLSGPYEVSTVTKQSPTIQDPTDVILKVKYSGLCGTDLHTYRGHIKLGSKDQIIGHEFLGTIVSRGSAITDSDFKIGDDVLSTFTIQCGECWYCKHGYSGQCDKTNTFGKVGLDGGQAEYVRVPYAMSTLIRKPESKSTEDDAVYVMMADIFITGYYGVKKILNHLKNESADGYTKSDIKDITILQLGVGPVGLCALRILKHFGFEKVVCVDSVTSRLEEARRFGAFKAINFETEKNGVADFIKESTNNVGFDVVLEVVGASSALRTAYDSVRGNGFICSIGMAHDPLPFTGLDCYLKNVNISFGRCHAWSLFPEALDLFEVLKPDFTIFIDFNLFLY

SEQ ID NO: 8894 - protein, 304 aa, Arabidopsis thaliana
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASDNNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEDGVNITANSLHPGAIMTNLWGYFNSYLAGAVGAVAKYMVKSVPQGAATTCYVALNPQVAGVTGEYFSDSNIAKPIELVKDTELAKKLWDFSTKLTDSQ

SEQ ID NO: 8895 - protein, 347 aa, Rickettsiella grylli
MATHELEGTIQRLTIHGKGILAADESQATIAKRFSPLHIESTAENRRHYRELLFTTPGIEAFISGVILHEETLGQKTKDGLLFSDYLDNEGIVPGIKVDKGLISLNTEEKMTQGLDGLAERLLTYKNLGACFAKWRAVFSISNTLPSSLAITANTQALARYASICQHNGVVPIVEPELLIEGDHSLSRCAEATETVLYSVFEELHKHHILLECMLLKPSMVIAGNQYTPQPHIAEVAAATLKILRRTVPAAVPSINFLSGGQSPEAATAHLNTMNKLQPSRHPWRLSFSYARALQEPALKIWNGKAHNIKAAQRAFYKRAKLNAAACKGHYQSSMEKEEKEVETNFV

SEQ ID NO: 8896 - protein, 385 aa, Cytophaga hutchinsonii ATCC 33406
MKAAVFHKPGHISVDTVEDPKIEKSDDIILKVTSTAICGSDLHIYDGFFPQARPLIMGHEFMGIVEEVGNAVTHLKAGDRIVVPFPIACGHCYFCNHDMQPNCEHSNPEHYGPEGDVLSGKGGGLFGYTDLYGGYAGGQAQYVRVPYADYSPRLVPESLSDEQVLFLTDIFPTGWSAIDWAQLKGGETVAIFGSGPVGLMAQKAAWLKGAGRVIAIDPLNYRLAKAKMVNNVETLNPHEVDVIEAIRAMTNGRGADVCVDAVGVEAERTFFDKVKAVVRFEKGTDKVLENCFKAVRRGGTVTVVGVYGTPYDNFPLHTMFDKGLTVRLGQAPVQKYIDHLFTLVQNEKVVLNDIVTHVLPLSHASHAYDIFKNKQEDCVKVILKP

SEQ ID NO: 8897 - protein, 467 aa, Salmonella enterica subsp. enterica serovar Typhi
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVVLLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLFLRKNKLAK

SEQ ID NO: 8898 - protein, 622 aa, Pyrococcus horikoshii OT3
MDEFVKGLMKNGYLITPSAYYLLVGHFNEGKFSLIELIKFAKSRETFIIDDEIANEFLKSIGAEVELPQEIKEGYISTGEGSQKVPDHEELEKITNESSVESSISTGETPKTEELQPTLDILEEEIGDIEGGESSISTGDEVPEVENNNGGTVVVFDKYGYPFTYVPEEIEEELEEYPKYEDVTIEINPNLEVVPIEKDYEIKFDVRRVKLKPPKVKSGSGKEGEIIVEAYASLFRSRLRKLRRILRENPEVSNVIDIKKLKYVKGDEEVTIIGLVNSKKETSKGLIFEVEDQTDRVKVFLPKDSEDYREALKVLPDAVVAFKGVYSKRGIFFANRFYLPDVPLYRKQKPPLEEKVYAVLTSDIHVGSKEFCEKAFIKFLEWLNGYVESKEEEEIVSRIRYLIIAGDVVDGIGIYPGQYSDLIIPDIFDQYEALANLLSNVPKHITIFIGPGNHDAARPAIPQPEFYEEYAKPLYKLKNTVIISNPAVIRLHGRDFLIAHGRGIEDVVSFVPGLTHHKPGLPMVELLKMRHLAPTFGGKVPIAPDPEDLLVIEEVPDLVQMGHVHVYDTAVYRGVQLVNSATWQAQTEFQKMVNIVPTPGLVPIVDVESARVIKVLDFSRWC

SEQ ID NO: 8899 - protein, 303 aa, Prochlorococcus marinus str. MIT 9211
MPAKQAMSSNPNPGNAMISPLIQWYPGHIAKAEKQLKKHIDKVDLVIEVRDARIPISTSHPHLEKWITNKKHLLVINRRDMITNKAIKEWDQWFKSEGKTPWWCNAKNGNGVAMIKEAAIRLGDELNERRKSRGMRSRAVRALTLGFPNVGKSALINRLTMQKVVESSRRAGVTKSLRWVRLGQQLDLLDAPGVLPPRLENQKAALLLAICDDIGQAAYDVESVGIAFLRLLSALEETYSGFNKESLKERYGIALENCEPNVHDWLANSASVHTSDDLRRMAQKLLDDFRKLLLGQISLELPK

SEQ ID NO: 8900 - protein, 283 aa, Glycine max
MEGNSGGGGGGNDVELLCKTLQVEHKLFYFDLKENPRGRYLKISEKTSATRSTIIVPFSGISWFLDLFNYYVNSDDQDLFSKELQLDTKVFYFDIGENRRGRFLKVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMTVANVRTVDPPQR

SEQ ID NO: 8901 - protein, 292 aa, Bacillus licheniformis ATCC 14580
MNKDIATPIRTKEILNKYGFSFKKSLGQNFLIDTNILDRIVDHAGVTERTGVIEIGPGIGALTEQLAKRAKKVTAFEIDQRLLPILEDTLSPYDNVTVIHQDVLKADVRAVMDEQFQDCDEVMVVANLPYYVTTPIIMKLLEENLPLKGIVVMLQKEVADRMAAKPSSKEYGSLSIAVQFYTEAKTVMNVPKTVFVPQPNVDSAVIRLTLRKEPAVAVQDAAFFFQVVKASFAQRRKTLFNNLVNNLPNGKENKSKIERALQDSHIDGKRRGESLSIEEFAVLSDRLREVLL

SEQ ID NO: 8902 - protein, 160 aa, Arabidopsis thaliana
  misc_feature (7)..(7): Xaa can be any naturally occurring amino acid
  unsure (1)..(160): unsure at all Xaa locations
ALVGGPXVRARNFVGVTCVNAGIASVMKRIRGKEDIESAVVAALGSGFAYSLVSQGLQGQPMNAITTAAGFAVFQGVFFKLGERFSKPSTEDPFFTRGRTMLVKLGLEKYEKNFKKGLLTDPTLPLLTDSALKDANIPPGPRLMILDHIQRDPEIKGKRK

SEQ ID NO: 8903 - protein, 267 aa, Leifsonia xyli subsp. xyli str. CTCB07
MNEAGTSSVRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 8904 - protein, 372 aa, Arabidopsis thaliana
MGKREKKPNRRRHKGEYSNDAEDFYDQHPPAVASVDEEDEENSDEEEEENDGNESSDLPSKFLLYQQSVQSPKGDISYLQKFFLMYVGGRQPFHFQEDFCGTALLSAEWLKTDTRRTAIGLDFDLDALEWCMDNNISKLGSDVYSRMSLFHGNVLTPLEAKQVKSKSHELIQNISLDDGDDNEDLADPSVVESLEKDGPDSLPKRDIVCAFNFSCCCLHKRSELVSYFKNARDALSKKGGIFVMDLYGGASAEGQLKLQRKFPNFTYTWEQAEFDILSRKTRISLHYHLQKQNRKIRHAFSYSWRLWSLPEIKDCMEEAGFSSVHFWLREMPDASEMRRTDGFGAGRDIKYEQVKSFQQCDSWNAYIVAVSL

SEQ ID NO: 8905 - protein, 243 aa, Synechococcus sp. WH 8102
MRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQAI

SEQ ID NO: 8906 - protein, 672 aa, Aspergillus nidulans FGSC A4
MASNFSEDNIKELKYRLEAAAVQCSERCLYQSAKWAAEILDSIIPIDNYDTDPDSPMDITEPRPQNPYLRTQDPVEAALEAQEYHKYLLAKSYFDTREYDRCASVFLPPTISPVSLSTSSPQSKLKSSLRNRKSQGSPHAGLKDNDLKRSPYPKLSQKSLFLALYAKYLAGEKRKNEETEMVLGPADGGATVNRELPDLARGLEGWFAERQEKGVEDQNHGWLEYLYGVILIKGRNEEEARKWLIRSVHLNPFHWGAWQELNDLLASTEDLKQVVEHLPQNIMTLIFHVHCSQELYQATEDTYQTLSELENIFPTSAFLKTQRALLYYHSKDFEEASHIFTDILITSPHRLDSLDHYSNILYVMGARPQLAFVAQVATATDKFRPETCCVVGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRIEQSIKALKRALVAGSYYAEDPSQHGGRKILDPETLYQIATLYERLEDEEEAAAYMELTLQQETGGQPDEVSDVSDSEIEDDQSNTASTSGANQRRARRSPNDDEEEAYHGTGPTATTSKARLWLARWSLRHGDLERADQLAGELCQDGVEVEEAKALMRDVRARREAGA

SEQ ID NO: 8907 - protein, 453 aa, Nocardia farcinica IFM 10152
MKDTETRPGRHRAPEPAHPEQPDTTGDTVVTVSGQDWDTVTETLGGAREERIVVNMGPQHPSTHGVLRLILEIEGETVVEARCGIGYLHTGIEKNLEYRTWMQGVTFVTRMDYLSPFYNETAYCLGVERLLGITEQIPERASIVRVLLMELNRISSHLVCLATGGMELGALTPMLFGFRERELILDVFETITGLRMNHAYIRPGGLAQDLPDDGVAKVRELLDLMPKRLRDMEHLLTQNPIFKARTQDIGYLDLTGCMALGITGPVLRSAGLPHDLRKSQPYCGYETYEFDVPTTTGCDCYGRYLIRVEEMKESLKIVEQCLDRLRPGPVMIEDKKLAWPADLKLGADGLGNSPAHIGRIMGSSMEGLIHHFKLVTEGIRVPAGQVYVAVESPRGELGVHMVSDGGTRPYRVHYRDPSFTNLQAVAAMCEGGMVADVIAAVASIDPVMGGVDR

SEQ ID NO: 8908 - protein, 304 aa, Mycobacterium leprae
MAKWTTADIPDQTGRVAVITGANTGLGYQTALALAEHGAHVVLAVRNLDKGKDAAARITATSAQNNVALQELDLASLESVRAAAKQLRSDYDHIDLLINNAGVMWTPKSTTKDGFELQFGTNHLGHFAFTGLLLDRLLPIVGSRVITVSSLSHRLFADIHFNDLQWECNYNRVAAYGQSKLANLLFTYELQRRLATRQTTIAVAAHPGGSRTELTRTLPALIAPIFSVAELFLTQDAATGALPTLRAATDAAVLGGQYFGPDGFAEIRGHPKVVASNGKSHDVDRQLRLWAVSEELTGVVYPVG

SEQ ID NO: 8909 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 8910 - protein, 395 aa, Triticum aestivum
  misc_feature (186)..(186): Xaa can be any naturally occurring amino acid
  misc_feature (198)..(198): Xaa can be any naturally occurring amino acid
  misc_feature (234)..(234): Xaa can be any naturally occurring amino acid
  unsure (1)..(395): unsure at all Xaa locations
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVEXNFTVGTIFGVWXPGDKLTGVTGGDQVAAAMGIYGPRTTFVVALKDCPXGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 8911 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPRGMEEGIDAALSAAAAKEGVTWSDYQKDLKKAGRWHVETY

SEQ ID NO: 8912 - protein, 865 aa, Oryza sativa (japonica cultivar-group)
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTVIKALRTHPRIRRLVYISCNPDSLVANAIELCTPSSEKQEKNKGNRGWRTMSSAGLARQRTKSMPNSEPFVPKRAMAVDLFPHTSHCEMVMLFER

SEQ ID NO: 8913 - protein, 401 aa, Burkholderia vietnamiensis G4
MKAVVFHGIGDIRIDTVPDPQLAQPTDAVVRLTASAICGTDLHMVRGTLGGMKPGTILGHEGVGIVEAVGRDVRNLKRGDRVLIPSTIACGSCAYCRAGYTAQCDVANPGGPRAGTAFFGGPADTGAFDGLQAEYARTPLANASLIRLPDSIDDDRAILMSDIFPTGYFGAQLAEIKPGDTVAVFGAGPVGQFAIASAKLMGAGRVFAIDRIASRLDMACAQGAETIDFAEEDPVDAVLRLTGGIGVDRAIDAVGVDAMRATHGPAAADADAARAFDTEVDAVAPRRKPDGRNWVPGDGPSQVLQWAVRAVAKAGTVSVIGVYPAQARVFPIGEAMNRNLTIKMGNCNHRTITPHLIELVRSGAFDPAAVLTCREPLTNAIDAYRAFDVREPGWMKVKLTP

SEQ ID NO: 8914 - protein, 214 aa, Petunia x hybrida
MFRSQLTSVIFVLFFSLPPIYGYFEYMQLVLTWPPAFCHIKRCRRTPNNFTIHGLWPDNYSTMLNFCTDDEFVKFTDDDKKDKLDKRWPDLITDEADCKGTQDFWKREYEKHGTCCLSSYNQEQYFELAMVLKDRFDLVKSFRNHGIIPGTAGHTVQKINNTVKAITQGFPNLACTKALELKEIGICFDRTGKNVINCPHPRTCKQTRTGIKFP

SEQ ID NO: 8915 - protein, 505 aa, Schizosaccharomyces pombe
MAILKSALVGFICFLHFFIVNASDNKSLLTEDIMASQVCNGMFAKKGKTSEITLKIDSYTSDFGGAIRLLIFNWKDVNAIGMEDDDGEKHYICNYEDIEAGVCKDDDYGLYLINQTAPHDSIYSAAVDAESMVSPLKYPVEQSGLYCVFTAPLEGSSEAYKITVTWENYFGNLDATDYPHLFLNPILLAINCLIGIWWSFIMFRYRHDLLQVQKYISGVVALSIVCTMVSTGYFYFANSKGYTTGSKVFAFFLSLAQSARQSYFGFLLLIVSLGYSIVVPSLGSLLRKCQILAGLQFVSSCFFLSSLFISPSNKESLVILFAAPVFLITLFAMFLWIVLALNNTIRDLRIRKQTVKAQMYTRLWIVICFGIVAYASIVAANAILIGIYGQMNYYLKYWKLLWFLNYGYTDILVLILMLTILYLWRPTENNRRFAMSEQVAQDVDEFEMTSSLSNDSLHLHHERPTSPANPHIIHGSADEHQALFAVDDESDDDASTLATSKQKPA

SEQ ID NO: 8916 - protein, 244 aa, Deinococcus radiodurans
  misc_feature (106)..(106): Xaa can be any naturally occurring amino acid
  unsure (1)..(244): unsure at all Xaa locations
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 8917 - protein, 968 aa, Tropheryma whipplei TW08/27
MHERHIGPSQEEIDHMLGFLGYKSLDDLMHAALPNGVQSPPDIKIPSHDELTCLTQLAAFAKMNRIKTSMLGQGFYNCITPAVIRRNILENPSWYTSYTPYQPEISQGRLEMLINFQTMICDLTGLEIANASMLDEASCAAEAMLLAKRVSRSSSNKYLVHNGVFPHIRRVLETRADAVGVEIVDLPEGQSIDFDHFGVYAQYQSASGKLLDLRPLFSRSKRAGAICVIGCDLLMLTLFTSPGELGADIAFGSAQRFGIPMNFGGPLASFLAARKAMERSLPGRLVGVSVDADSNHAYRLTLQTREQHIRREKATSNICTATVLMAIAAVAFAQHHGPKGLRAIAHRINTVAVGFARLLKQTAFRVSSLDIFDTIEINNPTQVCVEAESKYDLLFWKVDDNKLRITFDEVTARLDGDLPERLSKVFGISPDKIRDLGCNYDSCDCSFYGDLQQAREGLSSVASRNISVHSDLARHPLRRFSGYLKHPVFNNYTGEVALMRYLKALSDKDFALDRGMIPLGSCTMKLNAAFQLEPVLWPEFANLHPFAPLGDADGTLQIIDQIETWLANLSGYDAVSLQPTAGSQGELAGLLAIRGYYKSLNLDRDVCLIPASAHGTNAASAVLAGMRVVVVACDQQGNIDLDDLRLKASKNAHALAALMVTYPSTHGVYEDNISEVCSVVHKYGGQVYVDGANSNALIGYLRTGDFGGDVSHLNLHKTFGIPHGGGGPGIGPVVAKAHLAPFLPFRNRVHKPSTDLPAVKHMGGPIASSDYGFAGALYISWAYIFCLGSQGMKRCTAVAVLVANYIAKQLSDTFPVLYTGKNNLVAHEFIMDFREVTRVSGITVDDVCKRLIDYGFHAPTMSFPVPGTLMVEPTESEPFSEIQRFIKTIRSIRAEIDRVIDKTYDPDNNPLKRAPHTLEQIASDKWDRPYSRRTGIVYTSGKYWPASARIDNAYGDRNIFCTCPDLPD

SEQ ID NO: 8918 - protein, 256 aa, Vibrio vulnificus CMCP6
MRRPVVMGNWKLNGSKTMVAELLTGLNAELEGVEGVDVAVAPPALYIDLAERLIAEGGNKIILGAQNTDINNSGAFTGDMSPAMLKDFGATHIIIGHSERREYHNESDEFVAKKFAFLKENGLKPVFCIGETEAQNEAGETEAVCARQINAVIDAYGVEALNGAIIAYEPIWAIGTGKAATAEDAQRIHASIRAMIAAKDAAVAEQVIIQYGGSVKPENAEAYFAQPDIDGALVGGASLDAKSFAAIAKAAAKMKA

SEQ ID NO: 8919 - protein, 144 aa, Arabidopsis thaliana
RGRWGFQGQLGAAFSDPFLLRLFFFLAVLINHLRSFLLRLTFKSNPNLPEDDVSIASGLANIIVLADQLSLNRLFSYRCGDGGGGGSDCVACLSKLKEGEEVRKLECRHVFHKKCLEGWLHQFNFTCPLCRSALVSDDCVSKTQ

SEQ ID NO: 8920 - protein, 494 aa, Oryza sativa
  misc_feature (370)..(370): Xaa can be any naturally occurring amino acid
  unsure (1)..(494): unsure at all Xaa locations
MAESYHKEVIAGLKDKSLFIQEAFIDGQWVAKDNKFDVFEPSTATVLGQVANCALEDFQTAIKSADVAQTNYFDSTTGASRGALLRTWYDLVLANQEDLANILSLENGKTYSEALGEVLYSASFISWFAEEATRSYGVTIPSSAPHTTLMTVREPVGVCGIITPWNFPAAMITRKIAPALAAGCSVVIKPPSETPYSALAFTKLAIDAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGSGLDKSTTQGPLVNKAAVDKVKEHIADATSKGAQIATGGSTXRSPGFFHQPTVLTGVTQEMAVAKDETFGPLAPIFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 8921 - protein, 344 aa, Thermus thermophilus HB27
MRAVVYKGPFQVAVEEVPEPRLEADTDALLEVELSAICGSDLHIYHGKIAGVLPGTVLGHEFVGRIVEKGPLVPFPVGERVVGSFQVACGECPACRKGQFFACSRGGVFGFGLALGNLPGAQAERVRVPFARHTLFPIGDLPAEEAILAGDILTTAYGGVRPFLTPGMSVAVVGSGPVGLMAQMVAHALGAGQVYAIDPEEARLEKAKALGSLPIHPKAEDPVARVRRETEGLGADLVVEAVGGDGEALKLALRLAGPGGVVSSLGVPTAERLDYPWLPAFSRGITLRSALANVPRWIGEVLALQKAGRLKGSFVFSHRLPLEEAPEGYRLFHERKATKVALVP

SEQ ID NO: 8922 - protein, 463 aa, Lactobacillus acidophilus NCFM
MNEKTGDKLGFWSIVLLAINAIIGSGIFLTPGSVVQQAGSKALIVYFIAAIFAAILAISFAAASKYVTKSGAAYAYSKAAFGKKVGFYMGVLRYFSASVAWGVMAVGVIKSTISIFGGDPNKALNVTVGFLILMAIITIINLFGQRVLKWVMNLATIGKLAALVLIIIAGVILLITTGASSNLAEVDQITQNGQKIVPTLTTTTFVMAIVSAFYAFTGFESVASGSDDMKNPEKNLPRAIPLAILIIAVVYIGVVAVAMVLNPKALMTTKQVVAIAAIFNNEILRDIILVGALVSMFGINVASSFNAPRILEAMAREGQMSKALTKRTKNNFPIRTFFISVGLAILIPMAFEYNMVNLITLSAMVRFLGFIVVPIAVIQFYRGKTKEEVLKADKNAWTDVVVPILSIIIVVFLLIEYNWQAQFGITNAAGQVVGVNWYAIAMMIFGFVLLPLIMAWISRRERK

SEQ ID NO: 8923 - protein, 284 aa, Thermus thermophilus HB27
MYSSRVLGLRARSSTLLHDSLIPVRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVRGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 8924 - protein, 264 aa, Candidatus Protochlamydia amoebophila UWE25
MHITIIGCGNMGSGIAKRLSMNHQISLYDHYPATAESLTKQIQATAYADLFSAIEEADLILVAVKPQNLDDLTERLAPLLKPHQTIVSILAGINYKTLKHRFSQSIVVRMMPNLALIHGKGVIGLVENDQLTDKLKMQLKALFDPLGSVYWLPESKIDALTALTGSGPAFIFALVESMIEAGIYMGFQMTDAKSLIFQMLKGSLALLETTDKHPADLKWQITSPAGMTIEGLKTFEDYGVRSGIIHTFLASFNKIKQVSDSLKN

SEQ ID NO: 8925 - protein, 514 aa, Medicago truncatula
MIIIKFQILSFFIYLLFLLLFLPNNVHASIHYYSKQPFTHRSNAFFFHAGAEALFSSSFIRFESISFTRPKHSAIIHGQMQQNTGLIESIILEVKDRNRIGGFYFNPKSDLICCDPFLSKTQNCNLGEVIIHNNPQNPNFPKRLKTFFQGTNQIAHMDPQTVQINATGIYYLYFMFCDPNLEGTTFTGRTVWRNPNGYLPGKMQPFITLYAFMSLAYLLLGLAWFLRFLHFWKEKDVVHVHLHYHITAVIALGMVEMAFWYFEYANFNATGSRPMGITIWAVTFTSVKKTLSRLLLLVVSMGYGVVRPTLFEGFVSRVTVLGGFYFVACEVFELFEHLGNINDFSGKSKLLLVLPVVCLDSCFILWIFSSLSKTLEKLQTRRNLAKLEIYRKFTNTLAVSVLLSIAWIGFELYFNATDPLSELWQIAWIIPTFWCLLSYTLLLVICVLWAPSRNPTRYAYLEGTNDFDEEGISLTSSVAKMTGDVASKLERKERIGSSATDLTFGDDIEEDKRE

SEQ ID NO: 8926 - protein, 457 aa, Lactobacillus acidophilus NCFM
MAKKAPELKRSMTAGQMEMISLGGAIGVGLFMGASSTIKWTGPSVLLAYIFVGVILYIVMRALGEMLYIDPGTGSFADYASEHVHPIAGYLAEWANVFQYIVVGISEVVATTEYLRFWWKGTSDWIAGIIIILFLLIANLASAKAYATLEFWFAMIKVVTITLMILLGLAVILFGFGNGGHPVGFSNLWSHGGFFTGGIKGFFFSMAIIVGSYEGIELIGISAGEVSDPHKAIIKSVKSVLWRILIFYVGAIFVIVTIYPWNKLDSIGSPFVTTFAKVGITAAASVINFVVLTAALSGANSGIYSSSRMLYKLAHEGEAPKTFGYISKRIVPSHAIIGITSGILIGFMLNVLAQFLNKSLANIFVIVYSSSVLPGMVAWFVILLAELRFRRKNPDLMEDHPFKLPLYPYSNYFALIMLVVIVIFMFINPETQISVSVGALVLIVAAIVYVIKHRKEN

SEQ ID NO: 8927 - protein, 449 aa, Lactobacillus acidophilus NCFM
MNENTKLKRGLKSRHVTMIAIGGAIGTGLFLGSGSAIHSAGPSIILSYLIVGIITFFMMRALGELILADPDSHSFLESIKKYLGKRAEFVAGWTYWACWLSLAMADLTATGIYLRYWFPWLPQWVGPLVIVVLLMLINMVNVGLFGELESWFSMIKVIAIIALIVVGAVMIIFHTPVKGGTVSLTNLVSYGGFFPTGVWGFLLSFQMVVFAFVGVEIVGQTASETANPHQDIPKAINTLPVRIGLFYVGSMMAIMSVYPWNQIKTTSSPFVQVFTGIGVTAAAGILNFVVLTAALSATNSAIFSTSRSLYSLARNGHAPKKLGNLTKKAIPMNALITSSLILFVVVILNYVMPAEIFAVVSTVSTICFVIVWIMIMFTHIVYRRHNKNNLGEFRMPGYPLTSWLTIVFYIAILILLFFIESTKLALIISIVFVLILTVSYNFVSKNTNN

SEQ ID NO: 8928 - protein, 529 aa, Debaryomyces hansenii CBS767
MSSDTFHEFGVLFDRIQPYLTSLWAICIGAYILFSISTRINDRILMKKLGAKPMQMNAPNSFWGIPLMFRLLKAKREGTMVDVTKERYKELGVDTFNVNIAGTHAVVTRDPENIKAILATQFNDFALGKRHTHFKPLLGDGIFTLDGAGWKHSRTMLRPQFAREKVAHVKALEPHLQTLAKHIINSKGERFDIQPLFFRLTIDSATEFLFGESVENLHDESVGLTRDPVDFDGKSGFADAFNTSQTWLASRAVTQNLYFLVDGRSFRSSNAKVHKFADYYVRKALEASSEDLEKASRDGYIFLYELVKQTRDPVILRDQLLNILLAGRDTTAGLLSFTFFELARNQDVYDKLKEEIYEKFGEGEDSRVDEITFESLKKCEFLKCVLNEILRMYPSVPQNFRFAIRNTTLPKGGGPDGKSPIFVSKGKNLFYSMYSAHRNPKYYGKDAEEFRPSRWLEPEIRKVGWAFLPFNGGPRICLGQQFALTGASYIVVRLIQMFPNLSSFCEEYPPRKNTQLTMSHQNGVYIGMF

SEQ ID NO: 8929 - protein, 391 aa, Pyrococcus horikoshii OT3
MREKRKYFIAERVLLIKRSKIRELFERASKMEDVISLGIGEPDFDTPKNIKEAAKRALDEGWTHYTPNAGIPELREAVVEYYKKFYGIDIEVENVIITAGAYEGTYLAFESLLERGDEVIIPDPAFVSYAEDAKVAEAKPVRIPLREENNFLPDPNELLEKISKNTRMIVINYPNNPTGATLDKELAKTIADIAEDYNIYILSDEPYEHFIYEDAKHYPMIKFAPENTILANSFSKTFAMTGWRLGFVVAPSQVIKEMTKLHAYVIGNVASFVQIAGIEALRSEESWKAVEEMKKEYNERRKIVVKRLKNMPGIKVKEPKGAFYVFPNISGTGMSSEKFSEWLLEKARVVVIPGTAFGRMGEGYVRISYATSKEKLIEAMNRIEKALEGEK

SEQ ID NO: 8930 - protein, 525 aa, Debaryomyces hansenii CBS767
MSSSAHELFRSIEPYLTNWWIICIGTYVLFSILTWINERILMKKLGAKPIQFIAPDPFWGIPLMFRLLRKKKDGTMVDMTKERFEEFGIETFSFRVGGTPVITTKDPENIKAMLATQFNDFALGKRHTYFKPLLGDGIFTLDGAGWKHSRAMLRPQFSREQVAHVRALEPHLQTLAKHIINSKGERFDIQPLFFRLTIDSATEFLFGESVENLHDESVGLTRDPVDFDGKSGFADAFNTSQAWLASRAVSKNLSLFVDGKEFRNSNAKVHKFADYYVRKALEASPEDLEKASRDGYIFLYELVKQTRDPVILRDQLLNILLAGRDTTAGLLSFTFFELARNQDVYDKLKEEIYEKFGEGEDSRVNEITFESLKKCEFLKCVLNEILRLYPSVPLNTRCATKNTTLPRGGGPDGQSSIFIPKGKSVLYSVYATHRNPKYYGKGAEEFRPSRWLEPEIRKVGWAFLPFNGGPRICLGQQFALTEASYIIVRLIQMFPNLNSFCEKYPPRKSSHLTMCHQDGVSIGMF

SEQ ID NO: 8931 - protein, 332 aa, Wigglesworthia glossinidia endosymbiont of Glossina brevipalpis
MTLNIALNGFGRIGRMIFRIAQTRNNFNIVAINDLCSINEISYMLRFDSTHGKFLKKIYIKENFIQIEDKKIYCFSEKDPSNLPWKKLNIDIVIEATGLSLTKKASENHIISGAKKVIITAPPKDNIPMFVMGVNNNLYNGEKIISNASCTTNCLAPIAKVLNDYFGIQEALMTTVHSVTSTQNTVDGRSLQAFRIGRSCLNNIIPTSTGAADSVGKIIPDLNGKITGTSFRVPTTNVSVVDLTVKFKKETSYKEVCNAIKYESKNKFNGILGYTEDNVVSSDFNGEFLTSVFDSKAGIELNKTFMKIISWYDNESGYSSKVLDLAQYIFNK

SEQ ID NO: 8932 - protein, 332 aa, Salmonella enterica subsp. enterica serovar Typhi
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 8933 - protein, 707 aa, Oryza sativa
  misc_feature (396)..(396): Xaa can be any naturally occurring amino acid
  misc_feature (675)..(675): Xaa can be any naturally occurring amino acid
  unsure (1)..(707): unsure at all Xaa locations
MASLSSFLLAAAVATLFVVGSYATELTFKVNEGSSATSLELITNVAISEVEIKEKGASDWTALKESSSNTWTIKSGSPLKGPFSVRFLVKNGGYRVVDDVIPESFTAGSVYKSADAAHDHAGALAPHRRASPLRRRGRLFLACRVPAAAPSARGVAAEAAAGRPTVLVTEKLGDAGLELLRRFANVDCAYELTAEELRAKVSLVDALVVRSATRVTREVFEAARGRLRVVGRAGVGIDNVDLQAATEAGCLVVNAPTGNTVAAAEHAIALLAAMARNVAQADASLKAGKWQRNKYVGVSLVGKTLAIMGFGKVGSEVARRAKGLGMDIISHDPYAPVDRARAIGVDLVSFDEAISTADFISLHMPLTPSTAKLFDDETFANMKKGVRIINVARGGXVVDEDALLRALDNGTVSQAALDVFTEEPPPLHGFGARHEHVTVTPHLGASTSEAQEGVALEIAEAVLGALKGELAATAVNAPMVPAEVLSELSPYVILAEKLGRLVVQLVAGGSGIKGVKIGYSSSRDPDDLDTRVLRAMVTKGIIEPISSAFVNIVNADYVAKQRGLRISEERILLDGSPEIPIDSIQVHLANVESKFAGALSDEGDIRVEGEVKDGKPHLTLVGPFSVDVSLEGNLILCRQVDQPGIIGKVGSILGKMNVNVNFMSVGRTAPGKQAXIMAIGVDEEPEKEALKLIGDIPSVEEFVFIKL

SEQ ID NO: 8934 - protein, 484 aa, Ralstonia eutropha JMP134
MFSLKDPGLLRQQAYVDGQWRAAESGKTLDVINPANNEPLGTIPACDAADTRAAIEAANRALPAWSALTTHQRAAVLRKWRELMVAHADDLALIMTLEQGKPLAEARGEILYGASFVEWFAEEGIRAYGETIPATHASRRIIARKVPVGVCAAITPWNFPNAMITRKLAPALAAGCAVVVKPSELTPYSALALAELGERAGIPAGVLNIVTGMPQGIGGELTANPIVRKLTFTGSTQVGKLLLRQCADTVKRVSMELGGNAPVIVFDDADLEQAVAGVMASKFRNSGQTCVCANRIYVQAGIYDRFSARLSEEVRKLKVGAGTEDGVSIGPLINDAALRKVVRHVEDAVAHGAKVIVGGASLSRGQQYFEPTVVTGATDGMLIASEETFGPVAALFPFESETEIIRRANDTPYGLAAYLFSTDVNRVFRVSEALEYGMVGANTGVISSAVAPFGGVKESGLGREGSHHGIDEFLEVQTLHLEIV

SEQ ID NO: 8935 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASATTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 8936 - protein, 394 aa, Prochlorococcus marinus str. MIT 9211
MSQLETRTEPMVVNFGPHHPSMHGVLRLVVTLDGEDVVDCEPVIGYLHRGMEKIAENRTNVMFVPYVSRMDYAAGMFYEAIVVNAPERLAKISVPKRASYIRVLMLELNRIANHLLWLGPFLADVGAQTPFFYIFREREMIYDLWEAATGQRLINNNYFRIGGVACDLPSGWLEKCTDFCKWFGPKIDEYEKLITNNPIFRRRIEGLGAISREEAINWSLSGPMLRASGVSWDLRKVDHYECYDDFDWSISTATEGDCFARYRVRIEEMRQSLKILLQACEMIPGGPTENLEASRMLEGKGSKFAGFDYQYVAKKVAPTFKIPDGELYTRLESGKGEIGVFIQGNNDVTPWRFKIRAADLNNLQILPHILKGAKVADIMAILGSIDVIMGSVDR

SEQ ID NO: 8937 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 8938 - protein, 569 aa, Leifsonia xyli subsp. xyli str. CTCB07
MSFTAPITLPGLTLDPQWYRRSVFYEVMVRSFVDSNGDGSGDLAGLTSKLDYLQWLGIDALWLPPFFQSPLRDGGYDVSDFRAILPEFGTIDEFRDLVTKAHERNMRIIIDLPMNHTSDQHEWFQQSRSNPEGPFGDFYVWNETDDKYPDIRIIFVDTEDSNWAFDEARRQYYFHRFFSHQPDLNFENPAVHDAMFDIVRFWLDLGVDGFRLDAIPYLYESDEGNGEGEPPTHEFIKRLREVVDREYPGRMMVAEANQWPREVAAFFGSEEEPECHMAFDFPVMPRIFYALRSQQASELIHVLSETTDVPDGYAWGVFLRNHDELTLEMVSEEYRQAMYGWYAYDPRMRANIGIRRRLAPLLDNSRAELELAHALLFSLAGSPFLYYGDEIGMGDNIWLPDRDSSRTPMQWTPDRNAGFSSADPGKLFLPVVQSLVYHYNQVNVEAQLAQSRSLLHWVRNVIHVRKAHPVFGLGDMRVLPTNHESVLAFVRTYEGSGSHFGDQPEDVLCVFSFAHNPVSVTLEAPEFAGRTLYDLFGGAEFPTVAEDGRFTLTLGTQSFYWLHIEPRRD

SEQ ID NO: 8939 - protein, 816 aa, Pseudomonas syringae pv. phaseolicola 1448A
MSQEPLVRDADVAAFRAAVLAKLTYSVGKDPDHAFEHDWFEAVALAARDHMVEHWMDHTRQIYRKVQKRVYYLSLEFLIGRLLYDSLSNLGLLEVAREALTELGVDIERIRLLEPDAALGNGGLGRLAACFMESMSTLGIAGHGYGIRYEHGLFRQGIVDGWQQEQTENWLDFGNPWEFERPEVVYSIGFSGSVDTVVTEAGDSRQVWRPGETVRAIAYDTPVVGWRGKSVNTLRLWRARAVEDLHLERFNAGDHFGAVAEVVRAESISRVLYPNDATEAGQELRLRQEYFFVSASLQDLLRRHLNQHATLTDLPDHAAIQMNDTHPSIAVAELMRQLIDNHNIPWDTAWKITVGTLGYTNHTLLPEALETWSVGLMERMLPRHMQIIYLINAQHIDTLRAKGVDDVNVLRAVSLIEEDNGRRVRMGNLAFLGSHSVNGVSALHTQLMRKTVFAELHKIYPERINNKTNGITFRRWLFQANPKLTEMLIEALGEDVLDNAETRLKELEPFADKSSFRKQMADQRLHSKRALAAIIHERLGIAVNPAAMFDVQVKRIHEYKRQLLNLFHTVALYQAIRAEPGTDWVPRVKIFAGKAAASYNSAKLIIKLTNDIARTVNNDPTVRGLLKVVFMPNYNVSLAESIIPAADLSEQISTAGLEASGTSNMKFGLNGALTIGTLDGANVEMSEQVGLEHMFIFGMSSQQVEARKRAGEFNAHGDVAASGRLNDVLQAIRGGVFSPDDPNRYVGLIDQLLDYDRFLVCADFDSYWAAQAKVEERWHDSKEWWRSAVLNTARMGWFSSDRTIREYAGDIWKALD

SEQ ID NO: 8940 - protein, 340 aa, Legionella pneumophila str. Paris
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLIDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 8941 - protein, 425 aa, Haloquadratum walsbyi
MTDRQGHSASSIESEQANDEIRNPDHTSGNIHRLSQRAKQTPPSGIRRFFELADEMDDIVSLGVGEPDFSAPWAARSAAIDALERGKTSYTANRGRSDLRANISEHVKQYDLEYDPDEEILVTAGASEAVDLAMRALVDPGETVAVPKPSYISYAPSVTFAGGEVRSVPTRAETDFTLTYEDLTAANASEASALVLCYPNNPTGAVMTRDELRDVATFAREHDLFVLSDEIYSALRYDDEHVSIATLPEMRERTLVFNGFSKAYAMTGMRLGYALGPQEVIDAMNRIHQYTMLSAPTTAQAAAMEAINSCEPAVEKMRQAFDRRRQFVISRFNELGMDCFEAKGAFYVFPKCPPGWEDDEEFAEALIHEERVALVPGRVFGDGGEGHLRVSYASGMDDLKTALTRIESFLESYPTSASLEVSDTA

SEQ ID NO: 8942 - protein, 525 aa, Debaryomyces hansenii CBS767
MSSNFHEVVESIEPYVTNWWFICIGAYVLFSILTWINKRILMKRLSAKPMQVTARDAFVGIPLVFNLLKAKREGTMVDMTKERYEEFGVDTFDFRIAGTHAIATRDPENIKAVLATQFNDFVLGKRHAHFKPLLGDGIFTLDGAGWKHSRAMLRPQFAREQVAHVKALEPHLQTLAKHIINSKGERFDIQPLFFRLTIDSATEFLFGESVESLHDESVGLTRDPVDFDGKSGFADAFNNSQAWLASRAVSQNFYFLLNGKDFKDSNANVHKFADYYVNKALETSPEDLEKASRDGYIFLYELVKQTRDPVILRDQLLNILLAGRDTTAGLLSFTFFELARNQDVYDKLKEEIYKKFGEGEDSRVDEITFESLKKCEFLKCVLNEILRMYPSVPQNFRFSIKNTTLPRGGGPDGKSPILIPKGQNLLYSVYATHRNPKFYGKDADEFRPSRWLEPEIRKVGWAFLPFNGGPRICLGQQFALTEASYIIVRLIQMFPNLGSFCEEYPPRKSSHLTMCHQDGVFIGMS

SEQ ID NO: 8943 - protein, 111 aa, Picea abies
MGPSDSPYAGGVFLVTIHFPPDYPFKPPKVAFRTKVFHPNINNNGSICLDILKEQWSPALTISKVLLSICSLLTDPNPDDPLVPEIAHMYKTDRGKYESTARSWTQKYAMG

SEQ ID NO: 8944 - protein, 98 aa, Triticum aestivum
MAGPAKASWTAAMSVGAVEALKDQAGLCRWNYALKSIHRAAKAKASVGVSQSQSTKQRTVIYGRVRPGLAAALVERRRAEKAEEALRTVMYLSCWGPN

SEQ ID NO: 8945 - protein, 331 aa, Nocardioides sp. JS614
MALGRAAPRRSGCPADVTGARREARGVALTTLAPMSDTSAGPRLLGPADVRLLAAELDLRPTKQRGQNFVIDANTVRRIVREAGVTAEDVVLEVGPGLGSLTLALLAVAGRVVAVEVDPVLAGRLPATIAAYAPAQADRFEVVLGDAMRIQEVPGPTPTALVANLPYNVSVPVLLHLLTLLPSLERGLVMVQAEVADRLAAAPGSKVYGVPSVKAAWFADVRRAGAVGRNVFWPAPNVDSGLVAWSRREPPATTATREQVFAVVDAAFAQRRKALRGVLRSLAPAESVDAALAGAGVDPLARGESLRVEDFARLAERLPWEALPSKEGPWR

SEQ ID NO: 8946 - protein, 348 aa, Gibberella zeae PH-1
MAAPSFDTTPENQAGILHFFRQQLRYKPQAVTGVSLEGKTGIVTGASSGIGLETSRQLLDLGISKLILAVRNLEKGNAAAEDLAKGRNPPLKEGTIEVWKLDLDFYDSITAFAEKAKSLTRLDMVLMNAGLCPAKRVVNEQTKHDEIIQVNYLSTALLTLLLLPVIKATRLNQPGPTRVTFTSSEVAAWSKFKYDNGMNIIKTLDSSEKGSDTLSQMFNSKLLGQFFIAELAKRVPSSLAIINGASPGSIHDSQFNREIDQTFSGAMVKRVMKHVANTSANGARMMTDAIVKHGEETHGQFLSFQKLVPMAPIIYTDTGKKCSEQLWKETMEELAFAQPERLIESVSA

SEQ ID NO: 8947 - protein, 232 aa, Bifidobacterium adolescentis
MDKAQQDALKKAAGIEAAKLIQNGMIAGLGTGSTVRFLVDELGRRVKEEGLEFTGVTTSRRTQEQAEGYGIKIVNIDDVDHIDVTIDGADEVDKNFNGIKGGGAALLWEKIVATNSNKIVWIVDESKVVDTIGKFPLPVEVIPFGAGQVVKKFEAKGYKPVLRLDANGEPVRTDENNYVVDLHLERIDHPQELAQDLITTVGVVEHGLFLNMVDQVIVGDPNGPRVMDNPNK

SEQ ID NO: 8948 - protein, 235 aa, Pyrococcus horikoshii OT3
MLGLKTSIIGRRVIYFQEITSTNEFAKTSYLEEGTVIVADKQTMGHGRLNRKWESPEGGLWLSIVLSPKVPQKDLPKIVFLGAVGVVETLKEFSIDGRIKWPNDVLVNYKKIAGVLVEGKGDKIVLGIGLNVNNKVPNGATSMKLELGSEVPLLSVFRSLITNLDRLYLNFLKNPMDILNLVRDNMILGVRVKILGDGSFEGIAEDIDDFGRLIIRLDSGEVKKVIYGDVSLRFL

SEQ ID NO: 8949 - protein, 153 aa, Aspergillus fumigatus
MSNEQTFIAIKPDGVQRGLIGPIISRFENRGFKLVAMKLVSPPQSQLEQHYADLSDKPFFKGLVSYMLSGPICAMVWEGRDVVKTGRTILGATNPLASAPGTIRGDFAIDVGRNVCHGSDSVENAKKEIALWFKPEELISWKSATFDWVYEKA

SEQ ID NO: 8950 - protein, 233 aa, Campylobacter coli RM2228
MAQALAYGLKDSYNIYIVGRNLEKLQILEKEGFKTLLYKDFNIENKNIILAFKPYALESVAANLKGKAKILISVLANTDFDKLKLIQAQNYARIMPNTAAKYKASTTPYVLKNSNFKDEVIEILNTFGKAYELNEEKQMNAAMAISGCAPAFLALVAESIANAGVYEGLSKDLSLNLTRSLFKSAAALLENEHPAIIKENICSPAGVTIKGIKVLEQKGIRGTFFEALNASAT

SEQ ID NO: 8951 - protein, 194 aa, Glycine max
MSHFKGKYHDELIANAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIGEPEILGDGSLDI

SEQ ID NO: 8952 - protein, 479 aa, Haemophilus somnus 129PT
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDEEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTSTCRALVVE

SEQ ID NO: 8953 - protein, 2160 aa, Oryza sativa
MDRDEEMGHGDRSLLFIGDEDDDLEADRDGGSTPSSDPGSFSDRSDPPSVDDIDEDDDDVVGDGRRAPRDDDDDQRGTWPQSFRQSIDMMSAVPSPAMSSIITAASPNLGRLAAVGSSLLKRATSSAVGQEGSSLPLSRPLLPPSSLSQLSTASGPPVRDSADSLPPRARPPPPPLQGESVVPPPLPRPSSACLRSNYIDLPPPSTRCGQKQAILNGASGLMFCVELEFSPQVTESNKKCIDSSPSIDTYPDIGQAAFGIYGRIFVSVVLYLELYACGVEYITLLGDSLSSVFPSADLAFGGIYLNAHNLFAITMALAILPSVWLKNLRLLSYLSAGGVIATTTVIVCLFWVGIGEGVGFHPGGTALNLTHFPVALGLYGYCYSGHSVFPNIYSSMEERPKFTFVLLFCFIVVTFVYAGVAVAGFLMFGESTMSQFTLNMPQQFIPSKIAIGMTIINPYTKYALTLTPVALSIEEALPRRMQTYQVGMCVRTALVASTVVVALTFPYFALVMALLGSVFTMLVALILPCACYLSIKKGSTPLWEEIPDPIATFKIGDMKKIAENYDTRVEDIIKAMRKDTDVKFTFVVDGKKMIVPVTPAQNLTDVNGIYIIEITDGNLRLCLVADKYQNWFRGFITDKGNRFEIDHDTLPNIMKNSQSLHTNGMYPSLLGCEVSELKIGYHQLLAAFHTLARYGEGRRDLKKAKEAVAIFLILLFEGPRLLPVEQKMMNSLTQNLVAVVGTDKELINNWCGMSRNFYDENGYEMEVIISEETSEIVKNAVKTFGIMCRSRWDEWNIEVCQISPLLADGIAASYAEPTGLFFNELDALAAEFGPAVPSPPRVSPVPPSASGAGTSLPRTACTPPTGGEWLRPESPLPQQAPTLVVDVPDGVLYDVPMVVLDLDGRPLAHSLPSSVADNAALRAFLTSCSRPLPPALLSPPLPLPPLAAKAVGVVPKRSERIAAKMALEALEGPIHAVSRAQRNLMRKLGLVPERGPVTAEAVAAYNALFSKPLSQEHIIALSSLFSSSLPPAKAAEELVETIMDVIPSRTILEMLGLDFDYSFLPAVGRSGGVLLAWRTTVWSVSDVHLAEFSLTALVRHSSDVAPWWLSVVYGPQEEPDKLRFLDELRSLRSSRTGPWAVVGDFNLILEAQDKNNLNLNRRMMGRFRRLVDELELRELPLHGRRFTWSNERESPTLVKLDRVLFSADWEELFPSCLLQAASSIASDHCALLLHTCVTSPKALRFRFEAFWPKFDGFLQVVQDAWHPPANLPPLAALAWCFSTTAKRLQSWSDRHIGSVRLQLQMAKELVFRLDVAQESRSLSSLETWLRRDLKLKCLGLASLERTIARQRSRLVWLKEGDANTKFFHLHARARRRKNFITRLCDGDQLAVSHDALQELASSHFCAILGTSVERELALDLHSLGLRPAQLEGLDCPFTEDEVWAVIKSLPSDKAPGPDDFTGRFYKSCWPVIKVEILAALNSLFLTNGQGFASLNDALISLLPKKDEAVDVKDFRPISLIHSFGKLFSKILASRLSPRLDELVAPNQSAFIKGRSLHDNFRYVQLAARALHAKRVPRLLLKVDIAKAFDTVSWPFLLEVLAQLGFSQRWRDWISLILSASSSRVLVNGVPGPRFPHRRGLRQGDPLSPMLFILVMDVLNAMLRKASDSGGFLPLNDHAIRHRASLYADDLVLFLSPVRQDLEFIQGILSVFGAASGLRTNFTKCSITPIRCSVLDLELVQSSFPCSISEFPCTYLGIPLSVRKLPKAALQPLVDKVSHRLPPWKGRLTTLAGRSVLVQSVLSSIPVHVSMAIGLPSWVIKAIDKKRRAFLWTGTDSANGGQCRVSWTRVCRPRDLGGLGIPDLRVAGFALRVRWLWLQRSGHPYWSDLKAPVERSVSDMFTTSTFSILGDGQSTLFWTDRWIDGRSIASIAPDLLHVVPPRFRGSHTVAAGLANNSWVGDIRGALTVPVISQFLLVWDAVVPTQLSPGVEDHLVWCWTGDQCYSAQSAYQAFFLGQHSFACADLLWHAKGPAKCKFFLWFAFQQRCWTADLLQKCGIDSHSACPFCAQELETANHILIDCVFARQVWLRVLSPPGWAALSPPHGSWLQDWWSSSRLWKERNSRVFDSALASVAVVLESFRSEGQLWSLAGVACFGDFLGV

SEQ ID NO: 8954 - protein, 395 aa, Arabidopsis thaliana
  misc_feature (319)..(319): Xaa can be any naturally occurring amino acid
  misc_feature (325)..(325): Xaa can be any naturally occurring amino acid
  misc_feature (327)..(327): Xaa can be any naturally occurring amino acid
  misc_feature (330)..(332): Xaa can be any naturally occurring amino acid
  unsure (1)..(395): unsure at all Xaa locations
FGKARRALRALKGLVKLQALVRGHNVRKQAKMTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTXERDRAXLXKKXXXYPVPPPAEYEDNNSLRSPSFKSVAGSHFGGMLEQQSNYSSCCTESNGVEISPASTSDFRNWLR

SEQ ID NO: 8955 - protein, 473 aa, Thermotoga maritima MSB8
MMYPMPSWVYDSVVYQIFPDRFFIGKGKTVEDKKDLYLKRGGVIEKWGVPPRKLPGAQHVKIFYGGDLWGIAEKVDYFEELGINVLYLTPIFLSDTNHKYDTIDYFRVDPQFGGKRAFLHLLRVLHERSMKLILDGVFNHVGSQHPWFKKAKKNDPEYVNRFFLYKDRHRSWFDVGSLPELNVEVEEVKEYILKVVEHYLKLGIDGWRLDCGHDLGPTVNLWINMKVKEFSAEKYLVSEIWTYPAGWDMVDGLMNYNFRNLVLSYVNGETDSIGFHLERAYRETKNIFGCWNMLDSHDTPRLATMVPDRDLRKLAVVLQFTYPGVPLVYYGTEIGLTGGEDPECRATMEWNREKWDVDLFEFYKKMIRLRRTDPGLRFGEFVLLNDSPLAFLRKAPHPLQNTIVVVNPGEEKVLVLSIPDGKIMNTTPLVDVFSGERFHVDGGVVKLPLLARSFRILKPEDLRVGKYRLYKRV

SEQ ID NO: 8956 - protein, 554 aa, Synechocystis sp. PCC 6803
MNLAWLQGLSLGLLSPPAPALLIFRSFTMAKVLVSDSIDQVGIDILKQVAQVDVKTGLSEAEIIDIVPEYDAIMLRSATKVTEKIIQAGSQLKIIGRAGVGVDNIDVPAATRQGIVVVNSPEGNTIAAAEHALAMMMALARHIPDANKSVKESKWERKQFIGTEVYKKTLGVVGLGKIGSHVAGVAKAMGMKLLAYDPFISQERADQIGCTLVDLDLLFSEADFITLHIPKTPETANLINAETLAKMKPTARIINCSRGGIIDEEALVTAIETAQIGGAALDVFAQEPLGESRLREFSNVILTPHLGASTEEAQVNVAVDVAEQIRDVLLGLPARSAVNIPGLTPDVMEKLRPYLKLAETLGTLVGQLAGGRIDRLTVCLQGDLAEYTNSQPLVVAAIKGLLSQALRERVNYVNAAIEAKERGIRVIETKDASVRDYSGSLHLKATGTMGEHSATGALLSNGEIRITDVDEFPINVPPNNYMLFTLHRDMPGIIGKIGSLLGSFNVNIASMQVGRKIVRGDAIMALSLDDPLPDGLLSEITKVAGIRDAYTVKL

SEQ ID NO: 8957 - protein, 296 aa, Staphylococcus epidermidis RP62A
MEYKDIATPSRTRALLDQYGFNFKKSLGQNFLIDVNIINKIIEASHIDCTTGVIEVGPGMGSLTEQLAKNAKKVMAFEIDQRLIPVLKDTLSPYDNVTIINEDILKADIAKAVDTHLQDCDKIMVVANLPYYITTPILLNLMQQDVPIDGFVVMMQKEVGERLNAQVGTKAYGSLSIVAQYYTETSKVLTVPKTVFMPPPNVDSIVVKLMQRQEPLVQVDDEEGFFKLAKAAFAQRRKTINNNYQNFFKDGKKNKETIRQWLESAGIDPKRRGETLTIQDFATLYEQKKKFSELTN

SEQ ID NO: 8958 - protein, 159 aa, Zea mays
  misc_feature (74)..(74): Xaa can be any naturally occurring amino acid
  unsure (1)..(159): unsure at all Xaa locations
ASASAQSGCTTTLISLYPCLNYISGNVSTPPPSCCSQLASVVQTSPQCLCAALSSDSSSLGGVTIDRTRALQAXLPQACSVKTPPASKCNSVGGGSAPGAATPAAPSSGVPATAAAGTGSGSKATPTAPFLTSGGASVRGAVSLALAFAAVTVYAISAM

SEQ ID NO: 8959 - protein, 340 aa, Campylobacter lari RM2100
MGYVSVEQAIKELQDGKMLIMVDAEDRENEGDLIFPAQFSSKEKVNFTITHARGVVCVALSENLAKKFELPLMVPKNTSNHETAFTITVDAKNATTGVSAYERDMTIQIFADDNAKASDFVRPGHINPLIAKKGGVLERTGHTEGTVDLCRLAGLKEACVICEIVKDNGDMARRDDLLEFCKKHDINMITISDLIEYRLKNESLISLIKEEDSILAGFKAKKMIFKDHNANEHIAFSFGALKECENVKFYLSGSDFELLTSNKFNELLKQIEFLSQKGGVIIFMKNEKQENTQFKNYGIGAQILRYLKISKIKLLSQNTDKEFIGLKGFGLDITSSDFKA

SEQ ID NO: 8960 - protein, 565 aa, Glycine max
MGKNQKTGVGRALVKQHNQQSKENGRLQKKNVLESFTEISDIDAIIEQAEHPQQPLFSIPQRPINLDLSSSIGKNEMTLEEMRKQQTREEALHASSYVGPPPPPWRAYMSVEELDDNERQAFLIWRRRLARLEENENLVLTPFEKNLDIWRQLWRVVERSDLLVMVVDSRDPLFYRCPDLEAYAREVDDHKRTLLLVNKADLLPASVREKWVEYFCAHNILYIFWSAKAASAAVEGKMLRSPLEADDSGKNNNPDTKIYDRDELLARMQSEAEEIVEMRRNSSSDTGPSNIQSSGENVGGSSSSNNVIVGFVGYPNVGKSSTINALVGKKRTGVTSTPGKTKHFQTLIISDQLTLCDCPGLVFPSFSSSRYKMIACGVLPIDRMTEHREAVQVVADKVPRQVIEEIYKISLPKPKPYEPQSRPPLASELLRAYCASRGYVTASGLPDETRAARQILKDYIDGKLPHHEMPPGMSNVEPDPVNLHGSVSYGTEDVDSKVAPDFEQVLDDLNSFDLANGLVSNEVTIKKSDASHNHHKKPQGKKDRSQRTENNDADGMPVVKFLRNH

SEQ ID NO: 8961 - protein, 148 aa, Glycine max
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIRGDFAIDIGRNIIHGSDSVESANKECALWFPDGPVNWQSSLHSWIYE

SEQ ID NO: 8962 - protein, 317 aa, Haloquadratum walsbyi
MTSTPEQLAGVADIDCTGMQALVTGSTSGIGRAAAIALGRLGADVIVHGRDATAGADVVDTVTAYGADAEFIAADFADVSAVRELAATVQSTTDGIDLLYNNAGGVFRDGQLTDCGVEYTFHVNHLAPYLLTTELLDHLNTDARVVTTASAAHQGASLDINRTRTVDDHSAFWAYNHSKLANILFTTELAKRVDVSKYTATAVCVHPGAIPGSGFTRFLPGPLPRIIQSLEAVPGVTTVNDGAAELLFAGISSQATDYSGQYLASQQLKKPSSDARDEASSRRLWQESASILDITEPLNNLPDNQQSNSGVDIDVTG

SEQ ID NO: 8963 - protein, 341 aa, Salmonella enterica subsp. enterica serovar Typhi
MKALSKLKAEEGIWMTDVPEPEVGHNDLLIKIRKTAICGTDVHIYNWDEWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSVDDFQKGFDAMCSGQSGKVILSWD

SEQ ID NO: 8964 - protein, 152 aa, Brassica napus
MAMIGLLEVFVAFLFFLVFKHFFFHKKSPGQPILKSWPVLGMLPGMLPHIPRIFDWTFEVLEATNLTFFFKGPWFSGTDMLFTADPRNIHHILSLNFGNYPKGPEFKKIFDVLGDGILSADLELWEDLRKSNHAIFHHPDFLKLSASSNTIK

SEQ ID NO: 8965 - protein, 434 aa, Thermoplasma volcanium GSS1
MDEISSMLDYLGIKSTEELFSDIPLSVRKKEIGIGSPLDEHLVLERARKYASLNSTEMLNFLGNGIYDRVIPEAVNYIISKSEFLDSYTPYQPEVSQGMLQSIFEYQSLISDLFKMDFTNASMYDGYSALGEAARMAYRINGKNKILIPESTYDSKLSVLKNYVWGLSMKIEKYKMNEEGKIDIDDLQSRIDGDTSAVVVENPNGYGVIDENVFRISEIKKESLLISYVDPISLGVLKPPGEYGSDIAIAEGQQLGIPMNFGGPLLGIMSFKADYVRKSPGRLIGESVDADGKRAFVMTLQTREQHIRRAKATSNICSNQALLTLAAGSYLSILGSSGLKKVALLTIKHSKNLAESLGNIGIEKVFDSISFSDTLFRIDKNVMLDLAKKGILGGIKLTSLIKDSKYSSGTFFTATEKTDNEKIKALVNALEVIM

SEQ ID NO: 8966 - protein, 556 aa, Thermotoga maritima MSB8
MKVVKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 8967 - protein, 394 aa, Lactobacillus johnsonii
MPKLSNDLSLTKNTRLNSLGPSKIRAFDEKASQIPGIIKLTIGEPDLNTPDHVKDAAIADIKANDSHYAPQAGKPELLEAISNYLDRSLDVKYDPKTEICVTVGATGALNDVFMSILNPGDKILVPTPVWALYFQLIKLTGAIPVQIDTSKDDFILTPEHLETVLQNEGKGAKAIILTDPSNPTGRVYPAATLKALAEVITKYHLFSVTDEIYGELVYDNNVHHSLSQYIPERNILISGLSKAYAMTGWRLGYIAAPADIMKTIQKVNAFLVTSVTDNVQAAAIEALNNGQADPLEARKIYEDRLEFMKTGLEKLGFEMSTPQGAFYIFAKIPDTFGTDDEAFANELATKAKVGVTPGRYFGKGGQGYVRMSYASSTEQLQEALKRIAKFVENI

SEQ ID NO: 8968 - protein, 139 aa, Agaricus bisporus
MSGKGKAGKSGGKAGSETKSMSRSSKAGLQFPVGRVHRLLKKGNYAQRVGAGAPVYMAAVLEYLAAEILELAGNAARDNKKQRIVPRHLQLAIRNDEELHKLLGNVVISQGGVVPHIAPELLPSKSSKGKKDEGVSQEL

SEQ ID NO: 8969 - protein, 235 aa, Zea mays
  misc_feature (208)..(208): Xaa can be any naturally occurring amino acid
  unsure (1)..(235): unsure at all Xaa locations
MAAAESARVQEAQKLAKSDPRKAEAIYKDIISKAPSTTSDAATREYETALVSLGEIYRDEKKTQELVNLVKESRTVFSSFAKAKSAKLVRQLLDLIKEIPDSTDIEISVTKDCIEWATAERRAFQRQDLEVRLVALQMAKQSYYEALGLINNLLRELKRLDDKLRLVEVQLLESRVYHALGNIPKARAALTSARTSAASVYTPPMLQXNLDMQSGMLHAEDKDFNTAFSYFIEAL

SEQ ID NO: 8970 - protein, 429 aa, Sulfolobus solfataricus P2
MNVEKELREKGVEILRFTWVGLDGYIRSKGAYIDHVDELLKTGIGLTMAMMSFTPMDYISPYGTFGPQDEDVFLTPDLNTLSVFPPSAIVICNLYKHGNPWNYDPRSILIKTIEKAKEQYDFDFKSAFEIEFYLTKDKKPLDDARCFDPSAFYNNQIIPEIAKTLRQINIEPIRIIKEYGPGQYEFDIMHKDALRSADEVVIFKEVARQVASKHGVEANFMPKPFNKLAGSGLHLNISLWKDNQNLFYSHNDKYGLSDLAYNFIAGLLEHAKALTAIASPTINSYKRLVPGSWAPTKITYGYNNKSAMIRIPTPYPGMSQLDRRIEYRVPDPSTNPYLLLTAVIEAGLDGIERGLKPPEAVNENAYYRKDIDDIPRNLREALNELRKDTKLVERIGKEIIGEFIKVKLAEVEEYESLVTDWEYEVYRRL

SEQ ID NO: 8971 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIKIIGFDNTRQVQCISFIAYKPPSFTEA

SEQ ID NO: 8972 - protein, 519 aa, Zea mays
MLGVGMAAAVLLGAVALVLADAAARRAHWWYREAAEAVLVGAVALVVVDAAARRAHGWYREAALGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 8973 - protein, 410 aa, Sinorhizobium meliloti
MTINATVKEAGFQPASRISSIGVSEILKIGARAAAMKREGKPVIILGAGEPDFDTPEHVKQAASDAIHRGETKYTALDGTPELKKAIREKFQRENGLAYELDEITVATGAKQILFNAMMASLDPGDEVIIPTPYWTSYSDIVHICEGKPVLIACDASSGFRLTAEKLEAAITPRTRWVLLNSPSNPSGAAYSAADYRPLLEVLLRHPHVWLLVDDMYEHIVYDGFRFVTPAQLEPGLKNRTLTVNGVSKAYAMTGWRIGYAGGPRELIKAMAVVQSQATSCPSSISQAASVAALNGPQDFLKERTESFQRRRDLVVNGLNAIDGLDCRVPEGAFYTFSGCAGVLGKVTPSGKRIKTDTDFCAYLLEDAHVAVVPGSAFGLSPFFRISYATSEAELKEALERIAAACDRLS

SEQ ID NO: 8974 - protein, 588 aa, Thermus sp. YBJ-1
MRKEAIHHRSTDHFAYAYDSETLHLRLQTKKHDVDHVELLFGDPYEWHDGAWQFQTMPMRKTGSDGLFDYWLAEVKPPYRRLRYGFVLRAGGEQLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYPFTDGALRFFAKEEISARQFADIMVRLLHSYPKHVNEAAFNLLGSHDTPRLLTVCGGDVRKAKLLFLFQLTFTGSPCIYYGDEIGMTGGNDPECRKCMVWDPEKQNKELYEHVKQLIALRKQYRALRRGDVAFLAADDEANHLVYEKTDGNETVMIIINRSNEAAEIPMPIDARGKWLVNLLTGERFAAEAETLCVSLPPYGFVLYAVESW

SEQ ID NO: 8975 - protein, 246 aa, Bifidobacterium adolescentis
MTYKLVLLRHGQSAWNKTNQFTGWVDVPLTEQGVEEAKNGGRLLKEKNVLPDIVFTSMLRRAINTANVALDEADRLWIPVKRSWRLNERHYGALQGKNKTEIRQEYGDEKFMLWRRSYATPPPEIDPNDEYAQNNDPRYTGDPVPEAECLADVVKRVEPYFKSDIEPELKAGKTVLIAAHGNSLRAIVKMLDNLSEEEIAKVNIPTAMPLLYELDENFKPIKPRGEYLDPEAAAAGAAAVAAQGQK

SEQ ID NO: 8976 - protein, 473 aa, Oryza sativa
MCCGVHLRQDAPLEAVNGGGRRTMTIATDAQIRQLSRGRPWPAAGGGPPPRLNKSGSSAAGGRGHAHRRRRRPSRHSSAGRSPRASYRVCQRQQGRRARSLELAPAAVGVAAPNLPHALAQPPAAWDTELGEARAERVAVYSGSVVGGSPEAEQDSTLAQSPVTQRPRPLPSKEPPHKLGRGSRDKVQQFMTITGASEKVALQALKASDWHLEGAFDFFYSQPQISLTNSRHLEDLYNRYKEPDVDMIMVEGVSQFCTDLQVDPQDIVMLVISWHMKAATMCEFTRQEFIGGLQSIGVDSIEKLREKLPSLRAEIKDDHKFREIYNFAFAWAREKGQKSLALETALGMWQLLFAERHWPLIDHWCQFLQACRVKGCGALHLQSCTATTLTAGNRREDEANRRKPGRCRRADETTDALGAVAPKDIVRRRGHMPPRSDGPEPSELLLLCCLYSAMEYNGRHCMGAGLPDAEVSE

SEQ ID NO: 8977 - protein, 127 aa, Brassica napus
IVARFETRSGGSVNWEEFPEKVAVQMNDTHPTLCIPELMRILMDLKGLSWEDAWKITQRTVAYTNHTVLPEALEKWSLELMEKLLPRHVEIIEKIDEELVGTIVSEYGTADPDLLKEKLNAMRILEN

SEQ ID NO: 8978 - protein, 507 aa, Salmonella enterica subsp. enterica serovar Typhi
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 8979 - protein, 479 aa, Wigglesworthia glossinidia endosymbiont of Glossina brevipalpis
MHRIIRRTKIVATLGPSTDLNNNLEKMILAGANMVRMNFSHGNFYDHARRTKQVRNISHKLGKNIAILGDLQGPKIRISTFMTGKVFLSPGDQFILDASLSKDLGTVESVGIDYKYLPKDVFPGDVLLLDDGRIQLKVKKIVNKKIFTTVYIGGYLYNNKGINKLGGGLSANSLTEKDKKDIICAAKIGIDYLAVSFPRTGKDLKYARNLLNNVESHAKIISKIERAEAVANNDIIDEIITESDAIMVARGDLGIEIGDPELVGVQKKLIQRARDLNRAVITATQMMESMVYNPMPTRAEVMDVANAVLDGTDAVMLSAETAIGKYPVETVESMSNVCIGAEKISNINSLKNRLNIKFKTVEESMAVSAMYIANHLNMIKAIISLTESGKTPLIMSRISSGLPIFALSKHEHTLNLTALYRGVTPVYFKNNEKGISAADSAINLLKEKKFLFSGDFVVITQGDVMGTIGKTNTSRILIV

SEQ ID NO: 8980 - protein, 533 aa, Oryza sativa
MGGRGALPVVAGVVLVLLVVAARGASAAGGGGGGGAAAAAVNGDRLRAEQIRKQAKDAAASAAALAAASRRLHLDRARHLRLLSSLHRNLTATLRDLSAAASASASASASEAGYASAGDEVRRLDLQAKDLIRAARAAIADAKPLFDPQLKIQRLKDAIFAQNELLARAKKRGAFASLIAAKSIPKPLHCLAVRLTAERIARPENYADPVPPPHALEDPAMFHYAIFSDNVLAASVVVRSAVANSLDPSKHVFHVVTDRMNLGAMQVIIRLMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKEKFNPNACGWAYGMNFFDLDSWRREKSTEQYHYWQSQNENRTLWKLGTLPPGLITFYSTTKPLEKSWHVLGLGYNPSISMEEIRNAAVVHFNGNMKPWLDIGMNQFRHLWTKYVDYDDSFIRQCNFAPP

SEQ ID NO: 8981 - protein, 160 aa, Triticum aestivum
KPGKNPYTPPPPHHGLPSSTLGKSTMRHARITAAVAVAFAVLAVTAAASTGATAAGRGKQQRAPGPASGSIVYIVMVKPPAVAADSAAYHMGILIAAVGSKEKADAALVYSYKSAISGFAARLTPAQVAVLRKNPAVIRAQPDVKYSLHDDKNNNNNNLN

SEQ ID NO: 8982 - protein, 394 aa, Synechococcus sp. PCC 7002
MTRIETRTEPMVINMGPHHPSMHGVLRLIVTLDGEDVVDCEPVIGYLHRGMEKIAENRTNVMYVPYVSRWDYAAGMFNEAITVNAPEKLADIEVPKRAQYIRVIMLELNRIANHLLWLGPFLADVGAQTPFFYIFREREMIYDLWEAATGMRLINNNYFRIGGVAVDLPYGWNDKCLDFCDYFDPKVDEYEKLITNNPIFRRRVEGVGTITRDEAINWSLSGPMLRASGVKWDLRKVDHYECYDDFDWDVQWETAGDCFARYLVRIREMRESVKIIRQALKGMPGGAYENLEAKRMLEGKKSEWNDFDYQYIAKKVAPTFKIPDGEHYVRLESGKGEVGIFIQGNNNVFPWRWKIRSADFNNLQILPHLLKGVKVADIMAILGSIDVIMGSVDR

SEQ ID NO: 8983 - protein, 333 aa, Bradyrhizobium japonicum USDA 110
MADVKYDVLGIGNALFDVLVRTDEAFLAKHGMTKGSMSLIDEARAAAIYQDMGPATEVSGGSAANTIVGIGSLGARAAYVGKVKDDQIGKLYVHDIRAAGVAFNTPAAKDGPATGCSYILVTGDGERTMNTYLGAAQDLSPADIDPAEIASAGIVYLEGYLWDPKNAKEAFVKAAKIAHDARRKVALTLSDSFCVDRYRDEFLSLMRNGTVDIVFANESELHSLYMTSDFDTALKQLRNDVNLGVVTRSEKGCMVVSAEDAVAAPAAPIAKLVDTTGAGDLFAAGFLYGLARNLPYKQCGELGALAAAEVIQHIGARPQVSLKELAEQRGLTA

SEQ ID NO: 8984 - protein, 738 aa, Erythrobacter sp. NAP1
MGRWLAIWNILFVMLFLGGAAPSHAQSVPTSYSAANTPHFAPFAADLRSPIGRDLQTRNKVRSAIWAASQHTGVDYRYLLAKAQIESGLNPDAKARGSTATGLYQFIETTWLVSLDRYEAQLFTSLPIRGTNGQAGLSRRAKLALRDDPRMSAMMAAAYTLENGRALRSVLGREAVSRELYLAHFLGTGGAKRFLSAWLRNPHASAASLFPRAARSNRPIFSDRRGQMRSLDQVLRYIDVKLMEASKLTMGKIEAGLAKLSDCQIIILVEGFKRVTEETAETCDGETPASYTAPRSIGRGTLAVSGDHIALPCHHIEMCYLSRMSTSTITQVRELVETGAYTKAGIARAAGLHANTLRDASEPDWNPTAETLAKLQRFLDANDDSPVLVGIEEIIDEARNGRMYILVDDEDRENEGDLIIPAQMATPAAINFMATHGRGLICLALDKGRVDQLGLDPMSRNNKESMQTAFTVSIEAKKGVTTGISAADRARTVSVAIDATKGADDIVTPGHVFPLMARDGGTLVRAGHTEAAVDISRLAGLNPSGVICEIMNEDGSMARLDDLVDFARKHSLKIGTIRDLIAYRMRNDHLVERIDERSFESDYGGQWRLITYTNKVSGGEAYVLQKGHVVPGEPTLARVHPISVFDDVLGQPGPRKRTLQRAMGAIGEHGSGVIVILTNRIGGDEWTRDEQDRNIGIGSQILADLGVHDMVLLSNTRPELVALDGYGLTITDHMPIPE

SEQ ID NO: 8985 - protein, 497 aa, Bradyrhizobium japonicum USDA 110
MTPTAAARAQHATATLRDRLKDPSLLKEACYIDGAWVGTPVFAVNNPATGVELAKVPQLGADDTTKAVEAAERAFPAWAKHTAKQRSNILRKWFELIIANREDLALILTSEQGKPLSEALGEVDIGAAYIEFFAEEARRVYGETIPTQRPDARLLAIKQPIGVCGAITPWNFPNSMITRKVSPALAAGCTVVLKPANETPLSALALAVLAEKAGIPKGVLNIITGDAPPIGKVLCEHPAVRFVGFTGSTAVGKILYQQASVGVKRLGLELGGNAPFVVFDDADIDAAVEGAIVSKYRNMGQTCVCANRLYAQDKIYDEFVQKLSKKVAVMKIGDGTEAGVTQGPLINLKAVDKVERHIADAVKRGAKVVTGGKRSELGRSFFEPTVLADVKPDSLVAQEETFGPLAPVIRFKDEADVIAMCNASPFGLASYFYSRDLGRVWRVAEALESGMVGVNTGLITTEVAPFGGVKESGLGREGSRHGMEEYVEIKYVMMAGV

SEQ ID NO: 8986 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATNPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 8987 - protein, 334 aa, Haemophilus somnus 2336
MTIKIGINGFGRIGRIVFRAAQTRDDIEVVGINDLIDVEYMAYMLKYDSTHGRFDGTVEVKDGNLVVNGKAIRVTSERDPANLKWNELGVDVAVEATGLFLDDATARKHITAGAKKVVLTGPSKDATPMFVNGVNFDAYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCSLTSVFDAAAGIALTDTFVKLVSWYDNETGYSNKVLDLVAHVHNYKG

SEQ ID NO: 8988 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCLRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 8989 - protein, 574 aa, Arabidopsis thaliana
MARFAVIGLTFLLLLGTSLSARSDEETRERFYGNVVNSTAPGNGEGSIAKMFDRVLEKEFSENDSPEGSDGASFNSSVADQQAEIETVAKVTHEKGKRNDTQENNGTRPFQLQDVFSLENEDSDDMTLIDKKNNVFVMSNKKSKYPILQVDLRLISDLVVIIVFAAIGGIVFSCLGQPVIVGYLLAGSIIGPGGLKFISEMVQVETVAQFGVVFLLFALGLEFSMTKLKVVGPVAVLGGLLQIVLLMFLCGVTALVWPKISLCGARLSEGIFVGAFLSMSSTAVVVKFLVERNSTSSLHGQVTIGILIFQDCVVGLLFALLPVLGGNSGLLQGIISMGKLLLILSIYLTVASLLTWSFVPRFLKLMIQLSSQTNELYQLAAVAFCLLSAWCSDKLGLSLELGSFVAGVMLSTTEFAQHTLEQVEPIRNLFAALFLSSIGMLINVHFLWNHVDILLASVILVIVIKTAIAAVVVKAFRYNMRISFHVGVLLAQIGEFAFVLLSRASNLHVIEGKMYLLLLGTTALSLVTTPLLFKLIPSAMNLGVLLRWFPSENSSPNESLQEKASLIEVHNRTK

SEQ ID NO: 8990 - protein, 472 aa, Yersinia pestis KIM
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 8991 - protein, 270 aa, Prochlorococcus marinus str. MIT 9312
MTDKIAIIGFGNIANAIITPLFDKNLIQPERVYCVVNSEKSLENIKKNYKYNINVYKSGSKESEIIWDCQFKLLSIKPQHLKDITEGDIIKNKNNLLVSILAGVSINKLHQKFPNHKCVRVVTNIPITVGKGLTGIAWGENLTEDQKEFTKKLFENTSKIYEFTEEYLDIFLALTSSGPAIIALIIESLSDGGLSGGLPKILSEELVMEMIIGTISLIKEKKLTTSELKNLVTSPGGTTISALRVLEKKGVRSALIESIVSASNRSKEFS

SEQ ID NO: 8992 - protein, 438 aa, Bacillus thuringiensis serovar konkukian str. 97-27
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 8993 - protein, 237 aa, Thermoplasma volcanium GSS1
MSYSKRLGQVFLRSRRIAEYEVDLLNGHPGDSVLEIGPGHGILTSILLDRGYYVTAVEKDRFVYNELLSIKNKNLNLFNMDFLDMPPQKYDFIIGNIPYYISSDVIFKLYDFEFSASVIMVQKEFADKLTNVKDSSRLYVNAYVRYEIDLKRYVGRKNFNPQPKVDSAILLLKKKKINLDIPLDYLDSKLKVMFSKKRKMISNIFEIYPESMGNRRPSDLTASEILDLVRLLHAHGL

SEQ ID NO: 8994 - protein, 165 aa, Brassica oleracea
FTPISTITDGTSFYGLDIVGISVGGQKLAIPQTVFSTPGALIDSGTVISRLPPKAYAALRGAFKAKMSQYKNTSAVSILDTCFDLTGFKTVTIPTVSFYFNGGAVVELGSKGVLYAFKMSQVCLAFAGNSDDNNAAIFGNVQQQTLEVVYDGAAGRVGFAPNGCS

SEQ ID NO: 8995 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCKRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 8996 - protein, 430 aa, Methanopyrus kandleri AV19
MGYEDEFPESLELFKRAERVMPGGVSSPVRRFDPYPFYVERAEGSRLYTVDGHVLIDYCLAFGPLILGHAHPEVVEAVVERVREGFHYGTPTLPELKLAEKVVELVPNVEKVRLVNTGTEATMSAIRLARAYTGREKIVKFEGCYHGAHDAVLVRAGSGASELGAPDSPGIPESVAENTLVCPFNDVEAFVETVERFDEEIGAVIVEPVLGNAGCVPPDEEFLKVLREYCDGTERLLIFDEVITGFRLELGGAQEYYGIDADLVCLGKILGGGLPIGAFGGPEEYMSRVAPEGKVYQAGTFNGNPVSATAGLVTLEVLERERPYDELSSKAERLASALEDGLEDRGIEGVVNRVESMFQVYFGIEEVRDYADVNSADHDAFKRFHRELLEHGVWIAASNYEAWFLSIAHTETDLERTEEAFEEALDRLTG

SEQ ID NO: 8997 - protein, 416 aa, Zea mays
RLYPSTSAPSFPSPHAPRERSFRIPHRIGRVPLTEKIGLGGASVLSVVRSDAKEGTTTGVSAKDRTNTILALASPNSKPEDFNSPGHIFPLKYREGGVLKRAGHTEASVDLAMLAGLPPVAVLCEIVVDDDGFMVLLPKLQQFAKRENLKIISIADLIRYRRKRVLWSLDRGVAHGDGHAVNEDDVTKFGVVPGDGRANVQDVVTKLAGDGAHGDRDAGCQDGVTKVACGATHRDGDVGCQDGVMKVTCGAVHGDGDAGCQDDTTKLAAEAIGSDRNPRGIGLGHKLQAYNLQDDGRDTVEANLELGLPADSREYGIGAQILRHLGARTMRLMTNNPAKYTGLKGYGLSVLGRVPLLTPITTENRRYMETKRLKMGHVYGSRSSNHANGSGLAGAGEREEQDQNDSAGVQERTPEA

SEQ ID NO: 8998 - protein, 262 aa, Rickettsia typhi str. Wilmington
MNIGKFKLIVFDEIDSTSSEAMRIAKHNKVYADYAIFAKSQTSGRGRSGKNWQSRSGNLHVSLLIRPEKELELLPQLSFVTALAVYNTILSCVLCVGSNQLINNFNAMSVCAQNYSIQLKWPNDVLMNGRKIAGILLESVKVDNNYYLIIGIGINITYHPENIDQPTTSLITENIIHVVPQALLKILIQNFEKYYQIWQNNGFSFIRKKWIEHAYKLYENINIKYQNGIVTGLFKDIDNTGRIILQLNSQKIISFSTVEFYF

SEQ ID NO: 8999 - protein, 408 aa, Campylobacter lari RM2100
MQISTKLKPYYENISFEREDGVMIVNLGPQHPSAHGNLRLILELDGEEITKAAPCIGYMHRGMEKMAENMIYQEFIPTTDRMDYIAASANNYAYVAAVEKLCGLEIPRRASVIRMILLELNRIASHLLWLATHALDIGAMTVFLYCFREREYVLDLIEKYCGARLTHSSMRIGGVMLDLPDGFLDELLAFCKKFPNDIKDYEALLDDNRIWRARTENVGVVSKEQALSWGCSGVMLRGSGIAYDIRKEEPYLLYDEVDFGVPVAKMGDSYARYKVYMQEFRESLKILTQCAKLYQDTPPEILCNHPEYVSASKEQIMTQNYSLMQHFVLVTQGLKPPKGEVYVPTESPKGELGFFIHSDGSGRPYRLRARTPSFFHCAFLEEMLVGSYLADAVAILGSINIVLGEIDR

SEQ ID NO: 9000 - protein, 232 aa, Candidatus Protochlamydia amoebophila UWE25
MTQTNDSPSIKAKKAAALKAVEFVQDQMIIGLGTGSTIAYFIEALGKRCQAGLKITAIASSERSMRQARLVGIPIVDSDTILELDLTIDGADEIDPLKQMIKGGGGALLREKLIASASKEMIVVIDETKLVNKLGKFPVATEISIFTFRHIVKKLKDHGYCGSLRVNQDQSLYRTDNGNYIFDICFPEPIDNPIFEHNRLKSFAGVLETGLFFNLAGRVIIGYQNGMTKIVA

SEQ ID NO: 9001 - protein, 119 aa, Prunus salicina
TMPSNCNGSQFNESKLYPHLRSKLKRSWPDVESGNDANFWGREWNKHGKCSEQTLNLMQYFQRSHEMWYSFNITGILKNASIVPSPNQTWTYTDIVSALKTRTKRTPLLRCKAKSQPKN

SEQ ID NO: 9002 - protein, 437 aa, Thermotoga maritima
MNYPYIPHTDEDVRAMLDFIGVSSIEELFSSIPVSARSSLNIPESRDEFSVFKQLKEISEMNNSLEDYAVFLGAGVYKRYVPTVVYDLAMKPDFLTAYTPYQAEVSQGTLQALFEYQTMVCELTGMEVANASMYDGATALAEAALMSFRLTGKEKVVVARSVHPEYRAVLRTYLEKRGFTVVEAGYDETGRVLLEEVDEETAAIAVQYPNFFGIIEDLDYVRSRSGNALLIVVVEPVSLALLEPPGSYGADIVVGEGQSLGLPMWFGGYSLGIFATREEYVRQMPGRLIGQTVDQAGNTAYTMILQTREQHIRRARATSNICSNHAHAALIAAVYMSVMGPDGLKEVARRSYNAAHYLQERLEEIGFKLCFSGEFFNEFVFNVPEDYPDRWRKMMEKKILGPLPLEEFYPELGDTALACATEVISKEDIEKLLEAMK

SEQ ID NO: 9003 - protein, 474 aa, Thermotoga maritima
MTIFERSKKGRKAFRLPESDIPEYSLPDRFLRRTPPELPEVSEPDLVRHYTNLARKNYSVDLGIYPLGSCTMKYNPKLNEKAANLEGFREIHPYQPVETVQGSLRLMYELKKMLCEITGMDDMTLQPAAGAHGELTGMLIVREYFKNRGDTGRKKVLVPDSAHGTNPASASMVGFEVVEIKSKNGMVDVEDLKKLLDEEVAAVMLTNPNTLGLFEKDILKIAEMTHECGALLYYDGANLNAIMGKVRPGDMGFDIVHLNLHKTFSTPHGMGGPGSGPVGVKKHLVDFLPFPQVKKNGELYELFVPEKTIGRVRSFFGNFPVLVKAYTYILTMGRDGLERVSEMAVLNANYLKKKIEKFLEIPYNGFCMHEFVASAEKVFRETGVRTLDIAKRILDFGVHPPTVYFPLIVPEALMIEPTETENKETLDKYAEILERVVKEAYENPDALKNAPHNTPVRRVNEVLASKKPVFRWRG

SEQ ID NO: 9004 - protein, 285 aa, Amborella trichopoda
GVSRSVLEMNGEVVERAEPHIGSLHRGTEKLIEYKTYLQALPYFDRSDYVSTMAQEHAHSSAVERLLNCEVPLRAQYIRVSFREITRISNHSLASTTHAMDVGASTPSLWASEEREKLLEFYERVPGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 9005 - protein, 91 aa, Brassica napus
MGKVSLLLNFLISHAAKQESMENFDRNGASGSGFKMPLHYPKYTKDDYEKMEEWRLDLLLSDYGLIAFHDTSTLHEKRAIAIETFLWPNAY

SEQ ID NO: 9006 - protein, 158 aa, Triticum aestivum
  misc_feature (40)..(40): Xaa can be any naturally occurring amino acid
  misc_feature (117)..(117): Xaa can be any naturally occurring amino acid
  misc_feature (123)..(123): Xaa can be any naturally occurring amino acid
  misc_feature (130)..(130): Xaa can be any naturally occurring amino acid
  misc_feature (136)..(136): Xaa can be any naturally occurring amino acid
  unsure (1)..(158): unsure at all Xaa locations
MAPTVMASSATSVAPFQGLKSTAGLPISRRSSSAGLSSVXNGGRIRCMQVWPIEGIKKFETLSYLPPLSTEALLKQVDYLIRSKWVPCLEFSKVGFVFREHNSSPGYYDGRYWTMWXLPMFGXTDATQVXNEVEEXKKEYPDAMSAYGLTTAQVSGYA

SEQ ID NO: 9007 - protein, 168 aa, Zea mays
  misc_feature (42)..(42): Xaa can be any naturally occurring amino acid
  misc_feature (72)..(72): Xaa can be any naturally occurring amino acid
  misc_feature (126)..(126): Xaa can be any naturally occurring amino acid
  misc_feature (144)..(144): Xaa can be any naturally occurring amino acid
  unsure (1)..(168): unsure at all Xaa locations
MGMSLVNITNVAVLDNSSTFINPGQFGVSSECLVSIDGHLKXKLLYVGSVEDDISGHQLESGLVGPDNVGPXRCVLQTDPPDPSKLCEEYIFGASELLLHCTYMGQEFMTVECYLGHYYADVLLRXSLQRKVVIFGVQRTLVAXTKPQITKFHISIHLEAEYVGRDPA

SEQ ID NO: 9008 - protein, 461 aa, Pseudomonas putida KT2440
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 9009 - protein, 215 aa, Prunus salicina
VVGFAFFLCFIMSTGSYVYFQFVQQWPPATCIRSNKPCTKHRPLPIFTIHGLWPSNYSNPRMPSNCRGSLFETRKLSPELQSKLKRAWPNVETDNDTKLWEHEWNKHGRCSEGTLNQTQYFQRSYSMWRSHNITEILRNASIVPNAKQTWKYSDIVSPIQTATKRTPVLRCKPDPAHPNISQLLHEVVFCYEYDALKQIDCNRTDCRNQVDIKFQ

SEQ ID NO: 9010 - protein, 323 aa, Clostridium thermocellum ATCC 27405
MFDVVAVGELLIDFLPAGTNENGMPLFSSNPGGAPANVLAMLSKLGAKTAFIGKVGKDGFGQFLKATLDNAGIDTSNLLMSSSEMTTLAFVHLNEKGDRSFSFYRKHCADVSLDAGELDKDLLRTCHFLHFGAVSLTDEPSRTATLEAARIAKEAGAIISYDPNYRPALWSNEHEARKYMLKAVEYADLVKVSEEELWLLAESEDFSKGAHKLLAMGPSVVFVTCGEKGSYVFTGSCKANHCGYDVKVVDTTGAGDAFVGAMLWQLRGMSLEEISQICEQKWGELLAFSNAAGTIVATKKGAIPAMPDLDTINTFMRQFLEEK

SEQ ID NO: 9011 - protein, 557 aa, Shigella flexneri
MLGYLLAGIAIGPWGLGFISDVDEILHFSELGVVFLMFIIGLELNPSKLWQLRRSIFGVGAAQVLLSAALLAGLLMLTDFAWQAAVVGGIGFAMSSTAMALQLMREKGMNRSESGQLGFSVLLFQDLAVIPALALVPLLAGSADEHFDWMKIGMKVLEFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMAPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 9012 - protein, 298 aa, Thermobifida fusca YX
MTRVVVVGDLMTDSIARAFYPLARGSDTPASVATFGGGSGANVAAWLAVEGTDTALIGRRGSDITGRTREMELMGYGIDARMVMDPERPTGTCVVMITHRGDRTMLSDPGANAALQPEDLPRDLFGPDGHLHLSGYTLLNEGSRRAGRVALRLAQESGMSISVDCGSHAPLERVGAEAFLEWTNGVRLLFANQEQAAVLTGRDDPDAAAKVLTAWYPNIVIKLGADGALWASKAREGTLHVPAEPVEPVPGAIGAGDAFIAGFLPAWLAGKHPKEALISAQRLAARALLQPGARPELD

SEQ ID NO: 9013 - protein, 279 aa, Bacillus thuringiensis serovar konkukian str. 97-27
MKNLQSKAVLNNGVEMPWFGLGVFKVEEGPELVEAIKTAIKAGYRSIDTAAIYGNEKAVGEGIRAGIEATGISREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 9014 - protein, 274 aa, Chlamydia trachomatis D/UW-3/CX
MFTDKETHRKPFPTWAHLLHSEPSKQFVFGNWKMNKTLTEAQTFLKSFISSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTTGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 9015 - protein, 440 aa, Streptomyces coelicolor A3(2)
MSTSHASPRETTEGTVYTVTGGDWDEVVQSAARADDERIVVNMGPQHPSTHGVLRLILEIDGETVTEARCGIGYLHTGIEKNLEYRTWTQGTTFVTRMDYLTPFFNEAAYCLGVEKLLGIDDQIPDRATIIRVLLMELNRLSSHLVAIATGGMELGATTIMIYGFRDRELILDIYELITGLRMNHAYIRPGGLAQDLPPGAVDQIREFVKKMNKNLPEYDKLATGNPIFKARMQDVGYLDLAGCMALGATGPVLRSTGLPHDLRKTQPYCGYETYDFDVPTADTCDSYGRFLIRLEEMRQSLRIVEQCLDRLQPGPVMVADKKIAWPAQLALGPDGLGNSLDHIKKIMGTSMEALIHHFKLVTEGFRVPPAQVYTAVESPKGELGVHVVSDGGTRPFRVHFRDPSFTNLQAMAAMCEGGQVADVIVAVASIDPVMGGVDR

SEQ ID NO: 9016 - protein, 195 aa, Triticum aestivum
MCKKREGGSSYQAIYLHSTAMAPTVMASSVTSVVPFQGLKSTAGLPVSRRSNGASLGSVSNGGRIRCMQVWPVEGVKKFETLSYLPPLSREALLKQVDYLIRSKWVPCLEFSKVGFIFREHNASPGYYDGRYWTMWKLPMFGCTDATQVINEVEEVNKEYPDAYVRIIGFDNMRQVQCVNFIAFKPPGCEESGKA

SEQ ID NO: 9017 - protein, 229 aa, Pediococcus pentosaceus ATCC 25745
MAKLVLIRHGQSQWNLSNQFTGWVDVDLSDEGVKQAQNAGKLIKEAGIEFDQAYTSVLTRAIKTLHYALEGSDQLWIPETKTWRLNERHYGALQGQNKAEAAEKWGDDQVHTWRRSYDVLPPLLDADDEGSAANDRRYANLDPRIIPGGENLKVTLERVIPFWEDEIAPKLIDGKNVIIAAHGNSLRALSKYIENISDEDIINLEMATGEPVVYDFNEKLEVQSKTKLN

SEQ ID NO: 9018 - protein, 137 aa, Zea mays
  misc_feature (11)..(13): Xaa can be any naturally occurring amino acid
  misc_feature (15)..(15): Xaa can be any naturally occurring amino acid
  misc_feature (20)..(20): Xaa can be any naturally occurring amino acid
  misc_feature (25)..(26): Xaa can be any naturally occurring amino acid
  misc_feature (28)..(32): Xaa can be any naturally occurring amino acid
  misc_feature (34)..(34): Xaa can be any naturally occurring amino acid
  misc_feature (36)..(37): Xaa can be any naturally occurring amino acid
  misc_feature (40)..(45): Xaa can be any naturally occurring amino acid
  misc_feature (47)..(47): Xaa can be any naturally occurring amino acid
  misc_feature (49)..(50): Xaa can be any naturally occurring amino acid
  misc_feature (53)..(58): Xaa can be any naturally occurring amino acid
  misc_feature (64)..(65): Xaa can be any naturally occurring amino acid
  misc_feature (69)..(69): Xaa can be any naturally occurring amino acid
  misc_feature (84)..(84): Xaa can be any naturally occurring amino acid
  misc_feature (86)..(86): Xaa can be any naturally occurring amino acid
  misc_feature (89)..(89): Xaa can be any naturally occurring amino acid
  misc_feature (95)..(95): Xaa can be any naturally occurring amino acid
  misc_feature (97)..(97): Xaa can be any naturally occurring amino acid
  misc_feature (123)..(123): Xaa can be any naturally occurring amino acid
  misc_feature (125)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(132): Xaa can be any naturally occurring amino acid
  misc_feature (134)..(134): Xaa can be any naturally occurring amino acid
  misc_feature (136)..(136): Xaa can be any naturally occurring amino acid
  unsure (1)..(137): unsure at all Xaa locations
MAKACLHADLXXXIXAADKXCGTIXXRXXXXXVXNXXSDXXXXXXLXFXXPVXXXXXXGVILFXXTLYXKSSDGTPFVDMLKSXGXLPXIKVDKXTXELAGTNGETTTQGLDGLGDRCKKYYXAXAXFXKXXAXLXI

SEQ ID NO: 9019 - protein, 527 aa, Parvularcula bermudensis HTCC2503
MKRVLISDKLSEDAVEVLKTRGIEVTFEPGLGKDPEKLKAALPGHHGIAIRSATKMTAEMIEAGTDLKVIGRAGIGVDNVDIDAATATGIAVMNTPFGNATTTAEHAIAMMLSLARQIPQANESTHQGKWEKSRFMGREITGKTLGLIGCGNIGSIVADRAQGLHMKVVAFDPFLTEARAIDLGVERVELDDLLKRADFITLHTPLTDQTRNILSKQALAKTKKGVRIINCARGGLVDEEALYDGLESGHIAGAALDVFEKEPATEHKLFGRDDVICTPHLGAATTEAQENVAIQIAEQIADYLLTGAVTNALNMPSVSAEEAPKLRPYIDLAGRLGGLAGQLAPGAVTGVEMAFAGTAASLNPAPMTAAALTAVLRPAMREAVNSVNAGQLAKQRGIQVSETRTETSPNFGSTVSVKLTTDKGELSVTGALFGGEPRAVRIGNVRLESNFAPHMLYVQNKDKPGFIGNLGKLLSSKDINIATFNLGRAAPGGTAYALLAVDQPLDDDTLKALSDLPQIDEARMLSF

SEQ ID NO: 9020 - protein, 283 aa, Aspergillus nidulans FGSC A4
MPALQSSKLAFIGGGNMASAIIGGLLSQGINKQNITVSEPWEVNRNKIADLGVKTTTSNVVAGGEADLVIIAVKPQVTKAVCEELADAWSKRETLPVVVSIAAGITLGSLQQWLKTSDGRTTHLVRVMPNTPALVGEGASGLFASADVTAEEKELVNALLGSVSKATEWVDKEELIDVVTGLSGSGPAYFFAMVEHLIASATALGLPAEQATRLAAQTCLGAGKMLTESSDSPTQLRKNVTSPNGTTHAALETFNAQHFDQVVDKAVKAATSRAAELGNTLGK

SEQ ID NO: 9021 - protein, 501 aa, Ehrlichia ruminantium str. Welgevonden
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLSNVSIATISGRYYSMDRDNRLDRTTKAYNSIAFGHGKRYEDPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 9022 - protein, 345 aa, Arabidopsis thaliana
MASSTGEKGLIVSFGEMLIDFVPTVSGVSLSESPGFLKAPGGAPANVAIAVSRLGGRAAFVGKLGDDDFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTENKTMDDKTAMSLWHPNLKLLLVTLGEKGCTYFTKKFHGSVETFHVDAVDTTGAGDSFVGALLQQIVDDQSVLEDEARLRKVLRFANACGAITTTKKGAIPALPTDIEALSFLKDQKKRQTNLKFSKWCCTASPC

SEQ ID NO: 9023 - protein, 1108 aa, Pseudomonas syringae pv. phaseolicola 1448A
MAKKPGDATFIKDPLWYKDAVIYQVHVKSFFDSNNDGIGDFAGLIEKLDYIAALGVNTIWLLPFYPSPRRDDGYDISEYRDVHSDYGTMADAKRFIAQAHKRGLRVISELVINHTSDQHPWFQKARHAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVDRDRRRVELLNSMLLSMPGTPTLYYGDEIGMGDNIYLGDRDGVRTPMQWSIDRNGGFSRADPASLVLPPIMDPMYGFQSVNVEIQERDPHSLLNWNRRMLAVRKQQKAFGRGTLKMLSPSNRRILAYTREYTAPDGHSEVVLCVANVSSAAQAAELELSAYAGTVPVEMLGGSAFPPIGQLSYLLTLPPYGFYWFLLASENQMPSWHVEPAQSMPDFPTLVLKKRLEELLEEPLRSTMEKTSLAVYLPKRRWFAGKGKDIEQVNIAYAVRFGDEAHPVLLSEIEVTADGQTDRYQLPFGLLAEDDISSALPQQLALARVRRNRDVGLITDAFTLETFIRAVILGMQSDTVIPCADGELRFEQSSQLAPLALTAESEVRYLSAEQSNSSAVVGGSLVLKLIRKVSAGTHPELEMGAFLTNAGFKNISPLLGSVVRVGNDGKPNLLMIAQGYLSNQGDAWEWTQNNLERAVRDELAHGVSGQEQHYNALLELADFSRSLGQRLGEMHQILASPTDNSDFAVEVTSSQDSKASGTSVNAQLERALQLLEQRKGDLEQDDQQLVSDLLAQRKQIRRRVEGLAKRSAGGLRIRVHGDLHLGQVLVVKGDAYLIDFEGEPARALEERRAKHSPFKDVSGVLRSFDYAAAMAVRSAQNVDTSPEAAGARKRVAETYLAQAREAFIEGYRSATSGMAHAWKDAKGEDAALELFTLEKAAYEVIYEAENRPAWLAVPLQGLRGLLQPSDGEPI

SEQ ID NO: 9024 - protein, 188 aa, Laurus nobilis
RAEPHIGSLHRGSEKLIEYKTTLQALPYSDRSDYVSTMAQEHAHSSAVERLLNCEVPLRAQYIRVLFREITRISNHSLASTTHAMDVGASTPFLWASEEREKLLEFHERVPGARMHASFIRPGGVAQDLPLGSCRDIDSSTQQFASRIDESEEMSTGNRIWKQRLVDIGTVTAQQAKDWGFSGVMLRG

SEQ ID NO: 9025 - protein, 297 aa, Methanopyrus kandleri AV19
MLDVVGLGALNVDELLYIPRMPERDDSVPVERRVRRGGGSAANTICWLAHLGREVGFVGKVGSDDAGDLLLREFEEYGVDTSRVVRGDGHSGTAFCLVSGDDRRILVDPGVNDELRPDEVDLDYIRKARVLHTSSFIGLRSETSLETLKRTMKAVADELMVTFSPATMVLRGWSYLEPYFEAADVVFLNETEAVHLTGDIEETLNRLAELVEVTIVTRGSDPAIVQEGTEISEVAPEPVPEEDIVDPTGAGDAFAAGFIEGILRGEPADRCCERGHAVAAECLRIEGCRPPTEGRSE

SEQ ID NO: 9026 - protein, 585 aa, Actinoplanes missouriensis
MELTSEHDPVEGSHTEDGVVEHPTSDDFGHARALPADRTWFQRAVFYEVLVRAFYDSGSDGGGDLRGLIERLDYLQWLGVDCLWLPPFYDSPLRDGGYDIRDFYKVLPEFGTVEDFVALLDAAHKRGIRVITDLVMNHTSDSHPWFQASRHDPDGPYGDFYVWNDNSDKYKDARIIFVDTEESNWTFDPVRRQFYWHRFFSHQPDLNYENPKVQEAMMDALRFWLDLGIDGFRLDAVPYLFEEEGTNCENLPATHAFLKHCRKVIDDEFPGRVLLAEANQWPADVVEYFGDPRSGGDECHMAFHFPLMPRIFMAVRRESRFPISETLANTPAIPDNCQWGIFLRNHGELTLEMVTDEERDYMYSEYAKDPRMKANVGIRRRLAPLLENDRNQIELFTAMLLSLPGSPVLYYGDEIGMGDNIWLGDRDGVRTPMQWTPDRNAGFSTATPGRLYLPVNQDPVYGYQAVNVEAQRDSATSLLNVDPDHAAVRRRHEAFAVGTFRELGGSNPSVLAYLREYGDDVVLCVNNLSRFPQPIELNLQHWNGYTPVELTGHVNFPRIGQLPYLLTLPGHGFYWFQLCGSEEKQ

SEQ ID NO: 9027 - protein, 217 aa, Prunus salicina
VVGFAFFLCFIMSIGDGSYDYFQFVQQWPPTNCRVRIKRPCSNPRPLQYFTIHGLWPSNYSNPTKPSNCAGSQFNFTKVFPYLRSKLKISWPDVESGNDTKFWEGEWNKHGTCSERILNQMQYFQRSQAMWKSHNITEILKNASIVPHPTQTWTYADIVAPIKTATKRTPLLRCKWDKKNQLLHLHEVVFCYGYNALKHIDCNRTAGCQNQQAISFQ

SEQ ID NO: 9028 - protein, 146 aa, Brassica napus
QKGLTLKETRQMEFLSQVVDETLRVITFSLTAFREAKTDVEMNGYLIPKGWKVLTWFRDVHMDPEVFPDPRKFDPSRWDKGFIPKTGAFLPFGAGSHLCPGNDLAKLEISIFLHHFLLKYRVKRSNTECPVMYLPHTRPTDNCLAR

SEQ ID NO: 9029 - protein, 213 aa, Prunus salicina
VVGFAFFLCFIMSTGDGSYVYFQFVQQWPPTTCRLKRPSIKHRPLQNFTIHGLWPSNYSNPTMPSNCRGSQFDARNLSPRLQSKLKRSWPDVESSNDTRFWEGEWNKHGKCSEQTLNQMQYFERSHEMWSSFNITEILKNASIVPHPTQTWTYAAIVSPIKAATKRTPVLRCKQHNNTQLLHEVVFCYEYNALKQIDCNRTAGCKNQQAISFQ

SEQ ID NO: 9030 - protein, 452 aa, Pseudomonas syringae pv. phaseolicola 1448A
MSTNLDQLTDWLKEHKITEVECMMSDLTGITRGKISPTNKFIAEKGMRLPESVLLQTVTGDYVEDDIYYELLDPADIDMICRPDQNAVYLVPWAVEPTAQVIHDTYDKQGNPIELSPRNVLKKVLKLYADQGWQPIVAPEMEFYLTKRSDDPDYPLQPPIGRSGRPETGRQSFSIEAANEFDPLFEDVYDWCELQNLDLDTLIHEDGTAQMEINFRHGDALSLADQILVFKRTMREAALKHDVAATFMAKPMTGEPGSAMHLHQSIIDIETGKNIFSNEDGTMSELFLNHVGGLQKFIPELLPLFAPNVNSFRRFLPDTSAPVNVEWGEENRTVGLRVPDAVPQNRRVENRLPGADANPYLAIAASLLCGFIGMVEGINPSAPVVGRGYERRNLRLPLTIEDALERMENSKTIEKYLGKKFIIGYVAVKRAEHENFKRVISSWEREFLLFAV

SEQ ID NO: 9031 - protein, 363 aa, Piper betle
AAHGVSRSVLEMNGEVVERAEPHIGSLHRGTEKLIEYKTFLQALPYSDRSDYVSMMAQEHAHSSAVETLLNCEVPLRAQYIRVLFREITRISNHSLASTTHAMDVGASTPFLWAFEEREKLLEFHERVSGARMHASFIRPGGVAQDLPLGSCRDIDSSTQQFASRIDESEEMSTSNRIWKQRLVDIGTVTAQQAKDWGFSGVMLRGRGVCWDLRRAAPYDVHDQSDPDVPVGTRGDRYDRYCIRIEEMRQSVRIIVQCPNQMPSGMIKADDRKLCPPSRCRMKLSMESSIHHFEPYTEGFSVPAPSTYTAVEAPKGEFGVFLVSNGSNRPYRRKIRAPGSAHLQGLDSMSKHHMPADVVTIIG

SEQ ID NO: 9032 - protein, 339 aa, Nocardioides sp. JS614
MTRSSTVSTAEALVAPGKGILAADESTPTIAKRLAAIGVESTEPVRRAYRELLLTAPGLSEHISGVILYDETLRQRTDDGVPFGELVAGAGMIPGIKVDAGTADLAGFPSEVVTEGLDGLRRRCAEYVELGARFAKWRAVIKVGEGRPTRTCIEANAHALGRYAALAQEAGLAPIVEPEVLMDGSHTIDRCAEVTVAVLWAVYDQLAEQRVLLEGTLLKPNMVLPGAECPDQVDDETIATRTVTAMRESVPVAVPGIVFLSGGQTHQQATARLDAINRHGSQPWQLSFSFGRALQAPVLEAWGGDERNRDAAQAALLERAALNGAARYGSYRPEMERPR

SEQ ID NO: 9033 - protein, 218 aa, Prunus salicina
VVGFAFFFCYVLSSGFYDYFQFVQQWPPTNCKIRKKCSKPRPLQMFTIHGLWPSNHSNPTTPSNCNGAQFDDRKVYPRLRSKLKISWPDVENGNDTKFWEGEWNKHGRCSEQTLNQMQYFERSYEIWNLFNITNILKNASIVPSATQTWTYSDIVSNIKAVTQRTPLLRCRRNPAYNKSGPNSQLLHEVVLCYGYNALKLIDCSRTPGCGNQQAISFQ

SEQ ID NO: 9034 - protein, 364 aa, Calycanthus floridus
AAHGVSRSVLEMNGEVVERAEPHIGSLHRGTEKLIEYKTYLQALPYSDRSDYVSTMAQEHAHSSAVERLLNCEVPLRAQYIRVLFREITRISNHSLASTTHAMDVGASTPSLWASEEREKLLEFHERVSGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMESSIHHFEPYTEGFSVPAPSTYTAVEAPKGEFGVFLVSNGSNRPYRRKIRAPGSAHSQGLDSMSKHHMPADVVTIIGT

SEQ ID NO: 9035 - protein, 366 aa, Triticum aestivum
MANSAALLHSLLSTAWTPRRRLDRASATRLAPSPGLSCRSSRPTRSVRPMASSTTAARADAAPPGLKEGIAGLYDESSGLWESIWGEHMHHGFYDSGEAASMSDHRRAQIRMIEEALAFAAVPDDPTNKPKTIVDVGCGIGGSSRYLANKYGAQCSGITLSPVQAERGNALAAVQGLSDKASFQVADALEQPFPDGQFDLVWSMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKFSIITCRKPQAAIEGEPEAASPSVE

SEQ ID NO: 9036 - protein, 345 aa, Magnaporthe grisea 70-15
MPPKKNDKAGGKKPSVTKVVDDKTFGMKNKKGGAAQKQIAQLQAQAKSGGNAEQKRKEAEKAAREREKKAAEDAKREADLLLNKPAQIQKVPFGVDPKTVLCIFFKKGNCEKGKKCKFSHDLDVERKTEKKSLYTDTRENEDDKKKAETSADWDEDKLRSVVLSKKGNQRTTTDKVCKYFIEAIEDGKYGWFWICPNGGDKCMYKHALPQGFVLKTKEDRAREKALLDKSPLKTLTLEEFLESERHKLTGTLTPVTPESFAKWKKDRLDKKAAEEQARKAKDATGRALFESGNWRTEEDDDDAEDDDDPWNLEKLRAETEAIRQRKEEERLAIENGVTVPGAPGT

SEQ ID NO: 9037 - protein, 95 aa, Raphanus sativus
MALVRSLLGAKKILGQATASTSKRATMAAPPKGFLAVYVGESQKKRYVVPISYLSQPSFQALLSKSEEEFGFDHPMGGLTIPCPEDTFINVTSRL

SEQ ID NO: 9038 - protein, 485 aa, Chlamydia trachomatis D/UW-3/CX
MIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETALGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDVLSPSLDEIVP

SEQ ID NO: 9039 - protein, 138 aa, Oryza sativa (japonica cultivar-group)
MSSKKIVIKVDFVRAKCKAVAMTVVAKIPGVKSLAADDEKGTMTVVGEVDVVQVVGELRKAKFAAEVVSVEPEKKPEAPKKPDDPPKKPDPPPPCPPPPPPCCPGCNSCRPACQCAAAPGGGVVLYEVEADGYGCIIA

SEQ ID NO: 9040 - protein, 1221 aa, Crocosphaera watsonii WH 8501
MVHVKRIELSHFKSFGGTTAIPFLPGFTVVSGPNGSGKSNILDALLFCLGLATSKGMRAERLPDLINHNHSSNRKTQEAYVSVTFDVSDLTDLAEFSRDNPPITKIALTEENSNNGNGHHVEEVNNENGLIASSEWTITRRLRVTKGGSYSSTYYINEQPCNVSQLHEQLNRLRIYPEGYNVVLQGDVTRIISMNGKERRNIIDELAGVAEFDRKIEKTKETLEGVREREERCQIIETELKRSLERLAADKIKAEKYQKLKLQIHEKQGWETVLLWKLLQQKISRLQTQITTGEQEEQKLNQAIHELAVKIKENATKLEELNRQVKALGEDEQLTVASQLATQKAQRNQRQQRQQELDNLIIQTEKEISDTETIINQQKQTLSQLTQNSNSLQQETLPLLKEQRDRTYQTLEMVRQQAAAVAEASDAWVQEQAKLSRQISTLQDTLNPQLTQQAQLTERSQQLQNNIEDESQQLANIETELNSQQQELQQLSIPHEEKIQQLAQQLATAEQDQSILEETQTRLDKEYREKQRQLDRLEASQQAQREAQGTYATQLILSSDLPGVCGLVAQLGQVKPTYQLALEIAAGARLGHVVVEDDTIAAAGIKLLKQAKAGRATFLPLTKIRPYRGQNNQSLSYAQGFIDMAVNLVLCRPEHEKIFSYVFGNTVVFETLNDAKSHLGKQRIVTLDGDLLETSGAMTGGSRPKRSSIRFGTLVQGESHEIKSLKQRLTDLEELLSRNQEKLQQKSEQIKQLSHELTEARQSGREQQLKRQQLEKEIQRLQGQQEKLSLQLSRHKQESETLDHKLTIIAAEIPPLTIELQQKQDRLKQLEESHSHSEWQEIQTLIKSQEIQLQEREKELRQTENKQQDINRKLSSLEEKIKENQGKIDAYKEQIVKLENEKIDINKQLETINDKVSKLEFLFQELTQKLGETKKERDLTEEKLTTIKKNHQQKIWNLEKLETTQQERKESLITLNEEQESQQNELPDPLPEVPLLSEIDETTTDLTPHIEQLQKDIRNGQKRLEAMEPVNMLALEEHEKTQERLNELTEKLTTIQGERRELLLRIENFTTLRFRSFKESFDAVNENFKNIFATLSQGDGYLKLENEEDPFQGGLNLVAHPKGKPVQRLSSMSGGEKSLTALSFIFALQRYRPSPFYAFDEVDMFLDGANVERLSKMIQQQAQQAQFIVVSLRRPMIEASQRTIGVTQARGAYTQVLGIKL

SEQ ID NO: 9041 - protein, 147 aa, Escherichia coli
KPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEA

SEQ ID NO: 9042 - protein, 393 aa, Arabidopsis thaliana
MSCFKSKFAGKSYFRRTFHSSIVQFHPQLSILIWHRRYSIIRTYELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTIGLDGLGDRCKKYYEAGARFAKWRAVLKIGNNEPSELAIHENAYGLARYAVICQENRLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 9043 - protein, 218 aa, Petunia x hybrida
MFKSQLTSALFVVLFFLSPTYGEFELLQLVLTWPASFCYANHCERIAPNNFTIHGLWPDNVTIRLQYCKPKPTYTTFAGKMLNDLDKHWIQLKYKEAYARREQPTWKYQYQKHGSCCQTKYKQIPYFSLALRLKDRFDLLTTLRTHHIVPGSSYTFDDIFDAVKTVTQMNPDLKCTEVTKGTQELDEIGICFTPKADKMFPCRQSDTCEKTRKILFRG

SEQ ID NO: 9044 - protein, 416 aa, Heterocapsa triquetra
PAGAAALCGAHWAFVQPAAPAQGEVAAPRRLRASAGASAEGARFAGALPAATAIAVGSAVACCAAATKKKGVKVVHGKEIPWNIFMPKAPYTGKVVANDVHPQTLTEDTGDANWETTHLTFDHDGKVPYLEGQSIGIIAPGPDKKGETPAKIRLYSIASSAVGDDQTSKTVSLCVKRVVELDGKFANREVGEDKPDKAGTGYPKNKVYRGVCSNHICDMSVGDDVLITGPTGAEMLLPEDPKANIIMLATGTGIAPMRSYMRLLFHDKAGEAADGSRKFQGLAWLFMGVPYSKSLLYDDEHLAYVKNYPDQFRFDYAVSREQTNAAGQKMYIQTKMAEYTDELWELMQKENTHIYMCGLKGMEAGMEECFSAKAEAAGLVWKEFAKSMKKADRYHVEVYRGASTPSQWLLQHVQFS

SEQ ID NO: 9045 - protein, 92 aa, Geobacter metallireducens GS-15
MPTATARHILVSTEAECLQLKAEIEAGADFAEIARKNSACPSRMQGGDLGAFVPGQMVKEFDEVVFSGEINKVLGPVRTQFGYHLIEITKRW

SEQ ID NO: 9046 - protein, 211 aa, Campylobacter lari RM2100
MEIVYFDELESTQIYLSDKIRSGEITNNTAICAFVQSAGIGSRDNTWQSKQGNLHVSFCIKTQELAQDLPLASASIYFAFLMKEVLQRQNSKVWIKWPNDFYIEDKKIGGLMSSKINDFLVVGIGINLKYAPFNAEILDIEVDIAKLLNEYFSYVDEKILWKNIFSKYMLEFEKSRNFFIHNEGKILSLKDALLYKDGSILLDNKRIYSLR

SEQ ID NO: 9047 - protein, 522 aa, Methanopyrus kandleri AV19
MAKILVTDPIHEDALRKLEELGEVVVLEDADEEEIREHVRDADAWVVRSGTRVTRELIEEAKNLKVIARAGVGVDNIDVKAATERGIIVVNAPESSSISVAEHTMGLILALARKIPQADRSVRRGEWDRKRFMGVELAGKTLGLIGLGRIGQQVAKRAKAFEMEVTAYDPYIPEKVAEELGVELVDELEELLERADVVSIHVPLTEETEGMIGEEELKRMKSSAFLVNCARGKIVDEEALIKALKEGWIAGAALDVFAEEPPGEDHPLYELDNVVLTPHIGGSTGEAQRAAGLIVAREIERVLKGEIPENVVNLPLAGVPDDVRELMEVGERLADAAAQVLEERLRWVQVKVGGELEDREKEALKRAVLKGCLDRVLTEPVTMVNAVDVAERRGIEFEFTVSDELEGGEVEVVVRSDEDEISLRGELVEDRVYLTSVNGYEVRFKLSGPTLFVWHVDRPGVIGEVGIILGEHRVNVAAMEVGRRERGGEAIMVIRMDEEPPEECLRAIDEVEPVRRVELVRC

SEQ ID NO: 9048 - protein, 157 aa, Triticum aestivum
  misc_feature (113)..(113): Xaa can be any naturally occurring amino acid
  unsure (1)..(157): unsure at all Xaa locations
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLGXGVTIAHGGVLPNINPVLLPKKTAEKEPKSPKKAAKSPKKADKKA

SEQ ID NO: 9049 - protein, 425 aa, Leifsonia xyli subsp. xyli str. CTCB07
MSLATIPEALAELRAGRPIIVVDNESRENEGDVVLAAELASQEWIAWTVKNSSGFLCAPMTNEIADRLELPVMVATNEDTRGTNYTVSVDAADRLSTGISAGDRAHTLRVLAGLDSTPSSLHRPGHILPLRAAEGGVRERDGHTEATVDLLKLAGMTPVGAIAEIVSGDGEMMRLPGLIELGEREGILVITIEALIAYLQEFHCDRRLESPTPVPESSRVIFEVETTVPTPNGPFRMRAYRDRMTGADHVAIVAGSPDPTGTLVRVHSECLTGEAFGSLKCECGPQLDAALETVQREGGVVVYLRGHEGRGIGLINKLRAYKLQEDGLDTLDANLALGLPIDARDYGAATAILQDLGMRSVRLLTNNPEKVRQLEEHGIEVEERVALVVGVGAFNEGYLETKRDRMGHAIGEIYQTASAAERTTQ

SEQ ID NO: 9050 - protein, 445 aa, Oryza sativa (japonica cultivar-group)
  misc_feature (46)..(46): Xaa can be any naturally occurring amino acid
  misc_feature (49)..(49): Xaa can be any naturally occurring amino acid
  misc_feature (180)..(180): Xaa can be any naturally occurring amino acid
  unsure (1)..(445): unsure at all Xaa locations
GQGGGPVAGLPGQPAGVGFAQYAGYVTVDAAAGRALFYYLAEADGXAAXSSKAPLLLWLNGGPGCSSLGYGAMEELGPFRVKSDGVSLYRNPYSWNNVANVMFLESPIGVGFSYSNTTADYSRMGDNSTAEDAYKFLVNWMERFPEYKGRDFYLAGESYAGHYVPQLAHAILRHSSAAAXRQALLLADQPQRHHDWERGDQRLDDTKGMYDFFWTHALISDEANDGITKHCNFTDGADANSLCDDATSLADDCLQDIDIYNIYAPNCQSPGLVVSPPVTPSIESFDPCTDYYVEAYLNNPDVQKALHANITRLDHPWSACSGVLRRWVDSASTVLPIIKELLKNNIRVWVYSGDTDGRVPVTSSRYSVNQLNLPVAAKWRPWFSNTQGVGDVGGYIVQYKGNLSLVTVRGAGHEVPSYQPQRALVLVQYFLEGKTLPDCEKCGEA

SEQ ID NO: 9051 - protein, 541 aa, Magnaporthe grisea 70-15
MAHSTVSLALAAVGIFTLYLISKVILKTWQNATEARRLGCKPPASFPSWCPFGLDIVRKLIISRRQMRTPEWLREQLAKTSTPANPNNLTCSFQIVHTSGILTADEVNVHAMLSKQFDDFEVGQTRREIARPLVGESIFTTDGHAWKMLRGLVRPSFARHQVGDLELDEKHFKNMMACLETGSDGWTGNIDLQTLMFRYSLDSSTEFLCGASVGSQLKELQLQNGKVTDDEDEIDFASALDRAMEGLATRGQFFKCGPYIWPRGFEKACRDCHAFIDKYVARRQNKTLAAAEKQPPAESPPAAKEKYIFLDALAESFPDPVELRHQILGVLFAGRDTTASLISWVFYNLARDPARCHKLRRAVLEHFGGPREEEEEDPGRAVTFESLKECRYLQHVINETARLCPVVPVNSRRARRNTTLPRGGGPDGQSKVFVKEGTLVYFAPYIMGRRKELWGEDAERFVPERWEGKRHGWEFIPFSGGPRICPGQQSALTKTAYVIVRLLQRFDRIESWDPEVDVKHDATATMCSGTGVKVRLHADGF

SEQ ID NO: 9052 - protein, 194 aa, Philodendron oxycardium
NGEVVERAEPHIGSLHRGTEKLIEYKTYLQALPYSDRSDYVSTMAQEHAHSSAVERLLNCEVPLRAQYIRVLFREITRISNHSLASTTHAMDVGASTPFLWASEEREKLLEFYERVPGARMHASFIRPGGVAQDLPLGLCRDIDSSTQQFASRIDELEEMSTGNRIWKQRLVDIGTVTAQQAKDWGFSGVMLRG

SEQ ID NO: 9053 - protein, 341 aa, Mycobacterium sp. MCS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCRQCKSGRYNLCPEMKFYATPPIDGAFCRYVVIDDDFAHPVPESMSDDAAALLEPLSVAIATMRKAGVVPGSSILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWSAAIHLVNSGAVDLDAMVTGRYDLEHVADALDSDTDPASLKSIVNP

SEQ ID NO: 9054 - protein, 244 aa, Corynebacterium glutamicum
DHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 9055 - protein, 745 aa, Zea mays
MALCRGDVNSTTCFSCLTEAFGDLPSACSDDKAATIYYDPCMVHYSDVHTLPGDDDTGPSIDTYPIGDNQYVTADPGQFIRLLAALVNATADYAAYNSTRRFATGQADTGFDPEFPELYALAQCTPDQTPAQCHKCLAGLISQSLGGFQNRDGARMLAVSCTYRYETKPFYNGPAMVRLASPSSGAPAPAPAVNSRVRAADGDPMYSTEAEDTEMVDSMMMDVSALRAATGDFDESNKLGEGGFGAVYKGVLPDGEEIAVKRLSSSSSQGVQELKNELALVAKLKHRNLVRLIGVCLGQQERLLVYEFLPNRSLDLILFDTENEERGRRRLDWAQRYKIINGVARGLQYLHEDSQLKVVHRDLKASNVLLDENMNPKISDFGLARIFGRGQTQAVTRRVVGTYGYMAPEYMMRGNYSVRSDAFSFGVMVLEVVTGRKNSDDGCNLLATVWTHWEAGTVAQLVEPSTMGGSFPEGDVLRCVHIGLLCVQADPAARPVMSSVVMMLGSDTVTLQAPSKPGFFVRNNSANAAASTVSLDDTELAARLGAEVQGRRAGPAVPSCTKTPPTQLKVVHRDLKTSNILLDAKMRPKISDFGLARIFKRDQTQAVTRPAASLAPSQYSVELQNQLPVWSVFINTFLLDLFHVSWVHPYMAPEDVMRGNYIINPFHKFDGTNSFLILLLTISLRKIKCDGLTHSISQTKRESTEQEDDYLVPQNKHAVNYYHALVDSGGGLFRCQLSPGSGGGL

SEQ ID NO: 9056 - protein, 288 aa, Eichhornia crassipes
AAHGVSRSVLEMNGEVVERAEPHIGSLHRGTEKLIEYKTYLQALPYSDRSDYVSTMAQEHAHSSAVERLLNCEVPLRAQYIRVLFREITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRGRMKLSMES

SEQ ID NO: 9057 - protein, 287 aa, Liriodendron tulipifera
AHGVSRSVLEMNGEVVERAEPHIGSLHRGTEKLIEYKSFLQALPYSDRSDYVSTMAQEHAHSSAVERLLNCEVPLRAQYIRVLFREITRISNHSLASTTHAMDVGASTPFLWASEEREKLLEFHERVPGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 9058 - protein, 403 aa, Pseudomonas aeruginosa PAO1
MQVSKSNKLANVCYDIRGPVLKHAKRLEEEGHRILKLNIGNPAPFGFEAPEEILQDVIRNLPTAQGYSDSKGLFSARKAVMQYYQQKQVEGVGIEDIYLGNGVSELIVMSMQALLNNGDEVLIPAPDYPLWTAAVSLAGGKPVHYLCDEQANWWPDLEDIKAKITPNTRAMVIINPNNPTGAVYSREVLEGMVELARQHNLVLFSDEIYDKILYDGAVHVSTASLAPDVLCLTFNGLSKSYRVAGFRSGWVAISGPKQRAQSYIEGLDILANMRLCANVPAQHAIQTALGGYQSINDLVLPPGRLLEQRNRAWELLNDIPGVSCVKPMGALYAFPRIDPKVCPIHNDEKFVLDLLLSEKLLIVQGTAFNWPWPDHFRVVTLPRVDDLEQAILRIGSFLKGYQQ

SEQ ID NO: 9059 - protein, 444 aa, Gibberella zeae PH-1
MSKPVVLEDVTGGSVNATHLCVLVHGLWGNPSHLRNVAKSLRDNYSEDELYILLAKQNSGNHTYDGIETGGERVCAEIEQELKDIEKKGGKITKLSIAGYSLGGLVSRYAVGLLYAKGVLDDLECMNFTTFATPHLGVRTPLKGWLSNIYNVLGARTLSMSGRQLFTIDSFRNTNRPLLAVLADPNSIFMSGLKKFKRRTLYANIVNDRSVVHYTSGINKTDPYTDLDNVKLNYLKDYDGVILDPDHPVTQSPKVQGQDTLLSDFDSIKKWIKNVPFMLTIGVIIPIGVVVFLANSAVQTVRSAKRIKLHESGLAGLKIEDYRMPLRIKAIQEEVEQAYESFNSAQDQQYLASDSDDDLAYDAEDRQKLRRERRMSTVEQPTLALTPDQFEMIENLNAAGWRKFPVHIQKHRHSHAAIVVRMDKESFADGWVVLGHWAGSEFLI

SEQ ID NO: 9060 - protein, 204 aa, Zea mays
  misc_feature (43)..(43): Xaa can be any naturally occurring amino acid
  misc_feature (188)..(188): Xaa can be any naturally occurring amino acid
  unsure (1)..(204): unsure at all Xaa locations
MASSSLFLQSIFMTSFTNLSCNQQFHRISLLGSCKAFQNLGIXSNGTHFSYASIFTANKNLTASQALSQNGNIENPRPSKAQELSEYEINELDRHSPKILKNAFSLMFGLGDLVPFTNQLYTGDLKKRVGITAGLCVVIEHVPDKKGERSEATYSFYFGHYGHLSVQGPYLTYEDSLLAITGGAGIFXRAYGQVKLQHPVFPTH

SEQ ID NO: 9061 - protein, 503 aa, Burkholderia sp. 383
MTHNSERPADPAGGADSRHADPDAMFASHEAGYAKQLKPRHVQMIAMGGAIGTGLFLGAGGRLQHAGPALALVYLVCGVFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLAVFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGAPYGGILITVAINAIGVPLNYIVPAQAFEIVLNMASLGIITTWGFIVMCQILFRRAVDRGELKAVSFRMPGAPFTSWLTLAFLVGVLVLMAFDYPGGTWTIATIPVVVLALVVGWKLAKRGAAREQVADARASAATHAVADPARGA

SEQ ID NO: 9062 - protein, 559 aa, Rhodopirellula baltica SH 1
MSPHPMTLLRRSMLRYKIGRLQRYLADAERARDIQRENLLHRIHQNADTAFGRDHGFSEIRTLEDFRRRVPIAGYEAARPYVDRVIQGETTALFPENTKVVMFATTSGTTDHPKMIPVTEDFYRQYKAGWQYWGTGVYRDYPHLLQMKSLQFSSHWNVTQTPSGAPCGNISGLAAETRPFYIGSLFVLPACVIQITEHLAKHYTALRLSLACDRVGKIVTANPSTLVEVAKFADTMKETLIRDIHDGTLTGDQPIPDAIRQQLRSRLRPNPRRARQLQQIVDRTGHLYPKDAWPDLTLLAVWTGGSVGLYLNQLPEYYGDAAIRDHGLSASEGRMTVPLQNGSPSGMLDYSSHHFEFIPESERDSKTPHVLEAWELTEGENYFIVLTTASGLYRYDIHDLVRCDGFCGQTPMLSFLNKGKNFCSFTGEKLSEHQVMQAMQQTLQSINAPSCTFTLAPTLGERPRYHLVLDDSSLPNLCERIGQELQNQLAQVNCEYADKCASGRIEPIQVTRVPAGTWEKLRASKTSKRGNFEEYKHPCLTNDPNFLQNLSKLDSASPS

SEQ ID NO: 9063 - protein, 511 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYDNGIYDEFVLPSVITKEDGSPVATIQDEDAVIFYNFRPDRAIQISNTFANEDFRSFDRGEKHPKHLHFVCLTHFSETVDGYVAFKPINLDNTLGEVLSQNNLKQLRIAETEKYPHVTFFMSGGREAEFPGETRILIDSPKVATYDLKPEMSAYEVTDALLAEIEGDKQDAILLNFANPDMVGHSGMLEPTVKAIETVDECLGKIVDAILAKGGTAIITADHGNADEVITLEGNPMTAHTTNPVPVIVTKQGLELREDGILGDLAPTMLTLFLDVAQPKEMTGKTLIK

SEQ ID NO: 9064 - protein, 362 aa, Capsicum annuum
MATAVTAAVSLPSSKSTSFPTRTSIISPEKINFNKVPLYYRNVSGGSKLVTIRAQVTTEAPAKVEKISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 9065 - protein, 117 aa, Oryza sativa
MNHPSSAATATVLLLLALLGVAAGGGEDGQKRAAGVYIVIVQPPADGADTVAYHTCILAAALGSEERAKEALLYSYRAVASGFAAKLTPPELSALQKHPAVLQVRPDQMYHAVDNLN

SEQ ID NO: 9066 - protein, 792 aa, Zea mays
MDETPTSSGQSEDSSCEPNWWPPDLLEKIESASISRKHDVLGNLRSSSWKASQLLWSTGSYSGLIPNGFYSIIPDKKLKETFPTIPSVDDLQTLEADGLKADIIIVDTERDKKVFMLKQLSAALVKGLSSSPALVIKKIAGLVFDCFKRQNPDASPAKGSIEDTHFFGYKGPQLLGQIRHGSCRPRAILFKVLADAVGLESKLVVGLPDDGAVGFVDSYKHMSVVVSLNSMELLVDLMRFPGQLIPFSAKAIFISHISAAGESDSAENDSCDSPLEPNSPLYGLSDKVETEGIESSSNLSGRSLRNMMLRSRTFSEGKLSTSCSEPNIANAFWRHSQRRGVAEEPRGASSSPEHPLMRARGRSILGGEKQSFQEYTESGAASRSDGLGGTSTSNARRIRRRSISITPEIGDDIVRAVRAMNETLKQNRLQRDHVEGSCSYVTEDQSNANDCPNKDDASRIIGATDSDSRNRTGPTQKAMSLPSSPHEYRGQDTQKGDDFISKEKMALAWNKVFQSSPFLNKPLLPFEEWNIDFSEITIGTRVGIGFFGEVFRGIWNGTDVAIKVFLEQDLTPENMEDFCNEIYILSRLRHPNVILFLGACITPPHLSMVTEYMEMGSLYYLIHMSGQKKKLSWRRRLKIIRDICRGLMCIHRMKIVHRDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPENRPSCQEILTRLLDCEYTVS

SEQ ID NO: 9067 - protein, 114 aa, Brassica napus
  misc_feature (3)..(3): Xaa can be any naturally occurring amino acid
  misc_feature (16)..(16): Xaa can be any naturally occurring amino acid
  misc_feature (24)..(24): Xaa can be any naturally occurring amino acid
  misc_feature (38)..(38): Xaa can be any naturally occurring amino acid
  misc_feature (44)..(44): Xaa can be any naturally occurring amino acid
  misc_feature (52)..(52): Xaa can be any naturally occurring amino acid
  misc_feature (59)..(60): Xaa can be any naturally occurring amino acid
  misc_feature (68)..(68): Xaa can be any naturally occurring amino acid
  misc_feature (70)..(70): Xaa can be any naturally occurring amino acid
  misc_feature (72)..(72): Xaa can be any naturally occurring amino acid
  misc_feature (77)..(77): Xaa can be any naturally occurring amino acid
  misc_feature (79)..(79): Xaa can be any naturally occurring amino acid
  misc_feature (89)..(89): Xaa can be any naturally occurring amino acid
  misc_feature (95)..(95): Xaa can be any naturally occurring amino acid
  misc_feature (99)..(102): Xaa can be any naturally occurring amino acid
  unsure (1)..(114): unsure at all Xaa locations
MAXVSLLDISIAFFCXLILQIFLXSKKPHPSFLTNWPXLGMLPXLLLEFPRXYDFITEXXEHGNLNYXFXKXPFLGXLXMLSTVDPAKXHHIMSXNFPXXXXGPRVGFWPSQLF

SEQ ID NO: 9068 - protein, 204 aa, Fusobacterium nucleatum subsp. vincentii ATCC 49256
MKFLKFDEIDSTNNYMKENISSFENYDIVSAKIQTSGRGRRGNTWLSPEGMALFSFLLKPEKTLSIIEATKLPLLAGISTLSSLKKIKDGAYSFKWTNDIFLSGKKLCGILIERVKNDFVIGIGINVANKIPDDIKNIAISMESDYNIDKLILKVVEEFSVYYKRFSEEKWSEIIEEINSYNFLKDKKIRVHIGDKIFEGIAKI

SEQ ID NO: 9069 - protein, 559 aa, Penicillium chrysogenum
MSPFITTHVWKDDGSTTPIVSNPNVPIYGDGEMSDNSEIENAAGQLKEIHEFRQGLHQRHIQMIALAGTVGTGIFLSSGRAIVEAGPLGAFLAYTIIGATVASVVYGVGEMGALVPLNGGVIRYAEIFCDPALAFANGWNQIYSYCVSIPSEIVAAAVIIEFWITVNNAIWITVLGLLMLSTAFVFVRVYGELEFGFSILKIMLIIGVNLMALVITCGGAPNKSSIGFAYWKAPYGPFVQYLGVGGPLGRFLGFWKTFDNALFAYSGIENFTLAAAETRNPRHSIPMAARRIFVRILLFYVITIFMIGLIVSSADKRLLGSSGTASQSPFVIAARHAGIKVVPSIINAVVLTSAWSSGNSNILGGSRILYGMATQGHAPAVFTRINRFGIPWVAVALYGVFMSLGYMSLSSSASTVFTWLQNLVSISTLVNLMCICIVYLRFYYGCKKQGIDRFKELPWAAPFQPYITWISLFIYVVLFFTGGFTTFMRGHWSTATFVSTYFNLPFIVIVYFAYKFWAKTKIIPLAEIPIRPFIESWHKNPEPEPKPKRGLSKLNILWS

SEQ ID NO: 9070 - protein, 502 aa, Arabidopsis thaliana
MRKGQGYSYSVIASVLVLLCVVVSRIECSSQVHALSRLYLSKRGVGGSSTMDTSHFKAVKDLKPSSLRSAANQEGLRKRDLIRRLPGQPPVSFDQYGGYVTVNESAGRSFFYYFVEASKSKDSSPLLLWLNGGPGCSSLAYGALQELGPFRVHSDGKTLFRNRYAWNNAANVLFLESPAGVGFSYTNTTSDLEKHGDRNTAADNYIFLVNWLERFPEYKGRDLYIAGESYAGHYVPQLAHTILLHHRSFFNLKGILIGNAVINDETDLMGMYDFFESHALISEDSLARLKSNCDLKTESASVMTEECAVVSDQIDMDTYYLDIYNIYAPLCLNSTLTRRPKRGTTIREFDPCSDHYVQAYLNRPEVQAALHANATKLPYEWQPCSSVIKKWNDSPTTVIPLIKELMGQGVRVWVFSGDTDGRIPVTSTKYSLKKMNLTAKTAWHPWYLGGEVGGYTEEYKGKLTFATVRGAGHQVPSFQPKRSLSLFIHFLNDTPLPDTSRY

SEQ ID NO: 9071 - protein, 601 aa, Haemophilus somnus 2336
MVAEGANPLVSVVTLLAAAVVAVPLFKRLGLGSVLGYLAAGLVIGPFGFGLFTDPEGIIHIAELGVVMFLFIIGLEMKPSHIWGLRNYIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGTAFAVLVAAGLWLLNPLFKMLAKTKTREVMTAAALLVVLGSALLMEEGGFSMAMGAFLAGVLLSESSFRHQLEADIEPFRGLLLGLFFLGVGMSLNLSVVAENWFLIIFGVLLFMLVKGFIIYLIALITKTGNANSIDRAFIMAQGGEFAFVLFSAAASQNVISEEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIIAIDNREQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 9072 - protein, 244 aa, Brassica napus
  misc_feature (159)..(159): Xaa can be any naturally occurring amino acid
  unsure (1)..(244): unsure at all Xaa locations
MKKVVTSAAAKMTTVKDEWVAAAMTDDQMVVELLLRLKHAGTVAAENPETNLRWGIRQRRSRSSRFGGGVTLKKGVDSVRGSPKTPLSWSGGSGSGGASASPSAEDTSRQASCSTSAGSGSKAFPTNEITSCFPKRLKNKKSTSELKHEENLKLKERLXLEKEIASLRATFDQQNVMNQRLKRIKLDLNSGHVKNETPVDLIRKSQGESKPCRMEGKTATSESLFFLPDLNITPSEDELLYGTS

SEQ ID NO: 9073 - protein, 282 aa, Mahonia bealei
RSVLEMNGEVVERAEPHIGSLHRGTEKLIEYKTYLQALPYSDRSDYVSTMAQEHAHSSAVERLLNCEVPLRAQYIRVSFREITRISNHSLASTTHAMDVGASTPSLWASEEREKLLEFHERVPGARMHASFIRPGGVAQDLPLGLCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 9074 - protein, 722 aa, Gibberella zeae PH-1
MSGIMSKRQQARNEKALQDLVQNVPGNNMCADCHARNPAWASWSLGVFLCMRCAAIHRKLGTHISKVKSLSMDSWTNEQVDNMRKVGNVTSNNLYNPEHGKPSVPVDVDEADSAMERFIRQKYMNNTVNGTGKSKSPHMGEGTPPPLPPKNSKFGFRSASSIFPLSSKSKKDAKTIAAARANRTESPRPPNKPSKVFGATLDLDQPDELDQKMARLLDMGFQDAKRNALVLKGVNGNLERAIETLVRLGEGSGRPSPLPTPSPREQTLRTSRSLTPLTPNSGGLGLGAGLSVPSRSATDRPTTPSSASTNPFDNLGTAPPQTAQSTGSLQNRNPYGQTNPFGAPVAQEQQPTDAFSQAFQNMSLSPQQPLFPHHTGGPVPQPAAQQLTGYQQVAPSAPTTPGGFSSLGFSNNMTYPQPLQAQSTGYNPFFTNQTAAVQQQPQQLNNPFPQVNTNQAPAGYKPFTRSPTRIASPSLGQIPEQTQSSFQNPAVYQTSAVYQSSAVYQSPAPLSPPETTTNPFFANAGQSIAQTGQVFGQQPAMQPMQNQTQATNNPFVQQQTGQQLYGQQQIPQMQQQQQMQQQQQQQQMQQQQQFYQPQRPDNASIMALFNNYPQMTPQQASAESTQSSYQTAHQPQQPTIPENQPMAPVQQNHGVPAPMSSGTNPFMTNAPAANSIASPNAMTTSDPFAARSRESMNLGMDLAWTNGRHSPDAFASLSARHG

SEQ ID NO: 9075 - protein, 873 aa, Nocardia farcinica IFM 10152
MLKHLARAGVLSARGAAEYSLAALRDRDPASRDRRRAEAVLDFLVRMGPIYIKMGQIAATRSDLFGPDWVSTLRVLQDQTPHMTAAQSRRAVERELGRPLTQVFRRFDAEPVASASVAQVHVAELLDGRKVAVKLVKDGVPEQIEESLKSIATLLRLLNRATPRLRELDVATRFDEIARLLRPQADMTHEAAQQRRIHANFAGHPYVTVPAVLDELVTSRMLVMQFMDGIPGKRVEEVGFPRDQLARRLQDVIYTMLYMHGVCHGDPHPGNVMFGPTGELILLDYGVTVELTEDEKWGLSSFYYACTRKEWHNAIDRFTRYFVLADEKLHRNRAAYDAEMAEVLRYHFDISSSQWSTISYFNDVSAVLRKYDSRYTTNFTKVELVFLSCEGFASQIDPDIDIWANARRFTDRYSPYMSAEVEARFAAGFAEQMPTSLRLRDRAQATLVAPTHIDRYFFPSGFPVFVESAAGGRVRDFDGNDYLDLSGGYGPHLLGYGHPAITEAITTGVRRGLVNGIGNPGEIELAEQLVRAFPAADKAVLCNSGTEAILFAIRMARGYRRRATVAKFEGHYHGFSDQGMVSSWFRFSGDRHRPDPVAGSQGVDPATVANTVVMQYGDLDGLARIREHADELACVILEPMPTSVVALNVEFLTALRGLCTELDIPLIFDEVVSGFRVAYGGVQVLADVHPDLTCLGKVIGGGLPCGAVVGRAELIDTAKSSQDPFYDYENKVFAGGTLSGNSLTCAAGLAVLRHLDAHREIYDELESNTQRLAGMLREATAQREIACRINASRSIFSLNFSHRAAGLYRDRMAGSNFKATIALAYYMRKHQVYLPELHSFLISAAHTTEDLDQIAHAFDKSLDEMLADNLFVL

SEQ ID NO: 9076 - protein, 370 aa, Nocardia farcinica IFM 10152
MKSKAAVLWEPGAPWQIEELELDAPKYGEVLVELAASGLCHSDEHVRDGSVPVSFYPFIGGHEGAGVVREVGPGVTNLKPGDHVALGFIPACGRCRPCANGQSSICDLGAHLLDGYQVSDGTARHHVRGKDAGILCLLGTFAPYTVVNEASCVKITDDVPLDKAALVGCGVTTGWGSSVYAAGVSAGETVVVLGMGGVGCGAVQGAALAGARHVVLVDPSPVKREQAKVFGATHAVATVEEALPLVQDLTWGYLADKVLITVGVASGALIGQAMSLVAKGGVCVNVSVGDLETSDVTLNLFDLTAMRKTLKGAWFGNANIRFDIPHLLRLYMEGQLKLDEMITRTYTLEQVNEGYEAMRNAENVKGLIVY

SEQ ID NO: 9077 - protein, 518 aa, Saccharum hybrid cultivar H65-7052
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 9078 - protein, 442 aa, Arabidopsis thaliana
  misc_feature (275)..(275): Xaa can be any naturally occurring amino acid
  unsure (1)..(442): unsure at all Xaa locations
MCSILARFQVLQPPQWMRKKKTRFQFLLNPNSKFVFFPRAISSSSSSSSDNNNDGSVSSSRQNNRQMGYDPSEELFGVDFKPRFISGDSREPRSWFGPNGQYIRELPCPTCRGRGYTSCSNCGIERSRLDCPQCKGKGIMTCLRCLGDCVIWEESIDERPWEKARSSSPFRVKEDDEVDNLEIKFSKRRKSKRIYQSPTPEVGQKISRSLKSLNAKTGLFSKRMKIIHRDPVLHAQRVAAIKVCNLLHFVLYPKLTWNKFCCFFPLNLLSVVVFXKAKGTPAARKHASESMKAFFSNPVNREQRSLSMKGTKFYCKNCGQEGHRRHYCPELGTNADRKFRCRGCGGKGHNRRTCPKSKSIVTKGISTRYHKCGICGERGHNSRTCRKPTGVNPSCSGENSGEDGVGKITYACGFCKKMGHNVRTCPSKQVSDSDSCLEQEGS

SEQ ID NO: 9079 - protein, 148 aa, Brassica napus
  misc_feature (97)..(97): Xaa can be any naturally occurring amino acid
  misc_feature (105)..(105): Xaa can be any naturally occurring amino acid
  unsure (1)..(148): unsure at all Xaa locations
QIENLSIKLQEMERFAHGTNSVLSEMRERIEELVEETMRQREKAVENEEELCRVKREFESLKSYVSTFTNVRETLLSSERQFKTIEELFERLVTKTXQLEGEKAXKEVEVQKLMEENVKLAALLDKKEAQLLALNEQCKVMALSGSNI

SEQ ID NO: 9080 - protein, 152 aa, Paxillus involutus
MPNAAERTYIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMIYE

SEQ ID NO: 9081 - protein, 284 aa, Xylella fastidiosa Temecula1
MPHVTLLPSPSQIAFIGGGNMARSLIAGMIRQGAPSTSICVIEPIAALRDALIADFKIKAVTTATEAATDTSTWVLAVKPQVMPDVCATLPLPVQPNTPLVISIAAGITTCKLKHWLGDTCAIVRAMPNTPALLGAGVTGLFATSQTTGTQRTIAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQTLVAKAIDAATRRARALGKINDTDPT

SEQ ID NO: 9082 - protein, 326 aa, Catharanthus roseus
MDASALDGIINRLLEVRGRPGKQVQLSESEIRHLCLKSKEIFMEQPNLLELEAPVKICGDIHGQYSDLLRLFEYGGLPPNSNYLFLGDYVDRGKQSLETICLLLAYKIKYPENFFLLRGNHECASVNRIYGFYGECKRRFNVRLWKVFTDCFNCLPVAALIEEKILCMHGGLSPDLHSLDQIRNLPRPTDVPETGLLCDLLWSDPSKDVKGWGLNDRGVSYTFGPDKVKEFLQKHDLDLICRAHQVVEDGYEFFADRQLVTIFSAPNYCGEFDNAGAMMSVDETLMCSFQILNPAEKKAKFGFGSNTTVKTGTSPAKVKSFLGKVG

SEQ ID NO: 9083 - protein, 561 aa, Schizosaccharomyces pombe
VNELLEAVKKEFEDICQKTKTVEAQKDDFEYKAMISAQINEMALMKQTVMDLEMQQSKVKDRYEEEITSLKAQLEARRKEIASGVVPQSSKTKHGRNSVSFGKYGNAGPFNSDNSSKPLILNNGSSGGTPKNLRSPAIDSDGTVLAPIQTSNVDLGSQYYSSPHVRPAVGATMAGSAMRTFPSNLPLGHPPPPSDSANSSVTPIAAPLVVNGKVSGNPPYPAEIIPTSNVPNREEKDWTVTSNVPNKEPPISVQLLHTLEHTSVICYVRFSADGKFLATGCNRAAMVFNVETGKLITLLQEESSKREGDLYVRSVAFSPDGKYLATGVEDQQIRIWDIAQKRVYRLLTGHEQEIYSLDFSKDGKTLVSGSGDRTVCLWDVEAGEQKLILHTDDGVTTVMFSPDGQFIAAGSLDKVIRIWTSSGTLVEQLHGHEESVYSVAFSPDGKYLVSGSLDNTIKLWELQCVSNVAPSMYKEGGICKQTFTGHKDFILSVTVSPDGKWIISGSKDRTIQFWSPDSPHSQLTLQGHNNSVISVAVSPNGHCFATGSGDLRARIWSYEDL

SEQ ID NO: 9084 - protein, 314 aa, Catharanthus roseus
MSADLVASSTYGNLDEQDEQISQLMRCKPLSETEVRALCEKAKEILMEESNVQPVRSPVTICGDIHGLFHELAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLIARAHQLVMEGYNWSHEQKVVTIFSAPNYCYRCGNMASILEVDDCRQHTFIQFEPAPRRGEPDVTRRTPDYFL

SEQ ID NO: 9085 - protein, 302 aa, Glycine max
MASDRTIRIGVNGLGRIGRLGARVVLQRNDDELDAVNDPFITTDYMTYMFNFDTVHGQARVCVESTGVLTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKAAIKEESEGKLKGILGYTEDDVVSTDFVGDNRSSIFDAKAGISLNENFVKLVSWYDNEWGYSSRVIDLIAHIASVA

SEQ ID NO: 9086 - protein, 251 aa, Pediococcus pentosaceus ATCC 25745
MRTPIIAGNWKMNKNPQETQEFLDAIKGKLPDASVVESVIAAPAIDLSTLVAFSKDEQLKTAAENSYFEDEGAFTGETSPKALNEMGVNYVVIGHSERRQYFGETDEDINKKAKAIFNNNMTPIICCGETLEQREAGETNEWVAGQITNALKDLTAEQVAASVIAYEPIWAIGTGKTASSDQAQEVCHVIRETVAKLYDQTVADKVRIQYGGSVKPANIAELMGKEDIDGGLVGGASLDPESFLELVNYKG

SEQ ID NO: 9087 - protein, 143 aa, Arabidopsis thaliana
  misc_feature (6)..(6): Xaa can be any naturally occurring amino acid
  misc_feature (57)..(57): Xaa can be any naturally occurring amino acid
  misc_feature (116)..(116): Xaa can be any naturally occurring amino acid
  misc_feature (119)..(119): Xaa can be any naturally occurring amino acid
  misc_feature (121)..(121): Xaa can be any naturally occurring amino acid
  misc_feature (124)..(124): Xaa can be any naturally occurring amino acid
  unsure (1)..(143): unsure at all Xaa locations
MASSMXSSTAVVTSPAQATMVAPFTGLKSSASFPVTRKANNDITSITSNGGRVSCMXVWPPIGKKKFETLSYLPDLSDVELAKEVDYLLRNKWIPCFEFELEHGILCTREHGNTSXYYXLXGTXQLWKFHFRSFKELRPGLFW

SEQ ID NO: 9088 - protein, 159 aa, Glycine max
SCTGVETVAQFGVVFLLFALGLEFSLAKLKAVGPVAVLGGLLQIIIFMFMCGILSMLFGAKLSEGVFVGSFLSMSSTAVVVKFLVERNSNNALHVQVTIGTLIFQDCAVGLLFALLPVLGGNSGLLQGIMSMGKLLLVLSLYITATSVLSWTFVPRFLK

SEQ ID NO: 9089 - protein, 248 aa, Candida albicans SC5314
MPKLVLVRHGQSEWNEKNLFTGWVDVRLSETGQKEAKRAGELLKEAGINVDVLHTSKLSRAIQTANIALDAADQLYVPVKRSWRLNERHYGALQGKDKAQTLEAYGQEKFQIWRRSFDVPPPKIDPKDEYSQVGDRRYADVDPAVVPLTESLALVIDRLLPYWQDEIAGDLLAGKVVLIAAHGNSLRALVKHLDNISDEDIAGLNIPTGIPLVYELDENLKPTKPSYYLDPEAAAAGAAAVAAQGQKK

SEQ ID NO: 9090 - protein, 393 aa, Cucumis sativus
MNGPATRKDLMIVNMGPHHPSMHGVLRLILTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELVYDLFEAATGMRMMHNFFRIGGVAADLPHGWIDKCLDFCDYFLTAVAEYQKLITQNPIFLERVEGVGIISGEEVINWGLSGPMLRASGIPWDLRKVDRYECYDEFDWEVQWQKEGDSLARYLVRLAEMTESVKIIQQALEGIPGGPYENLEIRSFDRARSPEWNDFDYRFISKKPSPTFELAKQELYVRVEAPKGELGIFLIGDQGGFPWRWKIRPPGFINLQILPQLVKRMKLADIMTILGSIDIIMGEVDR

SEQ ID NO: 9091 - protein, 309 aa, Saccharomyces cerevisiae
MDSKEVLVHVKNLEKNKSNDAAVLEILHVLDKEFFPTEKLLRETKVGVEVNKFKKSTNVEISKLVKKMISSWKAQLIKNKRCRQPQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 9092 - protein, 473 aa, Bacillus cereus ATCC 10987
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 9093 - protein, 149 aa, Glycine max
VSYVRPPPHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 9094 - protein, 381 aa, Arabidopsis thaliana
MSCFSCFSSKVLDNEGSSMPAPYKQPNSPKRTTGEVVAKNANGPSNNMGARIFTFRELATATKNFRQECLIGEGGFGRVYKGKLENPAQVVAVKQLDRNGLQGQREFLVEVLMLSLLHHRNLVNLIGYCADGDQRLLVYEYMPLGSLEDHLLDLEPGQKPLDWNTRIKIALGAAKGIEYLHDEADPPVIYRDLKSSNILLDPEYVAKLSDFGLAKLGPVGDTLHVSSRVMGTYGYCAPEYQRTGYLTNKSDVYSFGVVLLELISGRRVIDTMRPSHEQNLVTWALPIFRDPTRYWQLADPLLRGDYPEKSLNQAIAVAAMCLHEEPTVRPLMSDVITALSFLGASSNSSNTGSNHLQQNRSNKYQDAVQWDSSPRYANSQM

SEQ ID NO: 9095 - protein, 148 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLK

SEQ ID NO: 9096 - protein, 658 aa, Oryza sativa (japonica cultivar-group)
MMKSTVFSAVAVSIGYTLLGWDFTTVLEANIHMKKEFGLNNGPSIDGIILAVSVFGSIAITVFSGSLLDWLGRRAALIYSSLLLISGGLLMVWSPNIYILLLARLIVGSGSGLVFTCVPIYISETSPPNMRGSLGTMPQFMFFVGIVFSYCLIFWMTLIPSPNWRIMIGAIFAPSLVYFALLVFYLPESPRWLVSDGKISEARISLQWLRGKDDVSDRSAGEIALIADGMNMITETAVGGHAVGAVRSQSFLGTSTNQMSRHSTFYWHLSDPLVDLLGSIHESMSELGAGRNSYFPVFNSFNIVEQEQTSEQRGNDSLQQSREAYSAEEGNNGDNLQASLLSQVASAETNDINTSFTSEGSSSYLRRHGTSTSGLAQDLISSLHDHDIEEDDEEIHIAALSSQPALGAGLHPFRQQMVRLSETADIKPKWRVLLQPGVRHALCYGMLIQALQQSAGISGLLRYTPQILEQVGVISLFSDIGLDSHSASILISALNASLMLPCITAAMILMDVCGRRVLLLVSIPFLTLSVGAISLSNIVKMGSLPHEILFQLSLTICFCSYVIGLGPIPNILCSEMFPTRARATCASFCSLAFWFGRLLSIYCFPVMLSTIGLSGACAIYAFVCCLVLVFVYLRVPETKGLPLELIAEIFKFSRQECL

SEQ ID NO: 9097 - protein, 526 aa, Nostoc sp. PCC 7120
MSKVLVSDPIDQAGIDILSQVATVDVNTGLKPAELIEIIGQYDALMIRSGTRVTQEIIEAGTQLKIIGRAGVGVDNVDVPAATRRGIVVVNSPEGNTIAAAEHALAMMLSLSRHIPDANASVKRGEWDRKTFVGAEVYKKTLGVVGLGKIGSHVAAVAKAMGMKLLAYDPFISTERAEQIGCQLVDLDLLMQQSDYITLHIPKTPETTHIINATTLAKMKPTARIINCARGGIIDEAALAAAIKEGKIAGAALDVFESEPLGESDLRAIGKDIILTPHLGASTTEAQVNVAIDVAEQIRDVLLGLPARSAVNIPGLGPDVLEELKPYMQLAETLGKLVGQLAGGRVELLTVRLQGELATNKSQPLVIASLKGLLHQALRERVNYVNANIEAKERGIRVIETRDASARDYAGSLRLEATGTLGTHSVTGALLGDKEIHLTDVDGFPINVPPSKYMVFTLHRDMPGIIGKLGSLLGSFNVNIASMQVGRKIVRGDAVMALSIDDPLPDGILAEITKVPGIRDAYTVTL

SEQ ID NO: 9098 - protein, 382 aa, Leifsonia xyli subsp. xyli str. CTCB07
MSRAARYSFAMTTSPLDRFYGVIPAGGIGSRLWPLSRADAPKFLHDLTGSGQTLLRDTWDRLAPLAGEQRIMVVTGRAHRAAVEAQLPALTDPNIVLESEPRDSTAAIGLAAAILEQREPGVIVGSFAADHVIQNEPLFAAAVREAAAAADAGHIATIGIKPTEAAVGFGYIQTGAALAVPGAPSALTVDSFVEKPDHATAERYLAGGRHLWNAGMFIARASRLLEEIGRSRPQLLAGLQELAAAWDNPATRGPAVDRIWPALEKIAIDYSVAEPAAAGGRLAVIPGSFDWDDVGDFASLAKLNSGGRKSDLAILGEDARVLSDASSGIVVSQSKRVISLIGVKDIVVVDTPDALLVTTSENAQRVKAVVDALKLTGSTDVL

SEQ ID NO: 9099 - protein, 447 aa, Nocardia farcinica IFM 10152
MAIDTALAPETATDTLTELARATGTRYILALFVTLTGKPCAKLVPVEAADRLAAGGAGFAGYAAGTLGQQPRDPDLIAIPDPASFTPIPFVRPGLALVHCDPHVDGAPWPYAPRVILAATLARAAARGLTVNVGAEVEYFLVDRDGDGRLRTADRADTSSQPCYDARDVTRMYDHLTEVSAAMNTLGWGNYASDHEDANGQFEQNFDYADAMTTADRVITARYLLSVIAEKRGMRATFMPKPFTDRTGSGMHLHMSLWNATGPLFPDPADGRGLGMSATAYAFIAGILEHACALQGVLAPTVNSYKRLGATATASGATWSPRYASYGGNDRTHYLRVPDPHRVELRGGDGSANPYLAVAAALAAGLDGVDRALDPGAPGAGARHGDMLPMTLLHAMDALDADPVISAALDGAGPGVAAYFSRLKREEFFAWHNTVSAWEIDHYLTAF

SEQ ID NO: 9100 - protein, 561 aa, Bacillus halodurans C-125
MSTQWWKESVVYQIYPRSFQDYNGDGIGDIPGIISRLDYLKTLGVDVIWLSPVYDSPNDDNGYDIRDYKAIMDEFGTMADWETLLAEIHTRGMKLIMDLVVNHSSDEHAWFVESRKSKDNPYRDFYIWRPGKDGKEPNNWASNFSGSAWTYDETTGEYYLHLFSKKQPDLNWENPKLREKIYEMMTWWLDKGIDGFRMDVINFISKVDGLPDAEPQPGQPYVSGSNYFMNGPNIHTYLQEMHENVLQHYDLMTVGEMPGVTLELAQLYTGEERNELNMVFQFEHVGLDQGPNGKWDLKPLELKDLKASLSRWQKGLQDIGWNSLYWNNHDQPRIVSRFGDDQSYRVESAKMLATLLHCMKGTPFIYQGEEIGMTNVRFDSIEQYQDIETLNMYKEKRAQGVPHETLMASIHAKGRDNARTPMQWDETKHGGFTDGTPWLEVNPNYKEINVKQALKDPNSIFYHYQKLIQLRKEHAILVHGSYDLILEDDPEIFAYKRTYNGQTLLVVCNFYGRITDFECPAEVVLSEPTLLLSNYDEEENGSYTSFRLRPYEARVYLGKNE

SEQ ID NO: 9101 - protein, 510 aa, Bacillus halodurans C-125; identical to SEQ ID NO: 281

SEQ ID NO: 9102 - protein, 251 aa, Bacillus halodurans C-125
MRKPIIAGNWKMNKTVGEAKAFVEEVKGAIPSSDKVDSVVCSPALFLEGLVQKAEGTELRIGAQNMHFEESGAFTGEISPVALSDMKVDYVILGHSERRDMFAETDELVNKKTHAAFAHGLTPIVCVGETLEEREANQTYDVVKTQVEKGLEGLTDEQVKVTVIAYEPVWAIGTGKSSSAEDANDVCSYIRKVVTEKFSQEAADAVRIQYGGSVKPANIAEYMAQSDIDGALVGGASLDPQSFLQLLEAVK

SEQ ID NO: 9103 - protein, 335 aa, Bacillus halodurans C-125
MATKIGINGFGRIGRNVFRAALNNPNVEVVAINDLTDANMLAHLLKYDSVHGKLDAEVKVDGDSLVVNGHSVKVKAERDPAQLGWGDLGVEVVVESTGRFTNREDAAKHLEAGAKKVIISAPAKDEDITVVMGVNENKYDPANHHVLSNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKEVTAEEVNAALKEAAEGDLKGILAYSEEPLVSGDYNGNPASSTIDALSTMVMEGNMVKVISWYDNESGYSHRVVDLVDYIAKQGL

SEQ ID NO: 9104 - protein, 473 aa, Burkholderia sp. 383
MQPSNQSDLKCGLKQRHMTMIALGGVIGAGLFVGSGVVIQQTGPAAILSFLITGGLVVLVMRMLGEMACAMPAVGSFYEYARLAFGNWRGPGKMAGFLTGWMYWYFWVIVVALEAVAGAKLIQFWLPDTPAWIISLALLVVLTLTNLISVGSYGEFEFWFSSIKVGAIIVFLFLGGLYVLGLWPASMHTTSVLPTLLGHGGFMPLGIGPVMSGAVAATGFYFGAEIVTIAAAEAKEPAKAVAKATNSVITRVLVFYVGSVALVVALVPWNSHQMATPYVSALEVMGLPAAANVMNAIVLTAVLSALNSGLYAASRMLFALTRHGDAPAALAKVNKRGVPVRAILLGTVFGYVSVVMSYVSPDTVFAFLVNSYGTVALFVYVLIAFSQLRLRKRLDPVAASKLRVKMWAYPYLTWVAIIGMVGILVAMAFIPDQRKPLWLGVASLGVLVVAYGLTRRSRREHLDDSELLAYPPR

SEQ ID NO: 9105 - protein, 317 aa, Pseudomonas fluorescens PfO-1
MLTLLNLLKDGRFHSGQALGAALGISRSAVWKQLQHLEAELGLSIHKVRGRGYQLASPLTLLDSLEIAESLPGWSVSIFDSVDSTNAESLRAVDRGRAAPFLVLAELQRSGRGRRGRKWVSPFAENLYYSLVLRIDGGMRQLEGLSLVVGLAVMQALHALGVPGAGLKWPNDVLVGRKKIAGILLELVGDPADVCHVVLGIGINVNMQATDEVDQQWTSMRLESGKSCDRNILAVELSKQLQLYLQRHQSGGFSVLRAEWEASHLWQGQPVSLTAGVNQVDGVVLGIDNQGALRLKVDGVEKVFSGGELSLRLRDDS

SEQ ID NO: 9106 - protein, 142 aa, Paxillus filamentosus
YIMLKPDGVDRGLIGEILARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 9107 - protein, 364 aa, Triticum aestivum
VNIGKLQELLITLATLIKKEIVSSSILMVGYAMKPSREEDFAKRGAFPIYPSENGLIFVPLSFELPLASQLLEVDIILHKMTDEIITIDPNCSISFPRGISFSAGMSEVIRFMEEYPDFCIIDPFKNISPLLDRLQIQEILVRLQELGSEGRPKLRAPHSLKVINFSGSELQKQLAEANLSFPLIVKPQVACGVADAHNMALVFQIEEFSNLSVPLPAILQEYIDHGSKIYKFYVIGDKVFHAVKTSMPNANLLKSSSGDEPLTFNSLKTLPVATKEQLLLNRAQDNKSLNIGVVEEAAKLLKESLGLTIFGFDVVVQEGSGDHVIVDLNYLPSFKEVPDSEAMPAFWDAIRQSYESKKGKVQT

SEQ ID NO: 9108 - protein, 98 aa, Zea mays
  misc_feature (40)..(40): Xaa can be any naturally occurring amino acid
  misc_feature (69)..(69): Xaa can be any naturally occurring amino acid
  misc_feature (86)..(86): Xaa can be any naturally occurring amino acid
  unsure (1)..(98): unsure at all Xaa locations
ARDPLGTRCIDMEKILTRADSRKLIVLPFNKTDLVTNEEXDIRLKSLKEEMPTVQFKCKTQEQLTNLGXKSSKLDKTYITPQRGEXLTPDNLVQLLQE

SEQ ID NO: 9109 - protein, 654 aa, Oryza sativa (japonica cultivar-group)
MMKSTVFSAVAVSIGYTLLGWDFTTVLEANIHMKKEFGLNNGPSIDGIILAVSVFGSIAITVFSGSLLDWLGRRAALIYSSLLLISGGLLMVWSPNIYILLLARLIVGSGSGLVFTCVPIYISETSPPNMRGSLGTMPQFMFFVGIVFSYCLIFWMTLIPSPNWRIMIGAIFAPSLVYFALLVFYLPESPRWLVSDGKISEARISLQWLRGKDDVSGEIALIADGMNMITETAVGGHAVGAVRSQSFLGTSTNQMSRHSTFYWHLSDPLVDLLGSIHESMSELGAGRNSYFPVFNSFNIVEQEQTSEQRGNDSLQQSREAYSAEEGNNGDNLQASLLSQVASAETNDINTSFTSEGSSSYLRRHGTSTSGLAQDLISSLHDHDIEEDDEEIHIAALSSQPALGAGLHPFRQQMVRLSETADIKPKWRVLLQPGVRHALCYGMLIQALQQSAGISGLLRYTPQILEQVGVISLFSDIGLDSHSASILISALNASLMLPCITAAMILMDVCGRRVLLLVSIPFLTLSVGAISLSNIVKMGSLPHEILFQLSLTICFCSYVIGLGPIPNILCSEMFPTRARATCASFCSLAFWFGRLLSIYCFPVMLSTIGLSGACAIYAFVCCLVLVFVYLRVPETKGLPLELIAEIFKFSRQECL

SEQ ID NO: 9110 - protein, 250 aa, Solibacter usitatus Ellin6076
MIYSAMATAKKIALITGANKGLGFEMARQLGQAGVTVIVAARDPGKGEAAAAKLRDAGLDAQFLKLDVNDGKDRAEAAEVLEKKFGRLDILINNAGISAETFGGSKASATTEDVLHRTFETNFFAPFALTQALLPLLKKSEAGRIVNMSSILGSQTLHADAKSPIYDFKSLAYDASKAALNSFTIHLAYELKDTKIKVNSAHPGWVKTDMGTDAAPMEIPEGAKTGVELALVGAEGPTGGFFHLGKALPW

SEQ ID NO: 9111 - protein, 246 aa, Prochlorococcus marinus str. NATL2A
MRKPVIAGNWKMNMTCTEAIEYMRVLIPLLKDIPKKDREIVIAPPFTALYPLSEFIRDRNEYLSLSSQNVHWEDSGAYTAEVSPLMLNELSVKCAIVGHSEPRKYFSESDEQINKRAKSAQDHQLIPIVCVGETFQQREMGEAERVIRRQIEQGLEGIEVKRLIVAYEPIWAIGTGKTCEANEANRICGLIRKWIGYEDVIIQYGGSVKSNNIDEIMSMSDIDGVLVGGASLDPTNFARIANYEKI

SEQ ID NO: 9112 - protein, 340 aa, Nicotiana tabacum
MEYEGILLGMGNPLLDISAVVDQDFLNKYDIKPNNAILAEEKHLPMYDELASKSNVEYIAGGATQNSIRVAQWMLPFSGATSYMGSIGKDKFGEKMKNNAKDAGVNVHYYEDDAPTGTCAVCVLDGERSLVANLSAANCYKVDHLKRPENWALVEKAKFYYIAGFFLTVSPESIQLVAEHAAANNKIFSMNLSAPFICEFFRDPQEKALPYMDFVFGNETEARTFSKVHGWETDNVEEIALKISEWPKASETHKRITVITQGADPVVVAENGKVKLFPVIPLPKEKLVDTNGAGDAFVGGFLSQLVQGKPVEDCVRAGCYASNVIIQRSGCTYPEKPDFA

SEQ ID NO: 9113 - protein, 252 aa, Methanopyrus kandleri AV19
MPGRGCAHDEDPGHGPVHEDALRKLEELGEVVLEDADEEGLRRHVRDADAWVVRSGTQVTRELIEEAENLKVIARAGVGVDNIDVEAATERGIVVVNAPESSSISVAEHTMSLMLVLARRIPQADRSVRRGEWDRKLFMGVELAGKVLGVIELGRIGRQVAKRTKAFEMEVIAFDPYISEEVAEGLDVELVEDLDELLRRADVVTIYVPLTDETQGMIGERELKLMKESAFLINCARGEVVDEEALVRACSC

SEQ ID NO: 9114 - protein, 340 aa, Nicotiana tabacum
MDFEGILLGMGNPLLDISAVIDQDFLNKYDIKPNNAILAEEKHLSMYDEMTSKFNVEYIAGGATQNSIRVAQWMLQIPGATSYMGSIGKDKYGEEMKKNAKDAGINVHYYEDESPTGTCAVCVLDGERSLVANLSAANCYKVDHLKKPENWALVEKAKYYYIAGFFLTVSPESIQLVAEHAAAKNKVFSMNLSAPFICEFFKDQQEKVLPYMDFVFGNETEARTFSRVHGWETDNVEEIALKISQWPKASGTHKRITVITQGADPVVVAEDGKVKLFPVIPLPKEKLVDTNGAGDAFVGGFLAQLVQGKPIADCVKAGCYASNVIIQRSGCTYPEKPDFE

SEQ ID NO: 9115 - protein, 340 aa, Nicotiana tabacum
MDSEGILLGMGNPLLDISAVIDQDFLNKYDIKPNNAILAEEKHVSMYDEMTSKFSVEYIAGGATQNSIRVAQWMLQIPGATSYMGSIGKDKYGEEMKKNAKDAGVNVHYYEDESPTGTCAVCVLDGERSLVANLSAANCYKVDHLKRPENWALVEKAKYYYIAGFFLTVSPESIQLVAEHAAAKNKVFSMNLSAPFICEFFKDQQEKVLPYMDFVFGNETEARTFSRVHGWETDNVEEIALKISQWPKASGTHKRITVITQGADPVVVAEDGKVKLFPVIPLPKEKLVDTNGAGDAFVGGFLAQLVQGKPIEDCVKAGCYASNVIIQRSGCTYPEKPNFE

SEQ ID NO: 9116 - protein, 961 aa, Streptomyces avermitilis
MTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 9117 - protein, 119 aa, Arabidopsis thaliana
  misc_feature (75)..(75): Xaa can be any naturally occurring amino acid
  unsure (1)..(119): unsure at all Xaa locations
MFSSMPSAVVEETSPAQASGVTPYTGGKSFAANPVTRKTNKDITTIASNGGRGSCMKVRPPIGKKKLETISNLPXLSDVQLAEEGDHTLRNKGIPCGEFRLEHPFEYPEHGNHSGYHQG

SEQ ID NO: 9118 - protein, 549 aa, Oryza sativa
MQAWFSGTGPSASSASSSSSPPQPSLLAEWNSYAAARSAEEEEDGGGGGFGIDIEAAVRSANDRVSGTFGVVSKGVLGLPGSFKSTTSSVPSSKSLVYFGLFLASGIFLVFIAFTIFLPVMRLPFTMGFVGSMAATIYVSMVLHSYILSVFFSCLQNLTGILGGMARLPYPGTGDGVFAAHGYLRFGLGIWYILSLSLSAYELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVTPGSDSPKVGAEVIGEYTVAALRRTVPPAVPGIVFLSGGQSEEEASQNLNAMNKLEVLKPWTLTFSFGRALQQSTIKKWGGKKENVAAAQAAFLARCKANSEATLGKYGGAAGDAATSESLYVKGYTY

SEQ ID NO: 9119 - protein, 143 aa, Triticum aestivum
  misc_feature (99)..(99): Xaa can be any naturally occurring amino acid
  misc_feature (111)..(111): Xaa can be any naturally occurring amino acid
  unsure (1)..(143): unsure at all Xaa locations
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFXVSNNSSPGYYDXRYWTIVESCLCSGWNRTQTARLKRLEGRSKGP

SEQ ID NO: 9120 - protein, 269 aa, Escherichia coli O157:H7 EDL933
MEKKIGFIGCGNMGKAILGGLIASGQVLPGQIWVYTPSPDKVAALHDKFGINAAESAQEVAQIADIIFAAVKPGIMIKVLSEITSSLNKDSLVVSIAAGVTLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 9121 - protein, 756 aa, Coccidioides immitis RS
MAATSTTTSTKRLNILVYSGGQSYSDWRRNVLTDCSGNGTTVDSVRQCLFSLRRLLAPNYAVIPVTGEMIINEPWTSSCALFVMPGGADLPYCRTLNGTGNRRISQFVHRGGAYLGFCAGGYYGSKRCEFEVRNEKLEVVGDRELAFYPGICRGCAFPGFVYNSEDGARASELQVSKSSFPDEKHIPPSFKSYYNGGGVFVDAPKFAHQGVEVLADYTESLKVDSGEGHAAVVYCRVGEGAAVLTGPHPEFVSLNANVSVDRPQLTALRFAASNLDRNADGPEFCHVIDTLAQNDEARTEFLRACLKKLGLHVNDETTRVPPLSRMHLSALEPHAATDLVSLLRDIITVEDGEEYIKDDNDTFHLEKPSSLSMDKVAEALPGSIEAKADQDSTGDRIVDYDKVIKKVAIHEDYPSPVETPRFNHQTFYGMIKEYRSQSRERLSEFGSHVLYAEVVTSTNTLLENNIQLANGERNTQILRRLPNGFMATANVQVAGRGRGSNVWVSPPGQLMFSICIRHPVEKFASAPVVFIQYLVAMAIVKGIKTYDKGYENMPVKLKWPNDIYALDPSQPDKMTYTKIAGILVNAHFSSKEYIAVAGAGINALNALPTTSLNAILATLNSSLPANKPRLPPLSLEKLLARILTTLEELYTRFLRTGFDQTFEDMYYADWLHMDQIVTLEAEGDVRARIKGITRDYGLLVAEELGWEDRPTGRRWELQSDRVGEEEDLMRERDKAIIVDSGLRGIEMIADDPGSIR

SEQ ID NO: 9122 - protein, 271 aa, Coccidioides immitis RS
MSAIEDAKRAAAREAVANHYPQNPKFVGIGSGTTIVYVVEAIKALGIDTSSTSFVPTGFQSNQLIVNAGLTPIAFDALPEGAVLDIAFDGSDEVDDDLNCIKGGGACLFQEKLVALQAKEFIVVADYRKLQPRLLTAWPSIPIEVAPLASRRVITALQALGSPEPKLRQSLISQEGPVKTDQSFFLIDAPFPQLLTSSDIQSGKTASAKEGIWEVETLAKEIKQIPGVLEVGLFYGPTGPQAQATGGVGGQKPIAAYFGMADGSVSVRKVK

SEQ ID NO: 9123 - protein, 321 aa, Coccidioides immitis RS
MDTKMEIDSGRTPEPHHLSLASDPESIPTLDGWIESLMSCKQLAENDVQRLCDRAKEVLQEESNVQPVKCPVTVCGDIHGQFHDLMELFRIGGPNPDTNYLFMGDYVDRGYYSVETVTLLVALKIRYPQRITILRGNHESRQITQVYGFYDECLRKYGNANVWKYFTDLFDFLPLTALIDNQIFCLHGGLSPSIDTLDNIRALDRIQEVPHEGPMCDLLWSDPDDRCGWGISPRGAGYTFGQDISEAFNHNNGLTLVARAHQLVMEGYNWSQDRNVVTIFSAPNYCYRCGNQAAIMEIDEHLKYTLYVPLLPCHSLNSKVS

SEQ ID NO: 9124 - protein, 142 aa, Vibrio cholerae O1 biovar eltor str. N16961
MALERTFSIIKPDAVKRNLIGEIYHRIEKAGLQIIAAKMVHLSEEQASGFYAEHEGKPFFEPLKEFMTSGPIMVQVLEGENAIARYRELMGKTNPEEAACGTLRADYALSMRYNSVHGSDSPASAAREIEFFFPESEICPRP

SEQ ID NO: 9125 - protein, 245 aa, Triticum aestivum
  misc_feature (123)..(123): Xaa can be any naturally occurring amino acid
  misc_feature (162)..(162): Xaa can be any naturally occurring amino acid
  unsure (1)..(245): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGXCTDATQVINKWRSQEGVPDAYVRIIGFTTSQVQCVSFIXAFKPPGLQGSGQALKTSFPKGQFKRALCSFGNFEIGLGFPSPFTFLNGSKKNGIGPVSLYKMAPKNLAHKKMLSGGFFIKRTH

SEQ ID NO: 9126 - protein, 446 aa, Xanthobacter autotrophicus Py2
MRYLPLTPEDRAEMLARIGVASVDELFVDIPADKRETALPRLALHKSELEVERTLARLAGQNVPAGSVPFFVGAGAYRHHVPATVDHLIQRSEFLTSYTPYQPEIAQGTLQYLFEFQTQVAELTAMEVANASMYDGSTAAAEAVLMAHRVTRRRKAVLAGNLHPHYRSTIETVSRYAADEVVALPPAPFGEEDLITPIDDTVSCVVVQSPDVFGNLVDLKPIAEAAHKAGALLVAVFTEAVALGLIEPPGAQGADIVVGEGQSIGNALNFGGPYVGLFATRQKFVRQMPGRLAGETVDAEGRRGFVLTLSTREQHIRREKATSNICTNSGLCALAFTIHMSLLGKTGLTRLARANHAAACDLADRLAAVKGASVVNDTFFNEFTLRVPGPAADVVEKLAAKGILAGVPYSRLAPKSGLDDLILVAATETTTEDDRAAYAAALKEVL

SEQ ID NO: 9127 - protein, 458 aa, Pediococcus pentosaceus ATCC 25745
MKEDLPQLKRSLTSNQMQMIALGGTIGVGLFMGSSSTIKWTGPSVLLAYGFAGLILYLVMRALGEILYVNPSTGSFADYATNYIHPLAGYLTMWSNIFQFIVVGISEVVAVSQYLNYWWPNLPGWVSSVVVIATLTLANLVSTKAYGAIEFYFALIKVLTIILMIIIGVLVIFMGLGNHWRPVGLSNLWAHGGFFTGGVKGFLFALSIVVGSYQGIELLGITAGEAANPKKAIVASVKSIVWRILIFYLGAIFVIVAIFPWNQLATVGSPFVETFSKVGITGAAGIINFVVLTAAMSGTNSGIYSASRMLYKLSQEGKVPKIFGKLSSHRVPSVAILTISFGILLGIILNIFLSSFKGGAVNLFVLIYSSSVLPGMVPWFVILLSELRFRRANPEIIQNHPFVMPLYPMSNYLAIISLLLIVVFMFINPDTRASVTVGFVFLMVLTINFIIKFRRKRG

SEQ ID NO: 9128 - protein, 623 aa, Zea mays
  misc_feature (104)..(104): Xaa can be any naturally occurring amino acid
  misc_feature (161)..(161): Xaa can be any naturally occurring amino acid
  unsure (1)..(623): unsure at all Xaa locations
MLPRRFSNHPGSSSPLPFLVVCGLLLAAAVAFSPAAAAEAAGRGGGGGGAGHEGRAGKPEVEAEAEARGDGVAVAEAGGEVMAQGNATEAKEGSLADMIDRALXEREFPESESEQGRGETDPGSFNNTVAEKQGVLETVARRVTKKNETKDNKVFAFKEVXFLDRSEQEDVPTLIDRKDNVFIISNPKSKYPVLQLDLRLISDLVVVIVSATCGGIAFACLGQPVITGYLLAGSIIGPGGFSFVNEMVQVETVAQFGVIFLLFALGLEFSTAKLRVVRAVAVLGGMLQIMLFMFLCGILATLCGGKTKEGVFVGVLLSMSSTAVVLKFLMERNSINALHGQVTVGTLILQDCAVGLLFALLPILSGTSGLLHGVASMTKSLVVLITFLTILSILSRTGVPWFLKLMISLSSQTNELYQLAAVAFCLLFAWCSDKLGLSLELGSFAAGVMISTTDLAQHTLEQIEPIRNLFAALFLASIGMLINVHFLWNHVDILLAAVILVITVKTFIVAIVVKGFGYSNKTSLLVGMSLAQIGEFAFVLLSRASSIHLIEGKLYLLLLGTTALSLVTTPLLFKMIPAVVHLGVLLRWFSVDTNQVELGLKNDVLRIDSGKRINLIVQGSHDS

SEQ ID NO: 9129 - protein, 571 aa, Kluyveromyces lactis NRRL Y-1140
MSKKLELSQQASISLSPYISNRIKEQAFSSVNDVIGDSDQGSYSDIENFKPPQKIVRGLKTRHIQLIALGSAIGTGLFIGSGGALSVCGPAPLLIAYIIISFFVWSIMNQMTEMVCLIPLPGEASLYSLAKTYLNSPISFMCGWNLFYAMAMIVPAEITACALLVQYWTDANSAIFISIFIVVSILLTMLPVKVFGESEFWVSSIKILTIVGLIIVGIVIFFGGGPAQDHVLGFHYWKNPGAFNPHLAEGNTGRFLAVWTAIIKSGFSFVLVPETVTSCSAECIAPRRNMPKACQRFIYRLAIFYIVGTLVVGVIVGFNNDRLINAIQSGKSDAAASPFVIGIQEAGIKILPHIINACILTSAYSCGTGLLYGSSRTLYSMALRGDAPKIFAKVNRFGTPYYSTGLASLFSFLAYLNCSKSASVVFNWLSNIATISGFVSWIFVSMTYIRFRKVINALDLNDRVPFRRPFQVPLAYLTCGFFFILSLTNGYAVFVKGNWNVSDFFASYVTIGFVIFLYLVGSFYYKQWTFRDFKEIEVEILPKIDIADEEERNDVIPVPRNFMEKVWYFIV

SEQ ID NO: 9130 - protein, 310 aa, Kluyveromyces lactis NRRL Y-1140
MSTSNESPSLKLNTGASIPVVGLGTWKSPEEDAYNAVVSALQNGYRHIDTAAIYGNEEAVGKGIRDSGVPREEIFVTTKLWGTQQRDPEAALDLSLQRLGLDYVDLYLIHWPVPLNASSITDGNYLTFPRTADGKIDIDIEEWNFIKTWEKMQHLPKSGKTKAIGVSNFSIKNIEALLAANPDFIVPAANQIEIHPQLPQTELIDYCKSKGILIEAYSPLGSSSSTILTDPTIEGIASKYNAEPANILISWGASRGYVVLPKSVNPQRIKTNLKLLDLSTEDLEKINKLTESVGAKRYVAPDFSPFAIFE

SEQ ID NO: 9131 - protein, 136 aa, Candidatus Blochmannia floridanus
MIQKERTLSIIKPDAVSKGIIGAIISRFESSGLLIVSAKMLQLTTDQVLEFYNEHKNKFFFKDLMEFMISGPIFVQILEGNYAIRRNREIMGNTDPMKALAGTIRFDYGESCTKNVIHGSDSESSAKYEIAYFFDI

SEQ ID NO: 9132 - protein, 175 aa, Triticum aestivum
MAPTVMASSATSVAPFQGLNSTVGLPVSRRSNGASLGSVSNGGRIRCMQVWPIEGIKKFETLSYLPRLITEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESDKA

SEQ ID NO: 9133 - protein, 393 aa, Streptococcus thermophilus LMG 18311
MTKLSNRVLQMEESVTLAASARAKALKAKGRDILSLTLGEPDFVTPKNIQDAAIASIENGKASFYTVASGLPELKDAVSTYMENFYGYTVKHSEIVVGTGAKFILYAFFATVINPGDEVIIPTPCWVSYVDQVKMVEGVPVTFQTTEANHFKATVEQLEAARTEKTKVVLLNSPSNPTGMIYSKEELQSIGDWAVEHDILILADDIYGRLVYNGNTFTPISSLSDAIRKQTIVINGVSKTYAMTGWRVGFAVGEPEIISGMAKIISQTTSNLTSVSQYAAIEALTGDQSSIEEMRKAFEERLNTIYPLLAEVPGFEVIKPQGAFYLFPNVKKAMEIKGYTDVNDFTNAILEEAEVALVTGAGFGAPENIRLSYATDLDILKEAVRRIKAFMEK

SEQ ID NO: 9134 - protein, 359 aa, Glycine max
  misc_feature (95)..(95): Xaa can be any naturally occurring amino acid
  misc_feature (193)..(193): Xaa can be any naturally occurring amino acid
  misc_feature (195)..(195): Xaa can be any naturally occurring amino acid
  unsure (1)..(359): unsure at all Xaa locations
MEISLGKLAFDIDFHPSDNLVAAGLITGDLHLYRYTPDSTPVRMLEVHAHTESCRAARFINGGRAILTGSPDCSILATDVETGSTIARLDDAHEXCRAAINRLINLTESTVASGDDEGCIKVWDIRERSCCNSFNSHEDYISDITFVSDAMKLLATSGDGTLSVCNLRRNKVQAQSEFSEDELLSVVLMKAGXTXNGRKVVCGSQTGIILLYSWGCFKDCSDRFTDLSSNSIDAMLKLDEDRIITGSENRIINLVGILPNRVIQPIAEHSEYPVECLAFSHDRKFLGSISHDQMLKLWDLDNILQGSGNTQSNEAGAVDSDDDEMDLDDDPSKNSKGNKRKNANNGNALGGSNNFFADL

SEQ ID NO: 9135 - protein, 555 aa, Methylobacillus flagellatus KT
MEHTPLIATIVGGLVLAFIFGMLANRLRMPPLVGYLIAGVVVGPHTPGFVADADLAHELSEIGVILLMFGVGLHFSLRDLLSVKSIAIPGAIVQIAIATLLGLSMALAIGWPLGEGLIFGLALSTASTVVLLTALQERRILETKRGQIAIGWLIVEDIAMVLTLVLVPVLSGMLGGDGNTLEGSALFNTMALTMGKIIAFVAVMLLVGRRVIPWLLARTAATGSRELFRLAVLAIALGFALGATYIFGVSFALGAFFAGMILSESELSHRAAEESLPLRDAFAVLFFVSVGMLFDPSILVREPWLILATLFIIVIGKSLAAFGIVLAFRHPLGTALTISASLAQIGEFSFILASLGASLGLLSDTGRDLILSGAILSILINPMLFAWLDRLKPWLLNREEKKPLKGESGARTISYPHLHAHAVLVGYGRVGKLVGAALRQQDQPFIVLEDQPEVVQSLREQGIPALCGNAAAPGMMEAANIKSARWLLVAIPDALEAGHIIQHARKINPQIEVVARAHSDAQIEHLEKHGASYTIMGEREIAKGMANWVRAGVEW

SEQ ID NO: 9136 - protein, 291 aa, Dehalococcoides sp. BAV1
MGKDVPLLVASAPSLMAQAKEMMEGYTLKARKGLGQHFLISQGVLNKILAAADLKPTDTVIEVGPGLGVLTEELLKRAGQVIAVEVDDKLIDALTEKFKGYPNFRLIHSDILKTSPEEILGQNVPYKLVANLPYYITSAVLRQFLEAKLKPESMVVMVQKEVAKNIVAKTGDMGLLTLSIRFYGNPSLVSVVPGGAFYPPPEVDSAIVKIVIPQTTIMEGVSEVDFFKLARAGFGTRRKTLLNALAQGLGISKPVILSLLNGAGIDPARRAETLSMEEWKKLCLEYAGNPC

SEQ ID NO: 9137 - protein, 284 aa, Clostridium thermocellum ATCC 27405
MGVNTKKLIQKYNLKLTKSLGQNFLIDDNIVKRIVDVAEITEKDLVIEIGPGVGSMTVELAKRAGKVVAVEIDKRLIPALEDNLGEFSNVDIINKDIMDVNINEFRGESGNVKVVANLPYYITTPIIMKLLEENNDNIDIMVFMVQKEVAQRMVASPGKKDYGALSVAVQYYTKPEKAFDVPPHCFVPQPEVDSTVIKLKVNETPPVKLMDKDYFFTVVKAAFGQRRKTLVNALHNFKALGKSKEEIKEILKKLGIDENARGETLSITQFAELSNLLFRSSQIM

SEQ ID NO: 9138 - protein, 140 aa, Brassica napus
  misc_feature (11)..(12): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(39): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
  unsure (1)..(140): unsure at all Xaa locations
MASSMLSSAAXXTSPAQGTMVAPFTGLXSSAXFPXTRKXNNDITFXXSNGRXVXCMKXXXPVGXKKIENLSXLSXLTXMNXXKGXDXPFXXKXVSCXXIQMXHGXFXXXGXGXTPPILIGVLKGNFLGRADGGQKGKTKF

SEQ ID NO: 9139 - protein, 490 aa, Arabidopsis thaliana
MAETTSWIPVWFPLMVLGCFGLNWLVRKVNVWLYESSLGENRHYLPPGDLGWPFIGNMLSFLRAFKTSDPDSFTRTLIKRYGPKGIYKAHMFGNPSIIVTTSDTCRRVLTDDDAFKPGWPTSTMELIGRKSFVGISFEEHKRLRRLTAAPVNGHEALSTYIPYIEENVITVLDKWTKMGEFEFLTHLRKLTFRIIMYIFLSSESENVMDALEREYTALNYGVRAMAVNIPGFAYHRALKARKTLVAAFQSIVTERRNQRKQNILSNKKDMLDNLLNVKDEDGKTLDDEEIIDVLLMYLNAGHESSGHTIMWATVFLQEHPEVLQRAKAEQEMILKSRPEGQKGLSLKETRKMEFLSQVVDETLRVITFSLTAFREAKTDVEMNGYLIPKGWKVLTWFRDVHIDPEVFPDPRKFDPARWDNGFVPKAGAFLPFGAGSHLCPGNDLAKLEISIFLHHFLLKYQVKRSNPECLVMYLPHTRPTDNCLARISYQ

SEQ ID NO: 9140 - protein, 395 aa, Heterocapsa triquetra
  misc_feature (339)..(340): Xaa can be any naturally occurring amino acid
  misc_feature (392)..(392): Xaa can be any naturally occurring amino acid
  unsure (1)..(395): unsure at all Xaa locations
MPTVPMASRGASAPRAYRRGTLSTVVRAAVAAAGCAGLAAAAAAAAMWPVSGSSFVASWPSRPRSRRCITCRAQDDSNAIELAERKRDGAILPKSWSDKPRTPTLPATLFKPKQSLSQNFLADPNYVFKMVNAIEDDSPGGKQVLELGPGTGALTSRLHPRFPEMMAVDLDQRAMRVLAQNVPGCTVIRSDVLLINYTKLAEVRGGPLTIVGNLPYHVTSQILFTLADHAKSVKDAHVTMQKEVAERIVARPNTKKYGILSVCFQLYADPKILFDIPPNAFFPRPNVMSSYVKLNFADAEERRLALNVDPRNLRNVTTRAFRMRRKMLQNSLKNLLDCXXTLINELPEEYAKLRPEQIEPWEFVHLTQLLFGKKEFPQDYLRRAWRGEFGRXVKD

SEQ ID NO: 9141 - protein, 710 aa, Saccharomyces cerevisiae
MGNSGSKQHTKHNSKKDDHDGDRKKTLDLPPLTKSDTTHSLKSSRSLRSLRSKRSEASLASNVQAQTQPLSRRSSTLGNGNRNHRRSNNAPITPPNNHYLTSHPSSSRRLSSSSRRSSMGNNNNSELPPSMIQMEPKSPILKNSTSMHSTSSFNSYENALTDDDDDRGDDGGESPSMAKVTRINTSSSADRGSKRTPLRRHNSLQPEKGVTGFSSTSSKLRRRSDNTLPATYPLNAEAGGNGSDYFSNRSNSHASSRKSSFGSTGNTAYSTPLHSPALRKMSSRDNDDSGDNVNGRGTSPIPNLNIDKPSPSASSASKREYLSAYPTLAHRDSSSSLSPRGKGQRSSSSSSSSQRIYVSPPSPTGDFVHGSCADGDNGSRTNTMVEMKRKKPVRPVDIDEIIQRLLDAGYAAKRTKNVCLKNSEIIQICHKARELFLAQPALLELSPSVKIVGDVHGQYADLLRLFTKCGFPPMANYLFLGDYVDRGKQSLETILLLLCYKIKYPENFFLLRGNHECANVTRVYGFYDECKRRCNIKIWKTFVDTFNTLPLAAIVTGKIFCVHGGLSPVLNSMDEIRHVSRPTDVPDFGLINDLLWSDPTDSSNEWEDNERGVSFCYNKVAINKFLNKFGFDLVCRAHMVVEDGYEFFNDRSLVTVFSAPNYCGEFDNWGAVMTVSEGLLCSFELLDPLDSTALKQVMKKGRQERKLANR

SEQ ID NO: 9142 - protein, 270 aa, Leifsonia xyli subsp. xyli str. CTCB07
MRKPYKYRASRWQTEPMETFRRSRAIVPLLDVLEEAGSTNDVMQARSGDLPDLAVVVTGNQTGGRGRLGRVWVAPPGKTLAISVLLKPEGLKPDAFGWFPLLAGLAMRRALAGFVPREVEVKWPNDVLIDGAKVSGILTELLPGMRGVVVGAGVNLTVAGDELPVPTATSLLLAGATDPDTDAVLAAYLIELVVLYRDFLTAGGDAVRSALRGEVAAACHTIGRAVRVELPGGGSLTGVAVALDDTGRLIVESDAGRTAVAAGDVTHLRY

SEQ ID NO: 9143 - protein, 123 aa, Bacillus halodurans C-125
MAFELDGIEQVEETELAALLNEKGDETIVVDVREPEEYEAGHIPGLPLLPMSSIPAVVAEMDKEKSYIFVCRSGSRSQNVALYLKDQGFRDVKNYAGGMLEWTGEVTSGLEWFVKDVHELYKK

SEQ ID NO: 9144 - protein, 485 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEYLVDTPDWSTILQANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVMTLLYSQVTRTKSRWKCSLKDGIMHINDKDILFNKVICASQIRLELFWQQASLTSDLNTSNDASRKVLQIPTERDMSIHGKVYSGWLVVQKEKFFLSKKAYQLSPCFMNSYCLSRNGKLTSQKLDLAYSCI

SEQ ID NO: 9145 - protein, 112 aa, Arabidopsis thaliana
  misc_feature (52)..(52): Xaa can be any naturally occurring amino acid
  misc_feature (76)..(76): Xaa can be any naturally occurring amino acid
  unsure (1)..(112): unsure at all Xaa locations
RTRANRMRSSATMVEHPSQATRGTASNGRKASASLQTTRRATNDTTFITSNXHRDNWMQVCTAIEKNKFETLFYLXDTTDHKAAIKTDYHILNTSIASVEFKWEQTFVYLVH

SEQ ID NO: 9146 - protein, 578 aa, Bacillus halodurans C-125
MKATIYHRPKSEDAYAYDKSTMHIRLRTGKNHVRKVNLIYGDPYDWTKNQWVTSKKEMTPTGSDAQHDFWFVEVTPPYRRLRYGFEIITKTETIYYGESGFLDTPSKDTSDYFCFPFMNPADLFSPPEWVKDTVWYQIFPERFANGDPSRNPEGTLPWGSAAPTPTNHFGGDLQGIIDHLDYLQELGINGIYLTPIFEASSNHKYDTIDYLKVDPHFGDKTTFKRLVDECHKRGIRIMLDAVFNHAGFYFPPFQDVLKNQQHSKYSDWFHLRDFPVRAEEPPNYDTFAFTPFMPKFNTENEEVREYLLNVATYWIKEFDIDGWRLDVANEVDHAFWREFRKRVKALKPDLYILGEVWHNSLPWLAGDQFDAVMNYPLTNAIIDFAGKQKIGQQRFEHVITQLTHMYPIHVQQVAFNLLGSHDTPRILTQTDNDVARVKLQFLLLFSQRGTPCIYYGDEIGMTGGQDPGCRKCMVWEEEEQNQELLSFVKRLIQLRKQEKAFGTEGDLTFVENDSSLLIYQKTYENQQLLFVINSTDQPDSVQLPVSWTNRNANDLLTGETFSLATEIVIPAKSAMVLK

SEQ ID NO: 9147 - protein, 468 aa, Propionibacterium acnes KPA171202
MAVAATGIPAESGEPAMDKPRMKGRHLVMMSLGSAIGTGLFVGSGKGVAAAGPATLVAYIVAGLLVIAIMYMLGEMVAAHPDSGAFSVYTSRAMGSAAGFAMGWVWWIELVVVVAAEAIAAASTLVAMWPIAPVWLLTLIFLVVLTAINLLGADRFGEFEFWFALLKVVAVVVFLTIGVLLICGVLAAPAAGTSNLVGHGGFLPNGWSGVATALLLVAFSFGGIEIMAVAAAETEDPAHNVSRAVRTIVWRILVFYMGSVAIMVIAVPWDDPELGASPFVAVLNRAGIPAASEVMTLVIVLALLSSLNANLYGAARMLGSLAERGMAPRVAMRTRGRSVPTVAVLASVAFGFCCVLATFEWGDAVLGTLLNIVGSTIIVTYFFTICSHYVLRRRAEKEGAPLPMRLKGFPVVNWAAMILLIGIVVLGMFSPDVRAQLMSTGALVVILYVIGVGWSHHAGRSPFHPTTD

SEQ ID NO: 9148 - protein, 321 aa, Hydrangea macrophylla
MAFTIPEVPLSSGGRKMPVLGLGTAADPPVDPETVRKAVTEALKLGYRHFDTAALYNSEQPLGDAIAEALGEGLIKSRDELFITSKLWCSDAHRENVEPALQKTLKNLKLEYIDMYLIHWPVSSKPGNYEYPIKKEDFLQMDYKSVWEAMEECQKLGLTKAIGVSNFSCKKLSDVLANAKVPPAVNQVEVNPCWQQKQLTEFCKSNGILVVAYAALGAVGTFYGTNRVMGSEVLNEIARIRGNTVAQVCLRWAYEQGIGVLVKSFNKERMEQNLQIFNWTLSDDESKKISEIPQGRACLGTDYTSVHGPFKTIEELWDGEF

SEQ ID NO: 9149 - protein, 138 aa, Deinococcus radiodurans
MERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 9150 - protein, 256 aa, Streptococcus agalactiae NEM316
MKIGIIGVGKMASAIIQGLKQTQHDIVISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLTKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 9151 - protein, 324 aa, Hydrangea macrophylla
MASNYSNIPEVSMSSSSRKIPIVGLGTATFPPVGSKTVVAAVLQAIQIGYRHFDTASVYQTESDLGEAIAEALRLGLIKSREELFTTSKLWCSDAHAQHVVPTLQKTLKNLNLDYLDLYLVHWPVSVKHGTYDYPIKTEDIIPMDYESVWGAMEECHKLGLAKAIGVSNFSCKKLGHLLSFAKIPPAVNQVEMNPVWQQRKLVEFCKENGVLVGAFSPLGALGTSWGSNNVMESEILKEIAKAKGKTVAQVSLRWAYEQGVIVLVKSYRAERMQENLGIFDWELSDEDTKKIREIPQRRVHRGEEFISENGPFKSIEEFWDGEL

SEQ ID NO: 9152 - protein, 565 aa, Oryza sativa (japonica cultivar-group)
MDDVWPWLAGLAGEEPPPPQAVVALAAFADGTTSIVLQADHVALAEGDEEEKTLVDFSLALNSTNGGAARVLWTSGRFEAASGVALQRQLLARLLDEVITLSPSVSCLSGNLGLGVGGAPKSKLDEEIVAGIGNDSAASFFSLTLLLRLFWLCATEAPADTGFLFFQALGADIQRALVDCRPALALFLASLGPDVEERFMRSLGYMLAKLCLLREMQADADQPAPAATRRPRALPAACLSYATEVHGLWVLRGYAPVLAMPRVTCAASTTAPITALPHEAPEEPALRYGLVHQQLEVVAQLEYAVRARRGERFMTVAVRVDNVRVRVARLGFRRDDADADADGGDAHDDAMDGERHFPSRLRLWVGPRFGASYATGPSLGRSTGNPEQDVETTRTVKGAFAAAGATKLANGGVPPRIKAKTRSSARARNRSWRWEQEAEGSAGVFEGVLCDPATGTEISAWRGDNNNNNGGAGDPRNGMRRRYGGPGRAFSKMRGLVVAGDELPEEVTWRVGREAEGRTLPWRVGLKAWLTYLPNQVRSHHFETRCVEWAHEVDLPLAAVNGDER

SEQ ID NO: 9153 - protein, 1190 aa, Clostridium thermocellum ATCC 27405
MHLKRLEIQGFKSFADRIQLEFNSGITAVVGPNGSGKSNISDAIRWVLGEQSAKTLRGGKMEDVIFAGTEHRKPMGFAEVSLTFDNSDGVLPIDFSEVTVTRRVYRSGESEYMINKTPCRLKDIYELFLDTGIGKDGYSIIGQGRVDEILSSKSEDRRAIFEEASGIMKYKVRKQEAEKKLEMTRQNLLRINDIIAELENQLEPLREQSEVAKRYLGLRETLKVLEVNVYIENIARYKEKIKELEENYASVKDNIDSENKRLEEITSLNQTNLSILKDMEGRLEAAKQEYYAIDGNLEKSNSEIRLNQEKINNLFSNIERLDGEIAEIDEKIKTILEEEASKNSKIVYLQERYNEYSAKLEEAEKKLQAIIATLNENERHIENLKTEIMEMLDIQSDKKTQINNIKNHIEGIKKRQANIDKEVYQLTLEKDKECMKKEELSESIYKTNELIKNIKDLLQELTEKRKDLGIKLEEEKKKQNNVRSQIQIMTSRQKMLIDMERNLEGYNRTVRVILQACRESHEFGKGIHGALAQLFTVDKRYETAIEMALGGALQNIVTTSEEDAKRVIEYLKKNNLGRATFLPISSVKGKYLDDSILNQLKDHEGFVGVASDLIEYDEQYRGIILSLLGKVVVVESLDAGIRMARKFGYGFRIVSLDGDILSTTGSISGGSKEKRESGILSRNREISELGESIARLKEDDEAIEKNVEGLIRELEEITDKISFEERSLKDNELVKIRDESHLAQIEENIKRSLARIDMLKQEKEQLIRQEKDTCLELSKYEDELSEIERDIAEKKEVVARYQEKNKEEQSVRDALHNDITDYRISVNSILESMEGVKETLERLVNEKNSLVKAMERKKAEKARNEQEIKALQEKNEGLDKLIKKYEEEKSGKTFEIDRITEEKKIREEESAGIIDQITEINKNILLLQEEYSRIEVKKAKLESEMESIQNRMWDEYELTYTNALELKKDIGSMAQAQKRIAEIRNEIKELGPVNVAAIDEYIKTKERFEFMSAQKSDMEQAEKKLQKVINEMMTIMKRQFMEKFKLINENFNLVFRELFDGGRAELILVDKENVLESGIEIEVQPPGKKLQNLMLLSGGERAFTAIALLFAILRLNPTPFCVLDEIEAALDDANVYKFAQYLKKYSNVTQFAVITHRKGTMEAADTLYGVTMQEHGVSKVVSLKMGEKVG

SEQ ID NO: 9154 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 9155 - protein, 283 aa, Triticum aestivum
MSVVSLLGVNVLQNPARFGDPYEFEITFECLETLQKDLEWKLTYVGSATSNDHDQELDSLLVGPIPVGVNKFIFVADPPDTNKIPDAEILGVTVILLTCAYDGREFFRVGYYVNNEYDSDELNTDPPAKPILEKVRRNILAEKPRVTRFAIKWDSDDSAPPLYPPEQPEADLVADGEEYGAEEAEDEDEEESADGPEVPADPDVMIDDSEAAGAMVETVKATEEESDAGSEDLEAESSGSEEDEIEEDEEREDEPEEAMDLDGAGKRNAAISSSNNTDTTMAH

SEQ ID NO: 9156 - protein, 137 aa, Thermus thermophilus HB8
MERTFVMIKPDGVRRGLVGEILARFERKGFRIAALKLMQISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 9157 - protein, 339 aa, Moniliophthora perniciosa
MVKVGINGFGRIGRIVLRNALQLQDIDVVAVNDPFIDLEYMVYMFKYDSVHGRFDGTVETKDGKLVINGKSIVVYGERDPAAIPWGSVGAHYIVESTGVFTTIEKASAHLKGGAKKVVISAPSADAPMYVCGVNLDTYDSSHTVISNASCTTNCLAPLAKVIHDKFGIVEGLMSTIHATTATQETVDGPSNKDWRGGHGINNNIIPSSTGAPKADSKVIPSLHGKLTGLSFRVPTPDVSVVDLVVRTEKACSYDDIKVAIKEAANGSLKGILTYTEENVVSTDFVGNNASSIFDATAGIQLNKNFVKLIAWYDNEWGYSRRVCDSCRRMTRRWADKWFN

SEQ ID NO: 9158 - protein, 240 aa, Oryza sativa
MAAAAPSRVSVRAAAPGQTGGFAKIRPQVVVAAAARSAGVSGRRARSVRASLFSPKPATPKDARPAKVQEMFVYEINERDRESPAYLRLSAKQTENALGDLVPFTNKLYSGSLDKRLGISAGICILIQHVPERNGDRYEAIYSFYFGDYGHISVQGPYLTYEESYLAVTGGSGVFEGAYGQVKLNQIVFPFKIFYTFYLKGIPDLPRELLCTPVPPSPTVEPTPAAKATEPHACLNNFTN

SEQ ID NO: 9159 - protein, 461 aa, Arabidopsis thaliana
MDPCPFIRLTIGNLALKVPLAAKTTSSVVHPSSSPCFCKIKLKNFPPQTAAIPYIPLETTQFPEIQTLAATFHLSSSDIQRLASRSIFTSKPCLKILIYTGRAGAACGVHSGRLLAKVSVPLDLSGTQSKPCVFHNGWISVGKGAGKSSSSAQFHLNVKAEPDPRFVFQFDGEPECSPQVVQIQGNIRQPVFTCKFSCRHTGDRTQRSRSLPTETSVSRSWLNSFGSERERPGKERKGWSITVHDLSGSPVAMASIVTPFVASPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRRGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 9160 - protein, 331 aa, Ashbya gossypii ATCC 10895
MVKVAINGLGKIGRLVMRIALSRANVEVVAINDPFITVDYAAYMFKYDSTHGKYAGDVQYEGNTLVIDGKKIKVFQERDPAQLPWGEEGIDIAIDSTGVFKELDSAQKHIDAGAKKVVITAPSSTAPMFVMGVNEEKYAGETIVSNASCTTNCLAPLAKVIDEQFGIEEGLMTTVHSLTATQKTVDGPSMKDWRGGRTASGNIIPSSTGAAKAVGKVLPQLNGKLTGMAFRVPTVDVSVVDLTVKLNKETTYDEIKAAIKAASEGKLKGILGYTEDAVVSTDFLGDNNSSIFDASAGIMLSPKFVKLVSWYDNEYGYSTRVVDLVEHVAAN

SEQ ID NO: 9161 - protein, 334 aa, Acidobacteria bacterium Ellin345
MAIKVGINGFGRIGRNVYRAALNDSNIEIVAVNDLTDPKTLAHLLKYDSILGNLHHNISATADAITVDSKSVKVFAEKDPAALDWSALGVQVVVESTGRFTKAADAKKHLKGSVKKVIISAPATDEDITIVLGVNQDKYDASKHHILSNASCTTNCLAPVVKVLHETFGIVSGLMTTIHSYTNDQVILDFPHKDLRRARAAAINMIPTSTGAAKALRLVIPEMAGKLDGFAIRVPTPNVSVVDLTFTAEKPITKDAINEAVKKAAEGELKGILGYETAPLVSSDFKGNSLSSIFDAELTKVLGNTAKVISWYDNEWGYSCRVRDLITFLGNKGL

SEQ ID NO: 9162 - protein, 491 aa, Methanopyrus kandleri AV19
MPRRLQNVYKVPGRGRHQLRIAGKSIPGVSPLADEVYTVDFKKRQKENEEKVEKVMEQVESKDVKFVRLQFVDIHGFVKNFAIPAERLEDALVEGVLFDGSSIDGFVDIEESDMIAMPDPDTFAVLPWRPREGKVARIICDVYWPEGKPFEGCPRLNLKRVMNELAEKGYMMYCGPECEFYLLKQDPETGEVEAHDEGGYFDFYPLDRAEDIRREIIFAMEEFGLEVEMSHHEVGPGQHEIDFKFADAVTTADNVISFKQIVKAIARKHGLIATFMPKPIYGENGNGMHVHQSLWDPEGKENLFYDPDAEDQYYLSDTALYYIGGIMEHAHALCAVCNPLVNSYKRLVPGYEAPVYIAWSPKNRSAFIRVPAARGKATRIEYRSPDPACNPYLAFAAMAVAGVDGIENKIDPGDPVNENLYEMSEEERKELGIEHLPENLRDALEAFKEDEVVQSAFTDHIVEQWLELKWEEWSEYRERVTKWEIKKFIVY

SEQ ID NO: 9163 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 9164 - protein, 339 aa, Triticum aestivum
  misc_feature (110)..(110): Xaa can be any naturally occurring amino acid
  misc_feature (120)..(120): Xaa can be any naturally occurring amino acid
  unsure (1)..(339): unsure at all Xaa locations
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKXAAAHIKGGAXKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 9165 - protein, 546 aa, Oryza sativa
  misc_feature (415)..(415): Xaa can be any naturally occurring amino acid
  misc_feature (543)..(545): Xaa can be any naturally occurring amino acid
  unsure (1)..(546): unsure at all Xaa locations
MGSDADMEDYGFEYSDDEPEEQDVDIENQYYNSKGMVETDPEGALAGFDQVVRMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYTKALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGDRSKGMXEIPSHRQVEYSAEEHLPNGVQQSWVREIAGCLGCTALGTCLHVLLWWMLGFCPELNLSANSNPSETILASMARNFWFCWHCRTSKFWYGRENVWFRVKYAPGTRHTANIVPLPSSDSVANQSLSNQKXXXK

SEQ ID NO: 9166 - protein, 92 aa, Glycine max
MGDFNQAYFPKFVVVLGLSDAAISILMLPADVANRQACRHAIYNGACNLTLPMKDLWLAIYILDAVLVFFVIPFAMFYYEGDQDKSVGKRIK

SEQ ID NO: 9167 - protein, 113 aa, Oryza sativa
  misc_feature (9)..(9): Xaa can be any naturally occurring amino acid
  misc_feature (12)..(12): Xaa can be any naturally occurring amino acid
  misc_feature (25)..(25): Xaa can be any naturally occurring amino acid
  misc_feature (28)..(29): Xaa can be any naturally occurring amino acid
  misc_feature (63)..(63): Xaa can be any naturally occurring amino acid
  unsure (1)..(113): unsure at all Xaa locations
MSAEQPEQXAPXAQEATVQIVYLDXPGXXDPEEFHIRTLAPVLGSEEKAKEAVLYHYKHAASXFSAKLTPQQVEELKSQYSILFFFQNYARLPFFYIENETRGINVFCLHQTN

SEQ ID NO: 9168 - protein, 247 aa, Nocardioides sp. JS614
MTHTLILLRHGESEWNAKNLFTGWVDVNLTEKGRAEAVRGGELMREAGVLPDVVHTSVQRRAINTACLALDAADRHWIPVRRSWRLNERHYGALQGKNKKETLEAYGEEQFMLWRRSFDVPPPPIEEDSEFSQFGLPQYAGLGDDMPHTECLKDVIARFLPYWESDIVPDLRAGHTVLIAAHGNSLRALVKHLDGISDEDIAGLNIPTGMPLVYELDDDFRPTVPHGRYLDPEAAAAAAAAVANQGR

SEQ ID NO: 9169 - protein, 425 aa, Mycoplasma pneumoniae M129
MQQIFFKDPILGEVLFDQQTKWMYELVETEAFRRLRNIKQLGINFHFYPGGVHTRYSHSLGVYELLRRILNTPAFAPIDENKKQTVLVAGLLHDIGHAPHSHAFEIYFAKAPNFKKELFIHEEVTTLFVNSEPIKSILKANQIDPKLVAALIDENKELKPSNYWMRQLISSDLDADRMDYLLRDSYFTGTSHSLIDYQTIIKEMDCVKVKGIYEIFFKDKCLPLIENFLITRHHMYQSIYSDGRSISTELNLWFVFQRIKDLVDKNQFDFNGYKTLEQVCLPLLKNEHFDKKMLPAFVKLDDYVFQSFFVNLYQTTKDKILKKLLDSYLNSLKFEIKFYETKEQRDLDFEKQASKYKDAKYFITKFNNQFKGFYEGWSSHKNELKIKTMQNKHTNLSEISMLVKRSNELFFENALYKWANVFYRL

SEQ ID NO: 9170 - protein, 263 aa, Mycoplasma pneumoniae M129
MNSFYPSRKLGQNFTVDQSVIAKTCRLIKSLNPTALIEVGPGKGALTKALLKLQLPYHGIELDKRLAEYLLVNEILTEEQLTIGDALKQNLDQYFPDTIPLLCGNIPYSISSPLIANFLASKLQQFVLVCQWEFGQRLVAPVNSPNYSAFGVFCQYHLQIKSVFKIDKVAFKPKPQVDSVLMLLKKKPQVAYEAHFGRFLKQCFHQRRKLLVNNLKQLLPPTLLTNVLQQQDLAATVRAQELTPTQLFRLYLSLKPHLSDGKD

SEQ ID NO: 9171 - protein, 189 aa, Oryza sativa
MPADDDDASYLLCAEDAGAAVFDVAVDISTCTTEDDECCSVGGEELYSAASIAELIGGEAEYSPRSDYPDRLRSRSIDPAARAESVSWILKVQEYNGFLPLTAYLAVNYMDRFLSLRHLPEGQGWAMQLLAVACLSLAAKMEETLVPSLLDLQVECSRYVFEPRTICRMEFLILTALNWRLRSVTPFTF

SEQ ID NO: 9172 - protein, 368 aa, Malus x domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVDPETTVLIIGAGPIGLVSVLAARAFGAPRIVIVDMDDKRLAMAKSLGADEAVKVSTKMEDLDDEVAEIKEAMISEVDVTFDCVGFNKTVSTGLNATRPGGKVCLVGMGHGVMTVPLTPAAAREVDVVGVFRYQKTWPLCLEFLRSGKIDVKPLITHRFGFTEKEVEEAFATSARGGNAIKVMFKL

SEQ ID NO: 9173 - protein, 181 aa, Brassica napus
MAYSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 9174 - protein, 214 aa, Pasteurella multocida subsp. multocida str. Pm70
MNQSILSPFGQSEERAIAAINAFKQGNGVLVLDDEDRENEGDLIFPAETITVEQMTMLIRYGSGIVCLCLSDEICQQLDLPPMVTENTSVNKTAFTVTIEAAKGVSTGVSATDRVTTIRAAVADNAKPSDLSRPGHIFPLRAMTGGVLKRRGHTEASVDLARLAGYKAAGVICEITNDDGSMARAPEIVTFAQKFGFPVVTIEDLVAYRQKYDV

SEQ ID NO: 9175 - protein, 318 aa, Oryza sativa (japonica cultivar-group)
MGAMEGAAVDEVVRRLVEGGRGGRQVQLSEAEIRQLCVEAKRVLLSQPNLLRIHAPVKICGDIHGQFVDLLRLFDLGGYPPTSTYLFLGDYVDRGKQSLETICLLLAYKVKYPDKIFLLRGNHEDAKINRVYGFYDECKRRFNVRLWKIFCDCFNCLPMAALIDDKILCMHGGLSPELNSLDQIKDIERPTEIPDYGLLCDLVWSDPSPDSEGWGESDRGVSCTFGADKLVEFLEKNDLDLICRAHQVVEDGYEFFAQRRLVTIFSAPNYCGEFDNAGALLSIDESLMCSFQILKPNDTGAPHSRKPTSNKTPKTGNA

SEQ ID NO: 9176 - protein, 437 aa, Brassica napus
MKGVRKTYDNSYTLSSLFVFFVLIILRPIFSTTTLSSTESLTISSNRTLVSPGNIFELGFFNTTSSSRWYLGIWYKKISERSYVWVANRDNPLSNAVGTLKISGNNLVLLGHSNRSVWSTNLTRENERSPVVAELLANGNFVMRDTNNNRSSRFLWQSFDYPTDTLLPEMKLGYEPKTGLNRFLTSWRSSDNPSSGDFSYKLEARRLPELYLSSGIFRVHRSGPWNGIRFSGIPDDKKLSYLVYNFTENSEEVAYTFLMTNKSIYSRLTVSFSGYLERQTWNPTLGMWNVSWSLPFDSQCDSYRMCGPYSYCDVNTSPICNCIQGFIPSNVEQWDQRVWANGCIRRTRLSCSGDGFIRMKNMKLPETTMATVDRSIGVKECEKKCLSDCNCTAFANADIRNGWTGCVFWTGRLDDMQNYVTDHGQDLYVRLAAADLV

SEQ ID NO: 9177 - protein, 250 aa, Acidobacteria bacterium Ellin345
MSRKKIIAGNWKMHNTPQQSLAFVKAFLPLVADHTRDEIVLCPPYLSLATVVEATKGSNVMVGAQNMHWEVKGAFTGECSPEMLVESGVTHVIIGHSERRQYFNETDDTVNRKLEVALEHGLTPIVCVGEVLEEREAGLTEDVLRRQCSRAFRGISGKKAAKLVMAYEPVWAIGTGKTATPEIAEDAHLVIRGEAAKAFGDDFAHALRIQYGGSVKADNARTLMSQPDIDGALVGGASLDAAGFAKIVKY

SEQ ID NO: 9178 - protein, 714 aa, Arabidopsis thaliana
MTRWSMSMHCTLFLLFLLRLTCIFSDSDYLMGLGSYDITGPAADVNMMGYANMEQVASGVHFRLRARAFIVAEPYKKRIRYGELYTEENVAISGTHTHAGPGGYLQYILYLVTSLGFVHQSFNALVDGIEQSIIQAHENLRPGSILINKGELLDAGVNRSPSAYLNNPAHERSKYEYDVDKEMTLVKFVDDQWGPVGSFNCGDNKGTAARIMEDWFERENGCRSVDVESPRRVSSIISDPYDQDLMEMASSLLSTGGKTVTRMSSVARRVRSRFRHADKPRFVSAFCQTNCGDVSPNVLGAFCIDTGLPCEFNQSTCGGKNEQCYGRGPGYPDEFESTRIIGERQFKKAADLFTKASEEIQGKVDYRHAYVDFSQLEVTINGQNGGSEVVKTCPAAMGFGFAAGTTDGPGAFDFKQGDDQGNPFWRLVRNLLKNPTEEQVRCQRPKPILLDTGEMKQPYDWAILRIGQLVILCVPGEFTTMAGRRLRDAVKTVLKEGSNGREFSVVIAGLTNSYSQYIATFEEYQVQRYEGASTLYGPHTLSGYIQEFKKLANDLLSAQTTDPGPQPPDLLHKQISLLTPVVADMTPIGTAFGDVTSDVPRLSKFRKGADIVRVQFRSANPRNDLMTEGTFALVERWLEGRETWVPVYDDDDFCLRFKWSRPFKLSTQSTATIEWRIPETASPGVYRITHFGSAKTPISSIHHFSGSSSAFVVY

SEQ ID NO: 9179 - protein, 956 aa, Colwellia psychrerythraea 34H
MTNNNLLAQLNDNLDFISRHNGPDRTQQQHMLDTLKVDSIEQMIDKTVPDNIRLLQPMALAKPQSEIEMLATLKGIASKNKVNRSYIGQGYYDTHVPHVILRNVFENPGWYTAYTPYQPEISQGRLEALLNFQQMITDLTAMELSNASLLDEATAAAEAMSLCKRASKNKSNVFFVSDDVHPQTLDVINTRAKYFSFEVVVAPCSELENHDVFGALLQYPGTTGQVHNLEKIIEQAHSKKTLVAVAADLLALTVLKAPGEMGADVVIGSAQRFGVPMGYGGPHAAFMATKEKYKRTIPGRVIGVSIDSKGKPALRMAMQTREQHIRREKANSNICTAQALLANMASFYAVYHGPQGLRKMGRRVNRLTSVLAAGLQKAGIELVHNDFFDTITLQTNEKTDAIYQRALAADLNLRLLPDQLGISLDETTTSADVEALWLAITEQSFNVDDIEQTLSAEFCNIPADCQRTSEYLSHPVFNSYHSETRMLRYLKSLENKDFSLTHGMIPLGSCTMKLNATAQMIPVTWPEFSRMHPFAPSDQCTGYETLAESFSDMLIEITGYDAFSLQPNSGAQGEYAGLIAIQRYHASRGEDYRNICLIPSSAHGTNPASASMVSMRIVLVNCDKEGNVDLDDLKEKINLHRDQLSAMMITYPSTHGVYEESIKEICELIHEAGGQVYLDGANMNAQVGLTSPGFIGADVSHLNLHKTFCIPHGGGGPGMGPIGVKSHLADFLPGHSVTNTVGAVSATALGSASILPISWAYIALMGAEGLKSATELAILNANYIMEKLSPHYPILFRGKQGRVAHECIIDLRPLKESSGISEEDVAKRLMDFGFHAPTMSFPVAGTLMIEPTESESLEELDKFIDALITIRHEIAKVEEGTWTLADNPLVNAPHTLNDLTGSDWPRAYSRLTACYPSSCPSQPKFWPTTNRIDNVYGDRNLICSCPPIESYQSTDT

SEQ ID NO: 9180 - protein, 816 aa, Aspergillus oryzae
MSEARRERKPSQELVRHVETTLARSLYNCDELAAYSGTALAFRDRLIIDWNKTQQRQSSADQKRVYYLSLEFLMGRALDNAMLNVGMKDAARDGLKNLGFRIEDVIDQEHDAALGNGGLGRLAACLLDSLATLNYPAWGYGLRYRYGIFKQEIVDGYQVEVPDYWLDFNPWEFPRHEIAVDIQFYGWVRKYQDDNGKTVHSWQDGETVQAVAYDVPIPGYGTSTTNNLRLWSSKASSGEFDFQKFNAGDYENAVAEQQRAETISAVLYPNDNLERGKELRLKQQYFWCAASLHDIVRRFKKTKRAWAEFPDQIAIQLNDTHPTLAIVELQRILVDLEGLTWDEAWKIVTNTFGYTNHTVLPEALEKWSVPLVQKLLPRHMQIIFDINLFFLQTVEKKFPNDRDLLSRVSIIEESHPKMVRMAHIAIVGSHKVNGVAELHSDLLQTTLFKDFVQVYGPDKFTNVTNGITPRRWLHQANPRLSDLIATKLGGYHFLTDLALLDKLEAFVDDESFRQEWAEIKTANKIRLAKHIKDTTGYSVNPTALFDIQVKRIHEYKRQQLNIFGVIHRYLTIKSMSPEERKKVLPRVSIIGGKAAPGYWMAKTVIHLVNSVASVVNNDPDIGDLLKVIFIQDYNVSKAEIICPASDISEHISTAGTEGSGTSNMKFVLNGGLIIGTCDGANIEITREIGEQNIFLFGNLAEDVEELRHRHYYGDFQLDPQLAKVFDAIRSGTFGNPGDFSALIASIAEHGDYYLVSDDFNSYVTTQNMVDEAFRNQDEWIVKSITSVARMGFFSTDRVINEYADGIWNVEPLAVKD

SEQ ID NO: 9181 - protein, 523 aa, Yarrowia lipolytica CLIB122
MIILYVLAVAVSFLIFKRVTYTMRSRELAKKWHCEEPHNLNEFPLNLPLFFLIINASRRHELLDTLLGLFRSFAPTKTVKQVLLGSFTIIPTNDPENIKAVLATQFKDFCLGQRHGQLAPVLGDGIFTLDGQGWQHSRAMLRPQFARDQVSDVEMIERHVQMMLLRIPNNKKFDIQELFFNLTLDTATEFLFGQTVGSQTVEMPNEDKSTVSDMPKDMRKSFQEDFNVAQHHGGIRTRFQMFYWLWRPTELFSSSKRVHAFVDHYVEKALANSDEEKSDDKYIFLRELAREVKDPRVLRDQALNILLAGRDTTAGVLSWIVYELARHPEVWKKLRAEIHQDFGDGSDLSQITFEGLKRCEYLRFVINETLRLYPSVPLNVRYASRDTTLPRGGGPDESKPILVRKGDTIVYNVFSMHRTEEFWGKDCDEFRPERWAEKGSRGWEYLPFNGGPRICLGQQYALTETSYVITRICQLFTNIENADTAVEPPQKLHALTLCHLNGVFVKMTRDEAAFAETEKLINA

SEQ ID NO: 9182 - protein, 139 aa, Brassica napus
  misc_feature (128)..(128): Xaa can be any naturally occurring amino acid
  unsure (1)..(139): unsure at all Xaa locations
MDTMRISAGAEKIPVKCNSLSSLVTRRWRTKTFPARIRNWRLLSVKSISSNTKTLVTDSEQVASSIKHHSEFRPLFSPEKFELPKAFFATAQSVRDALIVNWNSTYECYNRVNPKQAYYLSMEFLQGXAFVNAVGNLGL

SEQ ID NO: 9183 - protein, 473 aa, Oryza sativa (japonica cultivar-group)
MTVEELDANEKRAFLEWRRNLARLEENEKLVLTPFEKNIDIWRQLWRVLERSDLLVMVVDARDPLFYRCPDLEVYAQEIDEHKRTLLLVNKADLLPLNVRQRWAEYFKQHDILYLFWSAKAATADLEGKKLSSYSMENWNTADLDTKIYGRDELLVRLQGEAEYIVNQKGALRAEEGHESSRSDSVSTRPKHVVVGFVGYPNVGKSSTINALVGQKRTGVTSTPGKTKHFQTLVISEELILCDCPGLVFPSFSSSRHEMVACGVLPIDRMTKHRGAIQVVANRVPRNVLEQIYKITLPKPKAYEQLSRPPTAAELLRAYCTSRGHVSHAGLPDETRAARQILKDYLDGKIPHFELPPGDTDSETDPEETTDLEGSDTAVGATADHCASDEQDEEISQADPNISHVLSDLESFDLASEVSKNSTKKKKEASYKHHKKPQRKKDRSWRVGNDGADGSAVVRVFQKPAVNFATVTG

SEQ ID NO: 9184 - protein, 298 aa, Oryza sativa
MSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 9185 - protein, 461 aa, Bacillus halodurans C-125
MAMVEDTRPEHTYAEQTPRSKSWIEQAKKVMPGGITANIKHFAPYPIVMKKGCGAFITDVDNHQYVDYLLAYGALMLGHGHPEVKQAIDEMFADSGTLLFGAPHPLEVTFGHEIQQLYPSMERLRYTNSGTEATLLAMRIAQAYTNKKRIAKFEGHYHGGYNDVLYSVSPTLSEAGPADAPIPVKESKGMHVTDGEEPLILPFNNLTACERLLRAQQDSIAAVMIEPLQGGFIPATDTFIAGLRELTEELGIVLIFDEVKTGFRIRLGGAQEWYGVSPDLTTLGKVIGAGFPFGIVGGRKDIMEVTSPTTGSDVFDQSQSTFSRAKDVVFHSGTYNGHPLILAAGLKTVDVLKRDIKDVFARTDMLKDELEALFVRKGVPMKAVGIGSIFSVVLTEEDIFNYRDLQASDLQTRKLIDLHLLNEGIYTKPLNRYSLSTAHTEREVERTISAYDRVLSRLFGG

SEQ ID NO: 9186 - protein, 531 aa, Sinorhizobium meliloti
MAPRVLVSDELSETAVQIFRDHGVEVDFQPKLGKDKEKLAEIIGNYDGLAIRSATKVTEKLIAAATNLKVVGRAGIGVDNVDIPAASRRGIIVMNTPFGNSITTAEHAIALMFAVARQLPAADGSTQAGKWEKSKFMGVEITGKVLGVIGAGNIGSIVCARAIGLKMHVIAYDPFLSKERAEEMGVVKVELDELLAQADFISLHVPLTDKTRNILNAEAIAKAKPGVRIINCARGGLVDEKALAEALKAGHVAGAGFDVFEVEPATESPLFGLPNVVCTPHLGASTTEAQENVALQVAEQMSEYLVKGAVTNAINMPSITAEEAPILKPFIRLADVLGAFVGQVTESAIKEIEILYDGSTAAMNTKALTSAALAGLIRPQVADVNMVSAPVMVKEKGVILSEVKRDKTGVFDGYIKLTVKTANQTRSVAGTVFSDGKPRFIQIKGINLDADVGNHMVYITNTDVPGMIGFIGSTLGDAGVNIANFQLGREKQGGDAIALLYVDGPVSEIVLDKLRANEAIRQAKPLVFNID

SEQ ID NO: 9187 - protein, 1103 aa, Ashbya gossypii ATCC 10895
MTNDKRTIDDVDREVTSLLQEADEARERQAQNKRRKRFAPMTQYGTDTVDGEDWEGTPAGYMKRITLKNFMCHEHFELEFGPRLNFIVGSNGSGKSAILTAITVVFGAKASDTNRGVSLKSLIREGCGTARIAIVLANQGLGAFEQGVYGSEITIERTLKRDGQSSHFSIKSENGREVSNKKRDLQRIVDYFSIPVLNPMCFLSQDAARSFLTASTPQDKFRHFMRGTLLEEIDMNLAKAEEILRSSKSNLDYHGENMKALREDYEHAKRLFKEIYSTHDWNERKKTLQGKLCWLNYKENERRLRKFKKRQEEISQKIVACDEKITERNLKIERYKADQDSTHEEVDQKMTSLQDHQIKFEEAEQELGQFREKHEVLKEERRKVEREIASLEVSLKAHRQQVKQLEQELAEALGGSKEQMVTEKRQVDEEIKTLKGNLPSLEDKFQQCRDRELEYSHQRNTAIQQLQTSINLKKQEYRESTANRSQDSYAVYGRNMNRVVAEIRNRRHEFSKPPIGPLGLEVSIKPGYEQWARSIQSIVGPSLGGFVVSTSRDNLLLRQILRKYPDTRNTSIVTYALTEFNYEHGKAHTAHPTISDVLGFSRRDLECLFVDQHRIETIILVDNKDDAYNVLKQSPQNITRALSLKDNRSGFQSSLAPSGGFRLDTIEYQQHLLFARTSGNNNASDTQYLKAVIEEEEGELRRIQTHYASLGSEIKEEGRKLEEQMRSIRSRIVSLELRSKHLKVKIEKEVDTGALDAHKAALNVETSQIAQHRGAIAAINDQLLQLKDEVEPYKRKHESARQLVAKVKEELEDLKEMIRVRSHRIDKMTDDITIYNKKKVAYQEEFQSIQTNVDSFTPVLDSLREDAERHCSEEVAYGSEIPNTEEEVRMEMRIADRHIKQAEKSVGMTQEEVARLLESTREKFYDAQEKYSAVDRALWSLHESLEQRRITLMNNIKSTCREADSDFRTTIRVRNGFSGALNFDTPGALMVLVKTANDETPRNVDTLSGGEKSFSQITLLLSTWSTMRARIIALDEFDVFMDQVNRTIGTRMIMKKFSTNIRTQTIIITPQDIGKIADIRDPGIKIHKMRDPQRRNNSDFYST

SEQ ID NO: 9188 - protein, 576 aa, Rhodospirillum rubrum ATCC 11170
MIHATPLITILVAGLGIAFIFGAIAHRLKVSPLVGYLLAGIVIGPATPGYVADQNLASELSEIGVILLMFGVGLHFSLKDLLSVRAIAVPGAIVQIAFATVLGIGIAHFAGWGLGGGIVFGLALSVASTVVLLRAMQDRRLIDTLRGRIAVGWLIVEDLAMVMALVLLPAVAGALGVGTANGTPSLSLVDVGISLGVTLAKVAAFIVLMLVVGRRVIPWLLHRMASTGSRELFRLAVLVIALGVAFGSATLFGVSFALGAFFAGMVMNESELSGQAAQDTLPLRDAFAVLFFVSVGMLFNPSSVIESPLLFVATLLVIVFGKSVAAFGLVLMFGHSKATALTIAASLAQIGEFSFILAPLGVSLGLMPQQGQDLILAAAIVSILLNPFLFMLLDRYFLHDASASASAAADPPEPAPSSGAADDEDEAAIAVAKPAPVAPASGHAVVVGSGRVGALIGEMLAEREVRRVVIEESESVIEALRGKGVSCHLGNAADPETLALADTIEARWLFVAIPNAFEAGQVVEQARKSNPDLQIIARAHSDAEVEHLKARGASRVVMAERETARGMIAEALLPRL

SEQ ID NO: 9189 - protein, 411 aa, Oryza sativa (japonica cultivar-group)
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 9190 - protein, 488 aa, Pseudomonas aeruginosa PAO1
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFAEAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKASLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 9191 - protein, 234 aa, Bartonella henselae str. Houston-1
MNVQQLKKMAALKALEFVEDDMRLGIGSGSTVNEFIPLLGERVANGLRVTCVATSQYSEQLCHKFGVPISTLEKIPELDLDIDGADEIGPEMTLIKGGGGALLHEKIVASASRAMFVIADETKMVKTLGAFALPIEVNPFGIHATRIAIEKAADNLGLSGEITLRMNGDDPFKTDGGHFIFDAFWGRILQPKLLSEALLAIPGVVEHGLFLGLASRAIVAMADSQIKVLEPFDF

SEQ ID NO: 9192 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 9193 - protein, 285 aa, Oceanobacillus iheyensis HTE831
MAIQWFPGHMAKAKREVEEKLKLVDFVIELVDARAPLSSQNPMLKQVLNNKPKLIVLMKKDLADQEVTKRWVDKFNEDGTQAIDVNVNHKGDIQKVIQQAKLLGQDKMEKLKRKGIQPRPARAMIVGIPNVGKSTLINRLANKKIAKTGDRPGITKQQLWIKVKKDFELLDTPGILWPKFEEEVVGYRLAAIGTIKDQLLPLPDVTAFIIRYMSEHYPNQLKDRYQLEEIEDMVEVFESIGRIRGALESGGQVNYDKVADIVIRDLRVGRLGTITLEQPEDSSNS

SEQ ID NO: 9194 - protein, 571 aa, Oryza sativa
  misc_feature (300)..(300): Xaa can be any naturally occurring amino acid
  misc_feature (307)..(307): Xaa can be any naturally occurring amino acid
  misc_feature (319)..(319): Xaa can be any naturally occurring amino acid
  misc_feature (324)..(324): Xaa can be any naturally occurring amino acid
  unsure (1)..(571): unsure at all Xaa locations
MRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRIAISIILYIELYACWHEDLILESDNLSKLFRRAHLSMGSIXLKSHVFXAILTSLIVMPTXWLRDXSCLSYLSAGGVIASILVVVCLCGVGVVDHVGLENKGTALNLPGIPIAIGLYGYCYSGHGVFPNIYSSLKNRNQFPSILFTCIGLSSILFAGAAVMGYKMFGESTESQFTLNLPENLVVSKVAVWTTVANPITKYALTITPLAMSLEELLPPNQQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 9195 - protein, 272 aa, Staphylococcus aureus subsp. aureus COL
MKTVSQLIDMKQKETKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 9196 - protein, 393 aa, Lactuca sativa
MTGPATRKDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNFFRIGGIAADLPHGWIDKCLDFCDYFLTGIAEYQKLITRNPIFLERVEGVGIIGGEEAINWGLSGPMLRASGIQWDLRKVDHYECYDEFDWEVQWQNEGDSLARYLVRISEMTESIKIIQQALEGIPGGPYENLEIRRFDRVKDTVWNEFDYRFISKKPSPTFELSKQELYARVEAPKGELGIFLIGDKGVFPWRYKIRPPGFINLQILPQLVKRMKLADIMTILGSIDIIMGEVDR

SEQ ID NO: 9197 - protein, 398 aa, Zea mays
MGKSGKKPRESHRQGRGRRASHFCDEDGYDLPSSAYDATPRQNEESSEDNDDTSEATAEDEPERDTEAGEQDQWQGSMPSKFHLYQLSVQSPKGDISYLQKFFLMYVGGRAPLHLQEDFCGTALLSTEWIRTDARRTAIGLDLDLESLEWCLENNLSKIGADGYSRMLLFHGNVLQPMESRLVKQKFTNLVHGLDLNSNNGTGSNSCKQMGLADSKCLANLTMSEADFPARDIICAFNYSCCCLHSRKDLVLYFRHVRSVLSERGGIFVMDVYGGISSERKLRLQRKFPSFTYFWEQDEFDIISRQTRISLHFQGGKKQMLRYAFTYHWRLWSIPEIKDCLEESGFKWVHVWMREMPNTQSGGNAKEYNANRDVKYEESQHFNQGDAWNAYVVGVANV

SEQ ID NO: 9198 - protein, 311 aa, Nostoc punctiforme PCC 73102
MKNEKWNTENILSQKGRVAIVTGSSSGIGYETARVLANKQASVIIAVRNLDKGNKALAKILQQNKDADVKVMELDLANLASVKNFAENFQKNYVRLDLLINNAGVMIPPYSKTTDGFELQFGTNHLGHFALTGQLLERLIDTEDSRIVNVSSGAHSIGKIDFDDLNWEKRSYAKWKAYGDSKLANLYFTYELDRKLKDKGIDTLVTASHPGWTATELQRTAGGVVKYLNGILAQDITMGALPTLRAATEAGLKGAEYFGPNGFMEMRGYPIKVESNELSKDQAIAKKLWEVSEKLTNVKFEFNKKTQSAGK

SEQ ID NO: 9199 - protein, 295 aa, Oryza sativa
MMAAQASSKRGMLLPREAVLYDDEPSMPLEILGYHGNGVGGGGCVDADYYYSWSGSSSSSSSSVLSFDQAAVGGSGGGCARQLAFHPGGDDDDCAMWMDAAAGAMVENTSVVAGGGNNYCHRLQFHGGAAGFGLASPGSSVVDNGLEIHESNVSKPPPPAAKKRACPSGEARAAGKKQCRKGSKPNKAASASSPSPSPSPSPSPNKEQPQSAAAKVRRERISERLKVLQDLVPNGTKVDLVTMLEKAINYVKFLQLQVKVLATDEFWPAQGGKAPELSQVKDALDAILSSQHPNK

SEQ ID NO: 9200 - protein, 358 aa, Aspergillus niger
MSTQNTNAQNLSFVLEGIHRVKFEDRPIPEINNPHDVLVNVRFTGICGSDVHYWEHGSIGQFIVKDPMVLGHESSGVVSKVGSAVTSLKVGDCVAMEPGIPCRRCEPCKAGKYNLCVKMAFAATPPYDGTLAKYYVLPEDFCYKLPESITLQEGAIMEPLSVAVHIVKQAGINPGQSVVVFGAGPVGLLCCAVAKAYGASKVIAVDIQKGRLDFAKKYAATATFEPAKAAALENAQRIITENDLGSGADVAIDASGAEPSVHTGIHVLRAGGTYVQGGMGRSEITFPIMAACTKELNVKGSFRYGSGDYKLAVSLVSAGKVNVKELITGVVKFEDAERAFEEVRAGKGIKTLIAGVDS

SEQ ID NO: 9201 - protein, 149 aa, Oryza sativa
MEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 9202 - protein, 765 aa, Arabidopsis thaliana
MTRFACFLFSTLLLSFSYAAITPTSPLSIGQTLSSPNGIFELGFFSPNNSRNLYVGIWFKGIIPRTVVWVANRENSVTDATADLAISSNGSLLLFDGKHSTVWSTGETFASNGSSAELSDSGNLLVIDKVSGITLWQSFEHLGDTMLPYSSLMYNPGTGEKRVLSSWKSYTDPLPGEFVGYITTQVPPQGFIMRGSKPYWRSGPWAKTRFTGVPLTDESYTHPFSVQQDANGSVYFSHLQRNFKRSLLVLTSEGSLKVTHHNGTDWVLNIDVPANTCDFYGVCGPFGLCVMSIPPKCKCFKGFVPQFSEEWKRGNWTGGCVRRTELLCQGNSTGRHVNVFHPVANIKPPDFYEFVSSGSAEECYQSCLHNCSCLAFAYINGIGCLIWNQELMDVMQFSVGGELLSIRLASSEMAIVSKVSLQGAWRNDLKSEDVSGLYFFEMKTIEIATNNFSLVNKLGQGGFGPVYKGKLQDGKEIAVKRLSSSSGQGKEEFMNEILLISKLQHINLVRILGCCIEGEERLLVYEFMVNKSLDTFIFDSRKRVEIDWPKRFSIIQGIARGLLYLHRDSRLRIIHRDVKVSNILLDDKMNPKISDFGLARMYEGTKYQDNTRRIVGTLGYMSPEYAWTGVFSEKSDTYSFGVLLLEVISGEKISRFSYDKERKNLLAYAWESWCENGGVGFLDKDATDSCHPSEVGRCVQIGLLCVQHQPADRPNTLELLSMLTTTSDLPLPKEPTFAVHTSDDGSRTSDLITVNEVTQSVVLGR

SEQ ID NO: 9203 - protein, 347 aa, Pediococcus pentosaceus ATCC 25745
MKAAVFIEPGKVEVKEVPKPQIDGDNQAIIRIVRASVCGSDLWWYRGISERQTDTFIGHEAIGVVEETSADVDNIQVGDFVVVPFTHGCGHCVACLNGFEGDCLNRKSGDNGGYQAEYMKYEPANSGLVKIPGKPEDYTDAQLASFQTLSDVMATGYHAAQNAEVKPGSTVAVIGDGAVGLCGVIGAKLLGASKIILLSHHEDRAELGKAFGATDIVDTRGDEAIQDVLKLTKENAGADAILECVGATSAIEQAGQIARPGAVIGRVGVPQSEPKSNQLFWKNVGLRGGIASVTKPDKEVLLQAVLDGEINPGQVFTKSFDLDHIEDAYEAMSNRQAIKALLVISDK

SEQ ID NO: 9204 - protein, 680 aa, Aspergillus oryzae
MAAQFTEENVQELKFRLEDATIKCSERCLYQSAKWAAEMLDAIVPIDQYDTDPESPMDIPDTPSTRPNPYLRTQDPVEASLEAQESYKYLLAKSYFDTREYDRCAAVFLPPTIPPVALSTSSPNQKKRQSLTPQKGKSKSSQYAGGKDSNVSRNPYPRLSQKSLFLALYSKYLAGEKRKDEETEMVLGPADGGATVNRELPDLARGLEGWLTERREKGLEDRNQGWLEYLYGVILLKGRNEEEAKKWLIRSVHLNPFHWGAWQELNDLLSSTEDLKQVVDLLPQNIMTLLFHVYCSQELYQATEDTYQALSELETIFPNSAFLMTQRALLYYHSKDFEEASRIFTEILIASPHRLDSLDHYSNILYVMGARPQLAFVAQVATATDKFRPETCCVIGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRVPQSIKALKRALVAGSYYAEDPSQLGGSGRKILDPETLHQIATLYERLGDDEEAAAYMELTLQQESGQMPVEEDASSDNENDDNQSEAGAQKSSRRARQSSTYNQNDDDDDSWHGTGPTVTTSKARLWLARWALRNGDLERADQLAGELCQDGVEVEEAKALMRDVRARREGDE

SEQ ID NO: 9205 - protein, 286 aa, Pediococcus pentosaceus ATCC 25745
MEYVKLNDGNQMPQLGFGVFQVSDLSQAEQAVSDALDTGYRLIDTAAAYDNEEAVGAAIKKSGINRSEIFVTSKLWVDHFTYEKAQQGIEDSLNKLGLDYIDLYLLHQPYGDTAGAWRALIEAQKAGKIKSIGVSNFAPDQLMNLELMSDVKPALNQIEVSPWYQEGEAVGFAQSQDVQVEAWAPFAEGKHNIFSNETIAEIGQKYGKANGQVILRWLLQRGIVVIPKSVHKTRMAENLDVFDFELSDDDMQKMSSLDKNESQFFDHRDPEAIVSIFGESLKALRK

SEQ ID NO: 9206 - protein, 115 aa, Glycine max
MSAINITNVTALDNPAPFVSPFQFEISYECLTSLKDDLEWKLIYVGSAEDETYDQTLESVLVGPVNVGNYRFVLQADPPDPSKIREEDIIGVTVLLLTCSYMGQEFLRVGYYVNN

SEQ ID NO: 9207 - protein, 178 aa, Triticum aestivum
MFASRPAVHPVEAPPPTDPVEQPTGVLMKDLPGMPGTAGGLALRLAQFAFAGVALGVMASTNDFPSVSAFCYLVAATILQCLWSFSLGIVDIYALLVKRCLRNRRAVCLFAIGDGITAALIFGAACSSAGITVLIDNDLNICAENHCGSFETATAMAFMSWFALTPSFLLNFWSMASR

SEQ ID NO: 9208 - protein, 214 aa, Ustilago maydis 521
MSNKVVSQLYRSIIDDVVNNVRQDFEEMGIEKEVLEELQRSWEAKIVATQVAEFEGAPALPPAKSRSSKKQESKNEVKTEDDDANGQNSRSNGADQHRAKVARGDGSTDVADGAADGKGQDGVAGSVKAEDDDAAAGQKRKRISDDDEIGSDLDDSDDEDLDGGVDGDNDDMVLCLYDKVQRVKNKWKCVLKDGVASIDGRDYLFAKCNGEFEW

SEQ ID NO: 9209 - protein, 86 aa, Oryza sativa
MAGAAKASWMVAMSVGAVEALKDQCGLCRWNYALRSIHNAAKANAAGVSQGKKLPASAAAVAERRRAEKAEEGLRTVMYISCWSTN

SEQ ID NO: 9210 - protein, 793 aa, Lycopersicon esculentum
MEVPVRRSNYAILQQQPPYDEFNSDEKSKSRGDKGLYWDLIDRRKGTTPFQASIVLPTQSSEGSFAESSISGVSFGYMNAYSDVGGSLSKSWAQQTEESYQLQLTLALRISTEATCADDPNLLDYVPDESVSHASASSASVEAMSHRFWVNGSLSYFDKVPDGFYFIQGMDPYIWTVCSDLQESGRIPSIESLMAVDPSVVPSVEVILIDRQSDPRLKELQNRIHSMYRSCNTTKEVVDQLAKLVCNHMGGAASVGEGDFIPIWKECCNDLKDCLGCFVFPIGSLSVGLCRHRTLLFKVLADIIDLPCRIARGCKYCKESDAFSCLVRFGLDREYLVDLIRDPGCLYEPNSLLNGPSSISIPSPLRLPRFGQVEPAMDFTSFAKQYFSDCLSLNLAFDDSSAGTAVDGDAGQTDRSSMDKSSAVPSSSNRDEVSRLPLPSINAWNKGCDKGSQLPAKYHPPNMSISMSQEKDLIHLKNVPPIRYVDAHLIAISEARTDTINDQRYFEGVGRLAPAKPSRGLVLDVEDLDIPWNDLVLKERIGAGSFGTVHRADWNGSDVAVKILMEQDFHAERYKEFLQEVAIMKRLRHPNIVLFMGAVTEPPNLSIVTEYLSRGSLYRLLHKPGAREVLDEKRRLCMAYDVAKGMNYLHKRKPPVVHRDLKSPNLLVDTKYTVKVCDFGLSRLKANTFLSSKSAAGTPEWMAPEVLRDEPSNEKSDIYSFGVILWELATLQQPWSNLNPPQVVAAVGFKGMRLEIPRDLNHPVTTIIEACWVNEPWKRPSFSTIMDMLKPLI

SEQ ID NO: 9211 - protein, 837 aa, Lycopersicon esculentum
MEMSTRRSNYTLLSQVADDNYLPPPPKYSVTGGGGGGGGVAPYYESHSGEKGKGKTGDNRGFDWDLSDHRSNMMQASNRIGAAAFPGSIGLQRQSSGSSFGESSISGEYYMPSLSNAEASFGYLNDGGGGAEVRMKPLEANLFGGSSSKSWAQQTEESYQLQLALALRLSSEATCADDPNFLDHVPDESASRASASAASAETLSHRFWVNGCLSYFDKVPDGFYLIHGMDPYVWIVCSDLQENARVPSIESMRAVDPSVVPSVEVILIDRRTDPSLKELQNRIHSLSPTCGTTKEVVDQLAQLVCSHMGGATSAGEDELVPLWKECSYELKDCLGSTVLPIGSLSVGLCRHRALLFKVLADAIGLPCRIAKGCKYCNRADASSCLVRFGPDREYLVDLIGSPGCLCEPDSSLNGPSSISISSPLRFPRFREVEPTTDFRSLAKQYFSDCQSLNLVFEESSAGAAVDGDAGQTDRNNIERNSAVTGPSNRDEVSRLPVPAIRDMAPVKYVRPVLHGDTQLSDPRDIGNDMRFLERGSQLVPSKISRDIALEIEDFDIPWEDLVLKERIGAGSFGTVHRADWNGSDVAVKILMEQDFHAERFKEFLREVAIMKRLRHPNIVLFMGAVTQRPNLSIVTEYLSRGSLYRLLHKPGAREVLDERRRLSMAYDVAKGMNYLHKRNPPIVHRDLKSPNLLVDKKYTVKVCDFGLSRLKANTFLSSKSAAGTPEWMAPEVLRDEPSNEKSDVYSFGVILWELATLQQPWSNLNPAQVVAAVGFKGKRLDIPRDLTPQVASIIEACWAKEPWKRPSFAAIMDMLRPLIKPPVTPPQPGRTDTQLIA

SEQ ID NO: 9212 - protein, 480 aa, Chromobacterium violaceum ATCC 12472
MIPCILSGGAGTRLWPVSRMELPKPFIRMADGHSLLQKTFQRAARLPGVRRVMAVTNQQAMFRTLEECSEVNERQLALELLLEPAGRNTAPAIAAAALDMLERQEGSEAILLVLPADHLVTDEEAFAAAVQEAWELAEAGRIVAFGLKPSRPETGFGYIEQGEPLAGKGFEVARFVEKPDAAAAQAYLDDGRYWWNSGMLCFSALVMCDALARLAPEVLDGVEACLRASPCLSGAGRRQRELDKASFALCPDISIDYAVMEKTDNAAVVPCDLGWSDIGNWDSLMGEFPADGNGNSSSGEVLLCDTRRSFVQSRGRLIATLGVDDLLIIDTPDALLVADRKRSQDVRDIVAELKRRGHPAYLQHRTSQRPWGHYTVLEDGPRYKIKRIVVKPGATLSLQMHHHRSEHWVVVSGTALVVNGEDEKLVHCNESTFIPAGVRHRVANPGVIDLVMIEVQSGDYLGEDDIVRFSDHYGRSESAG

SEQ ID NO: 9213 - protein, 433 aa, Novosphingobium aromaticivorans DSM 12444
MTTNAELWTRREAAVPRGVSSMHQRFFARGENAEAFDAEGNRYIDFATGIAVCNTGHGHPRVLAAVQRQLDAFSHCSFQVTPYENYIELAERLNAIAPIDGPVKSIFFTTGAEALENAVKIARAHTGRRGIITFQGGYHGRTLLTLAMTGKVLPYKARFGPMPGDVFHARFPIPYHGFSEEEAIAGIEALFASAIEPSAVAAIVLEPVLGEGGFYTASYAFFRALREICDRHGILLIADEVQAGFARTGRMFAMDWVREATGVTPDLMTVAKAMAGGFPISGVMGRAEIMDAPDPGGLGGTYGGSPLGCAAGLAVLDVIADEDLCARAVAIGNRIKARLRRMRDNGMTAIGDVRGPGAMIAMELVHDGDPSRPNPDATRALVQEGAREGLLLLSCGLRGNVVRFLPALTMPDALLDEALDRLEIALNRVLGGQ

SEQ ID NO: 9214 - protein, 470 aa, Novosphingobium aromaticivorans DSM 12444
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMAVASAEIFGPVVPVIRFADEPQAIRIANDTPYGLAAYFYARDVGRIWRVMEALEYGMVGVNDGIISTEVAPFGGIKHSGLGREGSRHGLDEYLELKYCLMGGIDR

SEQ ID NO: 9215 - protein, 283 aa, Streptococcus mutans UA159
MSKIQWFPGHMSKARRQVQENLKFVDFVTILVDARLPLSSQNPMLTKIIGDKPKLIILNKVDLADSTCTAEWCNFFEKQGIKALAVNSKEQSAVKKVTEAAKGLMTDKLVKLRERGIQKENLRTMIVGIPNVGKSTLMNRLAGKKIAIVGNKPGVTKGQQWLKSNKNLEILDTPGILWPKFEEEAVGLKLAMTGAIKDNLLPMDEITIFGLDFFKRYYPERLLERYKGIDLEEEAPEIIMSMTQKLGFRDDYDRFYQVFIKDVRDGRLGCYTLDRLAELDGND

SEQ ID NO: 9216 - protein, 228 aa, Novosphingobium aromaticivorans DSM 12444
MPRLILIRHGQSQWNLENRFTGWWDVDVTEKGAAEAFAAGKLLKDKGVLPTLAFTSLQTRAIKTLHLALEAAGRLWVQEDKDWRLNERHYGGLTGLDKAETAAKHGDEQVKVWRRSFDVPPPPLEAGSEFDLASDPRYDGIAVPATESLKDTIARVLPCWEEKIAPALRAGETVIVSAHGNSLRALVKHLSGISDEDITGLEIPTGQPIVYELDNDLAQVERYYLSER

SEQ ID NO: 9217 - protein, 256 aa, Nostoc punctiforme PCC 73102
MAITTQQLIQWKQQGRSIVALTAWDYAIAQLIDAAGVDLILVGDSMAVVLGYDTTLPITLDEMIYHAKSVRRGVKRALVVVDLPFLTYQESLQQAMHSAGRVLKETGAQAVKLEGGYPAIAETIARLVQAGIPVMGHVGLTPQSVHQLGLRQQGKTQEASERILLEAIALEQAGVFSIVLEHIPADLAMQITQKLSIPTIGIGAGTHCDGQVLVTSDVIGLAEKHPPFAKVYTNLRETITKAVQDYAVEVRDRKFP

SEQ ID NO: 9218 - protein, 450 aa, Oryza sativa
MAVARPPRPLPLCSASPLCSARARSSRRRQGRAAWSRRRPPLPIRSRARLPLPPLSPADAASPQPCSPTDAAAPPPRSLPTPPLRLLWPPFWCGGGSFPSGDEVAGEQVRQRRQHADAAGLPLRQRHRQERELLRRRAAASPSPASPRGLLPSCRPACLEKRREEYDAEKLHGSGVAGEDPFARLYASVDADLNECLEKAEAAKQEKNRATVVALNAEIRGTKAKLLEEDLPKLQRLALKKVKGLSKEELAIRGDLVTALPDRIQSIPDGSATSSKKTGLWGSSGSRAGTGIKFDSTYDLEWKLIYVGSAEDENYDQLLESVLVGPVNVGTYRFVLQADPPDPSKIRKEDIIGVIVLLLTCSYMGQEFIRVGYYVNNDNDDEQLREEPPAKLLIDRVQRNILADKPSVTKFPINFHPETSAGAGQEQQQQQQSGSPENHPNQGSKPNPDQ

SEQ ID NO: 9219 - protein, 278 aa, Streptomyces avermitilis MA-4680
MSTKVPPITLNNGVEMPQLGFGVWQVPDDEAERAVATALEAGYRSIDTAAIYGNEEGTGKAIATAGIPRADLFVTTKLWNSDQGYDSTLRAFDVSLEKLGLDYIDLYLIHWPLPTRGQFVETYKAFEKIYADGRAKAIGVSNFLPEHLRTLIDATSVIPAVNQIELHPHLQQHAAREFHAEHGIATEAWSPLGSGKGLLEVPAIVAIARKHERTPAQVVLRWHIQLGNIVIPKSVTPSRIKENIEVFDFSLDDEDIAAISALNEDRRLGPDPATFDMG

SEQ ID NO: 9220 - protein, 377 aa, Anemia phyllitidis
  misc_feature (39)..(39): Xaa can be any naturally occurring amino acid
  unsure (1)..(377): unsure at all Xaa locations
MGDAEEVQPLVCDNGSGMVKAGFAGDDAPRAVFPSIVGXPRHTGVMVGMGQKDAYVGDEAQSKRGILTLKLPIETGIVTNWDDMEKIWHHTFYNELRVAPEEHPVLLTEAPANPKANREKMTQTMFDTFNVPAMYVAIQAVLSLYASGRTTGIVLDSGDGVTHTVPIYEGYALPHAILRLDLAGRDLTDALMKILTERGFSWTTTAEREIVRDMKEKLAYVALDFEQELETAKSSSSLEKSYELPDGQVITIGAERFRCPEVLFQGSLIGMEYAGIHETTYNSIMKCDVDIRKDLYGNVVLSGGSTMFPGIADRMSKEITALPPSSMKIKVVVRPERKIRVWIGGSILASLGTFQQMWIAKSEYDESGPSIVHRKCF

SEQ ID NO: 9221 - protein, 377 aa, Anemia phyllitidis
  misc_feature (266)..(266): Xaa can be any naturally occurring amino acid
  unsure (1)..(377): unsure at all Xaa locations
MGDAEEVQPLVCDNGSGMVKAGFAGDDAPRAVFPSIVGRPRHTGVMVGMGQKDAYVGDEAQSKRGILTLKYPIEHGIVTNWDDMEKIWHHTFYNELRVAPEEHPVLLTEAPLNPKANREKMTQIMFDTFNAPAMYVAIQAVLSLYASGRTTGIVLDSGDGVTHTVPIYEGYALPHAILRLDLAGRDLTDALMKILTERGYSFTTTAEREIVRDMKEKLAYVSLDFEQELETAKSSSSLEKSYELPDGQVITIGAERFRCPEVLFQXSLIGMESAGIHETTYNSIMKCDVDIRKDLYGNVVLSGGSTMFPGIADRMSKEITALAPSSMKIKVVAPPERKYSVWIGGSILASLSTFQQMWIAKSEYDESGPSIVHRKCF

SEQ ID NO: 9222 - protein, 230 aa, Photobacterium sp. SKA34
MKNTRIVLLRHGQSVWNKENRFTGWANVSLSELGETEARNAGIKLKENGFNFNFCYTSMLDRAIKTSNLALEQLDSLWIPVEHDWQLNERHYGDLQGLNKTETAEEFGDEQVHIWRRSYDIEPPQVSEDSFFYPGNDRRYQELQHSQLPHGESLKDTYDRVIPFWNENIVPNVKQGSDILIAAHGNSLRALIKYLDNIPDDKITELEIPTGAPLVYEFNKQMKPVQSYYL

SEQ ID NO: 9223 - protein, 248 aa, Clostridium acetobutylicum ATCC 824
MRTPIIAGNWKMNNTISESLKLIEELKPLVKDAKAEVVVAPTAVSLETVVNATKGSNIKVAAQNAHFEESGAFTGEISLKALEELGVSYVILGHSERRQYFNETDCALNKKVKAAFAHNITPILCCGETLEEREANVTNEVTGKQIKLDLAGLSAEQAAKVVIAYEPIWAIGTGKTATDEQANETIGAIRKTVEVMFGKEVAEKVRIQYGGSVKPNTIKAQMAKPEIDGALVGGASLKAADFAAIVNF

SEQ ID NO: 9224 - protein, 365 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATY

SEQ ID NO: 9225 - protein, 742 aa, Aspergillus nidulans FGSC A4
MYHDHPVRSVQDLIGFSGLISHAIRHPLDFHYSVGPTLSELSGGLLSSSFEPERDLPGLSGKVIFVTGGNTGLGKETVLQLARHRPERIYLAARTAIKATNAIASIQEALPCRADIRHIPLDLASFASIRAAAKQFQAECERLDILILNAGVMGHPPSLTEEGYEIHLGTNHIGHFLLTKLLLPTLRETVSRSESPDVRVITLSSLAANTAPSYDSITSTPALLSLGWASRYGASKAANVLFAAELARRHPEILSVSVHPGAVVTDLYQQTKKAGLFYEAGVGLMMKFFRSIRTGALTQIWAAAAPREQLINGGYYVPIAVKGVSRYHQYLPDLSLPRFQVMRNQDAHEYAEAFKKGRNPPWLHALYTHWKDLAQEPFKGVTTDGNVRPNLFTLQDEQVPIDTIVSATKHLFSLLSPDQQQTLSYHIDSPEWRTWSNPEFLLSHKGLRLDEVNPEIRDAILAVLQATLSPEGYDKAIKAMRINHFLGELVESPRVMNEYSYNFVLFGNPSTTRPWGWSFYGHHLCLNIFLYKSQIVASPWFTGAEPNLIDSGPYSGTRILHVEETLGLKLMQSLPPHIQRKAQTYALMKDPAMPPGRWNRDDQRHVCGAYRDNRIVPNEGVPVTLFTEDQKATLYEILNQYLLYLPTYARALRIAHIKQYESETYFSWIGGYGDHDPFYFRIQSPVILVEFDHHSGVFLNNEEPKKFHIHTLLRTPNGGDYGFALRPLVPPIEDANGKEISW

SEQ ID NO: 9226 - protein, 624 aa, Zea mays
MGVPPGGRKFPLPRGGRDTAQQNQNGTSSRRDRTASPSHSTPVHHRSHSPAAVGPSMATAAHSLLHTPEAHRAATRSPFSPPAPTPFLHLRPHRLPLRLRSTSPTASDLTAFPPNPNGIFASDRPIDVDAATEAELRENGFRSTRRTKLVCTVGPATSRPDQLEALAVGGMNVARLNMCHGDREWHRAAIRAVRSLNEEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKDWLDIDFGIAEGVDFIAVSFVKSAEVIRHLKSYIAARSRGSDMAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 9227 - protein, 366 aa, Nocardioides sp. JS614
MTVTAAVSREKGAPLVVEELELDAPRSTEVRVRMVGSGICHTDAVARDRIYPVPEPSVFGHEGSGVVEEVGSDVRGVQVGDHVVLGPSYCGKCTFCRSGEPMYCENGFPELFGCRRHDGTTAFSKDGEMVGSHFFGQSSFATHANVTENSVIVVDKDAPLELLGPLGCGLNTGAGAVLNEMRPAAGSSIVVFGTGAVGFAALMAAAAVSCSTIIGVDIHDSRLELARELGATHTINSSSQDLHAELEKITGGRGVNYALDTTARSSVVRDAADALGKRGVLIAVGAAAPGDEVSFEVGNSLVKGWTFKTVIEGSAVPQVFIPRLVDLWKQGKFPFDKLVKTYSLHDINTGFEDSASGAVIKPVVAY

SEQ ID NO: 9228 - protein, 227 aa, Haemophilus influenzae Rd KW20
MELVFIRHGFSEWNAKNLFTGWRDVNLTERGVEEAKTAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 9229 - protein, 451 aa, Staphylococcus aureus subsp. aureus MSSA476
MCIVSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 9230 - protein, 359 aa, Clostridium thermocellum ATCC 27405
MGKKTVIPFGPQHPVLPEPIHLDLVLEDETVVEAIPSIGYIHRGLEKLVEKKDYQQFVYVAERICGICSFMHGMGYCMSIENIMGVQIPERAEFLRTIWAELSRIHSHMLWLGLLADALGFESLFMHSWRLREQILDIFEETTGGRVIFSVCDIGGVRRDIDSEMLKKINSILDGFEKEFSEITKVFLNDSSVKLRTQGLGVLSREEAFELGAVGPMARASGIDIDMRKSGYAAYGKLKIEPVVETAGDCYARTSVRIREVFQSIDLIRQCISLIPDGEIKVKIVGNPSGEYFTRLEQPRGEVLYYVKANGTKFLERFRVRTPTFANIPALLHTLKGCQLADVPVLILTIDPCISCTER

SEQ ID NO: 9231 - protein, 556 aa, Glycine max
MVNPRIPRSRIPTFTLFTSAISIALCIFFVLSFLFTSHSYSSHQYHNAGSDGGVAHGFESIRRSILALKTDPLKPRLDQIRKQADDHRSLALVYSSYARKLKLESSKLVRIFAELSRNFSDLMNKPQYRTLFSNDASPADESALRQLEKEVKERIKTTRQVIGDAKESFDNQLKIQKLKDTIFAVNEQLTKAKKQGAFSSLIAAKSIPKSLHCLSMRLMEERIAHPEKYSTEGKPTPPEVEDPNLYHYALFSDNVVAASVVVNSATKNAKEPWKHVFHVVTDKMNLGAMQVMFKLKNYNGAHIEVKAVEDYKFLNSSYVPVLKQLESANLQRFYFENKLENATKDTTNMKFRNPKYLSILNHLRFYLPEMYPKLHKILFLDDDIVVQKDLTGLWKIDMDGKVNGAVETCFGSFHRYAQYMNFSHPLIKAKFNPKACAWAYGMNFFDLDAWRREKCTEEYHYWQNLNENRTLWKLGTLPPGLITYYATTKPLDKSWHVLGLGYNPSISMDEINNAAVVHFNGNMKPWLDIAMAQFKPLWTKYVDYELDFVQACNFGI

SEQ ID NO: 9232 - protein, 142 aa, Paxillus involutus
YIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMI

SEQ ID NO: 9233 - protein, 142 aa, Paxillus involutus
  misc_feature (17)..(17): Xaa can be any naturally occurring amino acid
  unsure (1)..(142): unsure at all Xaa locations
YIMLKPDGVDRGLIGEXLARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 9234 - protein, 193 aa, Zea mays
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGPGQQQQQQEPQTTSPENHTGNGEANGSKPEADQ

SEQ ID NO: 9235 - protein, 311 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMASFL

SEQ ID NO: 9236 - protein, 65 aa, Arabidopsis thaliana
  misc_feature (13)..(13): Xaa can be any naturally occurring amino acid
  misc_feature (31)..(31): Xaa can be any naturally occurring amino acid
  misc_feature (34)..(35): Xaa can be any naturally occurring amino acid
  misc_feature (39)..(39): Xaa can be any naturally occurring amino acid
  misc_feature (47)..(48): Xaa can be any naturally occurring amino acid
  misc_feature (57)..(57): Xaa can be any naturally occurring amino acid
  unsure (1)..(65): unsure at all Xaa locations
MASSMLSSATMVXSPAQATMVAPLNGLKSSXAFXXTGKXNNGITSIXXNGGRVKCMXVWTTIGKK

SEQ ID NO: 9237 - protein, 837 aa, Triticum aestivum
LSMEFLQGRALTNAIGNLELTGQYAEALKQLGQNLEDVASQEPDPALGNGGLGRLASCFLDSMATLNYPAWGYGLRYRYGLFKQIITKDGQEEVAENWLEMGNPWEIVRNDVSYPLKFYGKVVEGTDGRKHWIGGENIKAVAHDVPIPGYKTKTTNNLRLWSTTVPSQNFDLGAFNAGDHVKANEAHLNAEKICHVLYPGDESSEGKILRLKQQYTLCSASLQDIISRFESRAGDSLNWEDFPSKVAVQMNDTHPTLCIPELMRILMDVKGLSWNESWSITERTVAYTNHTVLPEALEKWSLDIMQKLLPRHVEIIERIDEELMNTIVSKYGTADISLLKQKLKDMRILDNVDLPASVAKLFIKPKEEKGKLLVESLESIAEADEKTESEEEENILSETTEKKGESDSEEAPDAEKEDPEYELDPFTKYDPQLPRVVRMANLCVVGGHSVNGVAEIHSEIVKQDVFNSFYEMWPTKFQNKTNGVTPRRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGMEASGTSNMKFAMNGCILIGTLDGANVEIREEVGEENFFLFGAHAPEIAGLRQERAEGKFVPDPRFEEVKEYVRSGVFGTSNYDELMGSLEGNEGYGRADYFLVGKDFPSYIECQQKVDEAYRDQKLWTRMSILNTAGSPKFSSDRTIHEYAKDIWDISPVIMP

SEQ ID NO: 9238 - protein, 743 aa, Cryptococcus neoformans var. neoformans JEC21
MPPRTKVQSSGLGKALINRKAKEAVAPKESQLYTLDDNNPLASVTHERDLDEFLANAALADQDFTTERTKLRVISAPNMPTPSTNPFLLSAEEEKEVTKKKRDFQGDLTVPRRPPWTRQMTRLELEKQERESFLEWRRDIAKLAETSNLLLTPFERNVQLWRQLWRVLERSQLVVQIVDARNPLGFRCQDLENYVKEIGSDENDEEITVAGKGKRRSLLLINKADLLTYDQRSAWAEYFEKEGISYAFFSAANAAAAQEQAEKQRLRQQEEYDGPKGSSEENEEESEEQQDETEDEQDETEEEHLINDLRETHLDEEDWSSESAGRSGNVSRSEVDEKLAEGQTLSLSEVAQDVGARFGESTEQEDVRTRVLTVTELEDLFINAAPDLKDFATPQHPNPKLMVGLVGYPNVGKSSTINSLLGAKKVSVSATPGKTKHFQTLVLSDTITLCDCPGLVFPQFANTQADMVVDGVLPIDQMREYSAPVDLLCKRIPREILEGTYGIRIDVKDEEEGGTGKVGWEEFLSAYAIARGMTRSSFGMPDTSRAARYVLKDYVNAKLLFAHPPPGIDADDFMSVSRAETIARIEESYENGRKRAPVTHVSKNADTYVQPASAKAKDSLDDETEQGQDQTKRERQSTSRQVKSTAASAPARSGREKASALDSVYFNESGAQPRLVIKGRNQPGDAQEGGQGFSRTTRYPHQRLLGPDGMPILGAGGRDLGGANGKKHFKRKEGKKRSGKGYD

SEQ ID NO: 9239 - protein, 334 aa, Glycine max
MTSVARQPTWKERENNKRRERRRRAIAAKIFSGLRMYGNYKLPKHCDNNEVLKALCNEAGWTVEADGTTYRKGCKPPVERMDIVGGSAAASPCSSYHPSPCASYNPSPGSSCLPSPRASPFPPNPNADGNSLIPWLKNLSSGSSSASSSKLPQLYIPNGSISAPVTPPISSPSSRKPQIRADWEDQSNCPTAWGGLAYTFVPSSTPPSPGRQVAETDWFSKIRIPQGGLAPTSPTFSLVSSNPFGLKEDAMVGSGSRMWTTPGASGTCSPAVAAGSENTSDIPMAEAVSDEFAFGSSSSGLVNAWKGERIHEASFGTDDLELTLGSSKTRLLHK

SEQ ID NO: 9240 - protein, 305 aa, Burkholderia xenovorans LB400
MNASRTPPPAAAATATQADWRIDRERAVALFGPHAHDWPIEIVEETGSTNADLMARVKALPRKAGALPRPIVRVAYLQTAGRGRRGRPWYAEPGNALLFSVACVLPRPLEGLAGLSLAVGVALVDGLRSLPVAGPGQIALKWPNDVLLEGDKLAGILIETAWSTENASAVVIGIGTNVKGAAELAAKVDALNAGTPPQARGTMPTALQRALPNANLTDTLAAELNALEPALQRFGAEGFAPFQARWNAVHAYAGREVVLLEQGEEQMRGVAAGVDEQGQLLLDTASGRQTVATGDVSLRLADGAA

SEQ ID NO: 9241 - protein, 330 aa, Triticum aestivum
MAAAGDDDLQLQHAAVPIPCVTLNTGHAMPVLGFGTGSSRAPADLPDTIVHAVRLGYRHLDTAAMYGTEPAVGVAVAEAVRSGAGGISSREDLFVTSKLGIPDARPGRVVPALRESLGRLGVDYLDLFLVHWARRRGTTPRTKSTHTEFDMEGVWRGMEECHRLGLARSVGVSNFSAAKMERLLALAAVPPAVNQVELNVGWRQEKVREVCARHGVVVSAYSPLGAYGASWGSDAVMHSGVMHHVAAAKAKTVAQVALRWVYEQGVCFVARSFNKERLKQNMDIFVDWELSDEDKAMIATIPQKRACQGDYFVSPDGPYKSLEELWDGEM

SEQ ID NO: 9242 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 9243 - protein, 480 aa, Vibrio parahaemolyticus RIMD 2210633
MTSKLRRTKIVTTLGPSTDKDNVLEEIIKAGANVVRMNFSHGTSEDHIQRAKKVRAIAARLGRQVAILGDLQGPKIRVSTFKDGKITLKVGDKFTLDSDLPKGEGNQESVGLDYKELPQDVSPNDILLLDDGRVQLQVTSVEGNKVHTRVTVGGPLSNNKGINKKGGGLSADALTEKDKADIITAAEIKVDYLAISFPRNGEDMHYARRLARDAGLEAKLVAKVERAETVATSESIDDIILASDVVMVARGDLGVEIGDPELIGVQKKLIRRARSLNRVVITATQMMESMINSPMPTRAEVMDVANAVLDGTDAVMLSGETAAGQYPVETVKSMADVCIGAEKMSEASLSTYRLDRTFETAEETIAMATMYSANHMEGIKAMIALTESGRTALMMSRLSSGLPIFALSRNESTLNRAALYRGVTPVYFDAKCDAGLPTAQAAISSLKDQGYLHEGDLVIITQGDVMDVVGSTNCMRILPV

SEQ ID NO: 9244 - protein, 166 aa, Triticum aestivum
  misc_feature (38)..(38): Xaa can be any naturally occurring amino acid
  misc_feature (60)..(60): Xaa can be any naturally occurring amino acid
  unsure (1)..(166): unsure at all Xaa locations
MLQGSGISNQKTLYEVLSVPEDATYDEIRAAYKCAALXTLEPSVSTGEQHGFFSVQKAWXETLRYPKCRAEYDKQLQSSRQSLDVIATDIEIEDMIVESSGDGVELLYACRCGDYFSITACELGEMGISVSEDGEIEAQAPDSLPTSVVLGCGSCSLKTRLVINKT

SEQ ID NO: 9245 - protein, 270 aa, Bacillus licheniformis ATCC 14580
MNKIGFIGYGSMAQMIAVKLLDQGKIRDDMVVVSSRNDGKTEELKKLYPNVACQSADELAKQCGLIFICVPPMAVKETLEKIQPFLQEDVHIVSIAAGVELDRLHDWTSGQVTRYIPTLTSEAGIGVSLVVHGERVAEADKSRLEEYLSAFSTVKQINERDIDAASNLTSSSPGFIASIFEEFAQAAVRNSSLTKEEAFQFLIHSLLGTGKLLMEKDMTFAQTLDRVATKGGITAEGAEVIQDAMPEVFDELFARTMKKYEVIKDAVRRQ

SEQ ID NO: 9246 - protein, 255 aa, Oryza sativa
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 9247 - protein, 774 aa, Ashbya gossypii ATCC 10895
MAPKASGGVGSGTKKKAGSDTNSEKKTSSKPKLPALYITRPVGNDITKRSTVAVLSPEVLQASEFRVGEICLVAKEGQRGVAAIIQSGSEDQPAAVVQLAAPLRAVGGVLLGDRVTVRKLPVQPSYATNVTVASLEGHVLGSGTKAIEKLLNDAGIIMPGQIFKDVLLDESSGLRGNIVVTDINSNADLADEVAKLAVTDSADVDVCLSPPGLFLKGKTTVFYSQSHQVHQRFRLPQRINYQSVGGLSKEIQQLKETIEAPLCDGEFYHECGVEPPRGILLHGPPGTGKTMLLRCVANENDAHVQIINGPSLTSKFLGETKKRLRAIFDEARQFQPSIILIDEIDSIAPSRDSDDAGEAESRVVATLLTLMDGVDSSGSIVVVATTNRPNKIDPALRRPGRFNVEVEIGVPDAAARLEILMKQVSRMAESRRGFTDQDIAEIAAKTHGYVGTDLSGLCALAVGKSKHRAVKQEIPLSQVKISLCDFEAALLEVKPSAMREIFLETPKVYWSDIAGQDQLKREMEEVIELPLKGAEKLKRLRITPPKGILLYGPPGCSKTLTAKALATESGFNFFAIKGPEVLNKYVGETERTVRELFRKAKVAAPSIIFIDEIDELAKTRDEDAGSSAAANVLITLLNEIDGVEELNGVVVVAATNKPHIIDSALIRSGRLDKHIYVAPPDFEARLQILRNNTRTFGLDDPDAILKRLAEQTAHCSGAAVAQLCRDAAIAATREDYEGGNVEERHFLEALPRLTRDVTPDVLLPYQTFAEKRGI

SEQ ID NO: 9248 - protein, 109 aa, Methylobacillus flagellatus KT
MSQIVIESKPSATRLEQLGVSKWPTWSKEVSTFPWVFPEQEIAYVLEGEVVITPDGGGAPVTFRKGDLVTFPAGLRCTWEVKQPLRKHYQLDGTLVGRIYRRIKLFFTR

SEQ ID NO: 9249 - protein, 337 aa, Salmonella typhimurium
FFLFDDIRFGASISGSHVAIDDIEGAWNSSTKYEGGNKGHRPGVKGGYFPVPPVDSAQDIRSEMCLVMEQMGLVVEAHHHEVATAGQNEVRTRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 9250 - protein, 260 aa, Synechococcus sp. WH 7805
MAQALVRPLVESGSLRGSDLIAVVGQEPSVARLKPELPSEITLISASDPRVHEAWEAPVQLLAVKPQQLDRVAESASTPPAGHAPLLISVLAGVTLERLQSTFPSRVCVRAVPNTPCLVAEGLCGLAWGRDVSPEQKAWVRRMFEPVSEVLELPESQLDAFLALTSSGPAYVALMAEAMADGAVAAGLPRVLAHHLAHRTLAGTAALLQEQELHPGQLKDMVASPGGTTMAALRRLEQAGVRSALIEAVVAAAEHGRALR

SEQ ID NO: 9251 - protein, 317 aa, Arabidopsis thaliana
MWPFWWKGASGFSARSTAEEVTHGIDGTGLTAIVTGASSGIGEETTRVLALRGVHVVMAVRNTDSGNQVRDKILKEIPQAKIDVMKLDLSSMASVRSFASEYQSLDLPLNLLINNAGIMACPFLLSSDNIELQFATNHLGHFLLTNLLLERMKKTASESNREGRIVIVSSEGHRFAYREGVQFDKINDEARYNTLQAYGQSKLGNILHATELARLFKEQGVNITANSLHPGSIMTNLLRYHSFINTIGNAVGKYVLKSIPQGAATTCYAALHPQAKGVSGEYLMDNNISDPNSQGKDKDLAKKLWEFSLRLTGEEES

SEQ ID NO: 9252 - protein, 215 aa, Haemophilus influenzae Rd KW20
MNQSILSPFGNTAEERVLNAINAFKNGTGVLVLDDEDRENEGDLIFPAETITPEQMAKLIRYGSGIVCLCITDERCQQLDLPPMVEHNNSVNKTAFTVTIEAAKGVSTGVSAADRVTTIQTAIADNAVLTDLHRPGHVFPLRAANGGVLTRRGHTEASVDLARLAGFKEAGVICEITNDDGTMARAPEIVEFAKKFGYSVLTIEDLVEYRLAHNI

SEQ ID NO: 9253 - protein, 275 aa, Burkholderia mallei ATCC 23344
MSNSRQHQGHFARKRFGQNFLVDHGVIDAIVAAIRPERGERMVEIGPGLGALTGPVIARLATPGSPLHAVELDRDLIGRLEQRFGELLELHAGDALTFDFGSIARPGDEPSLRIIGNLPYNISSPLLFHLMSFAPVVIDQHFMLQNEVVERMVAEPGTKAFSRLSVMLQYRYVMDKLIDVPPESFQPPPKVDSAIVRMIPHAPHELPAVDPAVLGEVVTAAFSQRRKMLRNTLGGYRDLVDFDALGFDLARRAEDIGVDEYVRVAQAVASARASG

SEQ ID NO: 9254 - protein, 990 aa, Arabidopsis thaliana
MTTIPFCFLFVAFFFSSSTADQRHHSRHLLHQPFFPVVTAAPPPYQPPVSSQPPSPSPHTHHHHKKHLTTTTPPPHEKHLFSSVANPPPPPPSPPHPNPFFPSSDPTSTASHPPPAPPPPASLPTFPANISSLLFPTHNKQSKPPSNGHIARLVTITASVISAAALLSLFAVFIIFIRRTRHRRRSSPADDTKSTRSDALQLFNASPSDGSKKQKQHQQPPKYTSSHTSSEFLYLGTLVNSRSNGLEQQKSPISLSGGITGVLELPPPASSSSSSSYSQYHKLGSPELRPLPPLPKLQSFTPVYKSTEQLNPKRQDFDGDDNENDEFFSPRGSSGRKQSPTRVSDVDQIDNRSINGSGSNSCSPTNFAPSLNASPGTSLKPKSISPPVSLHSQISSNNGIPKRLCPARPPPPPPPPPQVSEVPATMSHSLPGDDSDPEKKVETMKPKLKTLHWDKVRASSSRVMVWDQIKSNSFQVNEEMIETLFKVNDPTSRTRDGVVQSVSQENRFLDPRKSHNIAILLRALNVTADEVCEALIEGNSDTLGPELLECLLKMAPTKEEEDKLKELKDDDDGSPSKIGPAEKFLKALLNIPFAFKRIDAMLYIVKFESEIEYLNRSFDTLEAATGELKNTRMFLKLLEAVLKTGNRMNIGTNRGDAHAFKLDTLLKLVDIKGADGKTTLLHFVVQEIIKFEGARVPFTPSQSHIGDNMAEQSAFQDDLELKKLGLQVVSGLSSQLINVKKAAAMDSNSLINETAEIARGIAKVKEVITELKQETGVERFLESMNSFLNKGEKEITELQSHGDNVMKMVKEVTEYFHGNSETHPFRIFAVVRDFLTILDQVCKEVGRVNERTVYGSMPLHSPSNQTATPLFPVANLNRFWQIVASCYHRALYCGFLAKKMSGVGEKASGTTKTPADFLKSIRGKPVVVKLNSGVDYRGILTCLDGYMNIAMEQTEEYVNGQLKNTYGDAFVRGNNVLYISTTKGTLSDGA

SEQ ID NO: 9255 - protein, 659 aa, Kluyveromyces lactis NRRL Y-1140
MGNSGSKPSKKASKSKKIESASSNGSKSRSSSKASEVSSKKDTSPQLQKSDTMQSNKSGRSIRSLKSRRSQSQLQSPSNPGTPKLSANNHETSLSRKNSSTLPLSRHGSSQSASKEDERNGQTLKTARSSSFSTTGDLPPSMVQMAPKTPILKGSTNNPLYYENALTDDDYDDNNDDSISYKSSSSRHRSSARRASSSSRRRSNGSAHHLEVPQSGNSISMVNHGNSTSGSPIQMSRSSSRSSTHSRKSSMSMGQYSTPMASPGLNAMDPDVQDYFDTAGASQREIDDGNGNDYRGVSNGGTDDHPEGLGNDVELNAEGKPKKKKPIKPIDIDETIQKLLDAGYSAKKTRSVALKNSEITQICQMAREIFLSQPSLLELSPPVKIVGDVHGQYADLLRLFTKCGFPPSANYLFLGDYVDRGKQSLETILLLLCYKIKYPENFFLLRGNHECANVTRVYGFYDECKRRCNIKTWKTFIDTFNALPLAAIVAGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLEPLDSTALKQVMKKGRQERKLANQQQQQQQQQQLEQIQE

SEQ ID NO: 9256 - protein, 384 aa, Saccharomyces cerevisiae
MSETELRKRQAQFTRELHGDDIGKKTGLSALMSKNNSAQKEAVQKYLRNWDGRTDKDAEERRLEDYNEATHSYYNVVTDFYEYGWGSSFHFSRFYKGESFAASIARHEHYLAYKAGIQRGDLVLDVGCGVGGPAREIARFTGCNVIGLNNNDYQIAKAKYYAKKYNLSDQMDFVKGDFMKMDFEENTFDKVYAIEATCHAPKLEGVYSEIYKVLKPGGTFAVYEWVMTDKYDENNPEHRKIAYEIELGDGIPKMFHVDVARKALKNCGFEVLVSEDLADNDDEIPWYYPLTGEWKYVQNLANLATFFRTSYLGRQFTTAMVTVMEKLGLAPEGSKEVTAALENAAVGLVAGGKSKLFTPMMLFVARKPENAETPSQTSQEEATQ

SEQ ID NO: 9257 - protein, 457 aa, Shigella flexneri 2a str. 301
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 9258 - protein, 313 aa, Brucella melitensis 16M
MSHGEAPLKIFVFGSVNVDVSARMAALPRPEQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 9259 - protein, 469 aa, Streptomyces viridochromogenes
MFQNADEAKKLIADEDVKFIDVRFCDLPGVMQHFTIPASAFDPAEELAFDGSSIRGFQAIHESDMAVRADLSTARVDPFRRDKTVNINFFIHDPITGEQYSRDPRNVAKKAEAYLASTGIGDTGYFGPEAEFYVFDSVRLANSATESFYHIDSEAGAWNTGALENNRGYKVRYKGGYFPVPPVDHFADLRAQISLELDRAGLQVERHDHEVGTAGQAEINYKFNTLLAAADDLQLFKYIVKNVAWQNGKTATFMPKPIFGDNGSGMHVHQSLWTGGQALFYDEAGYAGLSDTARYYMGGILKHAPSLLAFTNPTVNSYHRLVPGFEAPVNLVYSQRNRSAAMRIPITGSNPKAKRVEFRAPDSSGNPYLAFSALLLAGLDGIKNKIEPAEPIDKDLYELAPEEHAGVPQVPTSLPAVLDRLEADHEFLLAGDVFTPDLIETWIDYKRTNEIAPLQLRPHPYEYEQYYDV

SEQ ID NO: 9260 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 9261 - protein, 182 aa, Glycine max
RVCLCLVAVIVATMWSQNAAQSGCTNTLTSLSPCLNYIMGSSSTPSASCCSQLSSIVQSSPQCLCSVLNGGGSTFGITINQTLALSLPGACEVQTPPVSQCQAGNGPTTPSTAPVGSPSGSSAESPQGSITPSALDFPSGAGSKTVPSIDGGSSDGSAIKVPSHLVLYLLALVSCALTFTKF

SEQ ID NO: 9262 - protein, 389 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHNTCLKTWGGKEENVKAAQDILLARAKANSLAQLGKYTGEGESEEAKEGMFVKGYTY

SEQ ID NO: 9263 - protein, 270 aa, Corynebacterium glutamicum
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKH

SEQ ID NO: 9264 - protein, 159 aa, Zea mays
  misc_feature (20)..(20): Xaa can be any naturally occurring amino acid
  misc_feature (72)..(72): Xaa can be any naturally occurring amino acid
  unsure (1)..(159): unsure at all Xaa locations
HASRAEHVQPCELAVRQNVXGLARDALICQENGLVPIVEPDILTDGGHDMGTCAGATERVLAALYESLSDHXVLLEATLLMTNMVTLGYDSPKVSAHEIAEYTVAVMRCTVPSAVPWVLILSGVHIEEDATHNLYSMNKLEVLKPWTLYFSLRRALQQS

SEQ ID NO: 9265 - protein, 283 aa, Tropheryma whipplei str. Twist
MVVFVLTYVPSVLLGDGVSIPQFGLGTYELPPNEASSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHIDKIKEAGFPLPSVNQIELHPWLQQRELVLSCRNDGIQIESWGPFARFSKDLDAFPELTRPAKQYGKTPAQVILRWHIQKGYVVFPKTVHAERLRQNIDIFDFDLTPDEISGIDSLDAGFRTGPDPSSFRAGLD

SEQ ID NO: 9266 - protein, 410 aa, Methylobacillus flagellatus KT
MTQQLSLPKDKIRFLLLEGVHQNAVEVLNAAGYRNIDYRKTALDEDALIEAIKDVHFLGIRSRTQVTAKVLDAANKLTAIGCFCIGTNQVDLDGALERGIPVFNAPYSNTRSVAELVLAQTILLLRGIPEKNALVHRGGWTKSAEGSFEARGKTLGIVGYGSIGSQLSVLAESLGMKVIYFDVIAKLPLGNARQVGTMEELLSQADVVSLHVPELPSTKNMMRAEQFAQMKKGSIFINAARGTCVDIDALARAIESKHLAGAAIDVFPVEPKSNDEEFQSPLRAFDNVILTPHIGGSTQEAQANIGIEVGEKFVRYSDAGSTITAVNFPEVSIPKQPGTHRLLHIHRNVPGVLSAVNSLFARNNINIAAQSMMTKGDIGYMIMDVEASASSAAIEALQTVEGTLRTRVLY

SEQ ID NO: 9267 - protein, 91 aa, Zea mays
MAGAAKASWMVAMSVGAVEALKDQGGLCRWNYALRSVHRTAKANVRSSLAAQRDKELAPAAAAAESKRRPGKAAAEEGMRTVMYLSCWGPN

SEQ ID NO: 9268 - protein, 362 aa, Oryza sativa
MSRSGAMDLASGLGGKITKDEVKSAVDEYEKYHGYYGGKEEARKSNYTDMVNKYYDLATSFYEYGWGESFHFAHRWNGESLRESIKRHEHFLALQLGVKPGMKVLDVGCGIGGPLREIAKFSLASVTGLNNNEYQITRGKELNRVAGVSGTCDFVKADFMKMPFSDNTFDAVYAIEATCHAPDPVGCYKEIYRVLKPGQCFAVYEWCITDHYEPNNATHKRIKDEIELGNGLPDIRSTQQCLQAAKDAGFEVIWDKDLAEDSPVPWYLPLDPSRFSLSSFRLTTVGRAITRTMVKALEYVGLAPQGSERVSNFLEKAAEGLVEGGKDKARSLKETLWRSKKHLMKLRSLKSSYAYEEMLKCV

SEQ ID NO: 9269 - protein, 265 aa, Silicibacter sp. TM1040
MPTLRCTILGCGSSGGVPRLGGHWGDCDPKNPKNTRRRCSMLVEQDGPDGTTTVLIDTSPDMRSQLLDAGVGRLDAVVYTHPHADHVHGIDDLRMVVFNMRERIPVYADAPTKADLLDRFGYAFIQPEGSSYPPILEMRDIEGAFTISGAGGSIPFLPFLVEHGAIDALGFRIGDLAYLPDVAKIPEPVVPVLEGLECWIIDALRRTPHPTHFSYQDALSWIDRMQPARAVLTNMHIDLDYDTVEAETPDHITPAFDGMVIHSDY

SEQ ID NO: 9270 - protein, 341 aa, Sinorhizobium meliloti; identical to SEQ ID NO: 285

SEQ ID NO: 9271 - protein, 283 aa, Bacillus licheniformis ATCC 14580
MLKIFNQKNVAFIGAGSMAEGMISGIVQSKKLPASQIYVTNHTNHRRLEELQQKYGIQGVKKEQLDYQNIDCFILAMKPKDAEGALNSMKPHIKPHQLIVSVLAGISISFIENTLHDMQPVIRIMPNTSSAIGASATAMAEGSHVTADLSKTAKQLLQCMGEVYSIEESKMDIFTGIAGSGPAYFYYLMEHIEKAGAEAGLSQKLTREIGAQTLLGAAKMLLESPEDTAVLKDNITSPNGTTAAGLKALEESGGGEAIEQAVKQAAKRSKTISLELEQLVAAK

SEQ ID NO: 9272 - protein, 181 aa, Fagus sylvatica
MASSMISSATVATVSRATPAQATMVAPFTGLKSTAAFPATQKSNNDITSLASNGGRVQCMKVWPPLGLQKFETLSYLPPLSLESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPK

SEQ ID NO: 9273 - protein, 892 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKDADANAIAQEACKNEMNLRVVDATTITVAFDETTTLEDVDKLFKVFNGGKPVNFTAESLVSEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKVKYQYTAICFHILDCRVDNVYGDRNLICTLQQGSQVAEEAAAATA

SEQ ID NO: 9274 - protein, 488 aa, Listeria monocytogenes str. 4b F2365
MSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 9275 - protein, 415 aa, Glycine max
  misc_feature (73)..(73): Xaa can be any naturally occurring amino acid
  misc_feature (99)..(99): Xaa can be any naturally occurring amino acid
  misc_feature (200)..(200): Xaa can be any naturally occurring amino acid
  unsure (1)..(415): unsure at all Xaa locations
SSRFGSSLAGIRLKIQQWASASATLLKSSPVLDKCEWVKGQTLRQPLVRCNPSSASALTIKAASYADELVKTXAKTVASPGRGILAMDESNATCGKRLXASIGLENTEANRQAYRTLLVTVPGLGEYISGAILFEETLYQSTVDGRKIVDVLVDQNIVPGIKVDKGLVPLAGSNDESWCQGLDGLASRSAAYYQQGARFXAKWRTVVSIPNGPSALAVKEAAWGLARYAAISQENGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 9276 - protein, 521 aa, Methanosarcina mazei Go1
MRISLHMTQARRPLMLMILDGWGYREEKEGNAILAASTPHLDRLQKERPSCFLETSGEAVGLPQGQMGNSEVGHLNIGAGRVVYQDLTKINVSIRNGDFFENPVLLDAISNVKLNNSSLHLMGLVSYGGVHSHMTHLYALIKLAQEKGLKKVYIHVFLDGRDVPPKAALGDVKELDAFCKENQSVKIATVQGRYYAMDRDKRWERTKLAYDALTLGVAPYKTSDAVTAVSEAYERGETDEFIKPTIVTDSEGNPEAVIQDTDSIVFLNFRPDRARQLTWAFVKDDFEGFTREKRPKVHYVCMAQYDETLDLPIAFPPEELTDVLGKVLSDRGLIQLRIAETEKYAHVTFFLNGGQEKCYSGEDRCLIPSPKISTYDLKPEMSAYEVTDEVVKRILSGKYDVIILNFANMDMVGHTGDFEAAVKAVETVDNCVGRIVEALRTAGGAALITADHGNAEQMENSHTGEPHTAHTSNPVKCIYTGNGEVKALENGKLSDLAPTLLDLLEIPKPEKMTGRSLIVRK

SEQ ID NO: 9277 - protein, 255 aa, Chlamydomonas reinhardtii
KIPFWEGQSYGVIPPGTKINSKGKEVPHGTRLYSIASSRYGDDFDGQTASLCVRRAVYVDPETGKEDPAKKGLCSNFLCDATPGTEISMTGPTGKVLLLPADANAPLICVATGTGIAPFRSFWRRCFIENVPSYKFTGLFWLFMGVANSDAKLYDEELQAIAKAYPGQFRLDYALSREQNNRKGGKMYIQDKVEEYADEIFDLLDNGAHMYFCGLKGMMPGIQDMLERVAKEKGLNYEEWVEGLKHKNQWHVEVY

SEQ ID NO: 9278 - protein, 204 aa, Debaryomyces hansenii
MPAKFVSIPEAIEAFKNGEYLIVMDDESRENEGHLIMSAELMTQEKMAFLVRYSSGYVCVPLSTERADALNLHPMLANETDRHGTAYTVTCDYADGTTTGISAHDRALTATKLADPSSKPVDFIRPGHVLPLRAVPGLLKKRRGHTEAGVQLCELAGLQPAAVICEMVRDEDGLMMRLDDCAKFSETHNIKMITIEQLVEHISQ

SEQ ID NO: 9279 - protein, 482 aa, Bacillus cereus E33L
MIRVGGEWMYTETKEKKQSPNKMVRKIAFISTFGGLLFGYDTGVINGALPYMSDSNQLDLNPFTQGLVASSLLLGAAFGALFGGRLSDYNGRRKNILYLALLFFISTLGCTLAPNTTLMVICRFILGLAVGGASVTVPTFLAEMSPAETRGQIVTQNELMIVTGQFLAFTCNAILGNVLGDVGYVWRLMLVIASLPAVVLWFGMLIVPESPRWLASKGKIGDSLRVLKQIREENQANIELEEIKSALAEDSKLEKSSFKDLSTPWVRRILFLGIGVAIVNQINGVNAIMYYGTEILKNTGWGTKAALIGNVANGVISIAAMLVGIWLLGRVRRRPMLIIGLCGTTTSLFLIGFFSFILNGSVMLPYIVLSLTVIFLAFMQGAIGPVTWLTLAEIFPLRMRGLGMGFSVFWMWIVNFLISLSFPVLLSKIGLSATFLLFGILGLVAIAFVNKYLPETKGKSLEELEHYFRSYDDQGLENKQAR

SEQ ID NO: 9280 - protein, 395 aa, Nicotiana paniculata
MASASLLKTSPAIGKTDFIKGQALRQPSVSVRCHPAPPSGLTVRASSYADELVKTAKTVASPGRGILAMDESNATCGKRLASIGLENTEANRQAYRTLLVSAPGLGQYISGAILFEETLYQSTVDGKKIVDVLHEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFFYLAENNVMFEGILLKPSMVTPGAECKERATPDQVADYTLKLLQRRIPPAVPGIMFLSGGQSEVEATLNLNAMNQSPNPWHVSFSYARALQNTCLKTWGGRPENVQAAQEALLIRANANSLAQLGKYTGEGESEEAKKGMFVKGYVY

SEQ ID NO: 9281 - protein, 753 aa, Nocardioides sp. JS614
MLHVPSRRHVVDMCRTLLERGYLKATEGNISVRVPGHDRFAVTPSNYDYAKMRPEDICILDFEGKVVAEAGGSDLPPTVESGLHAAVYRERPDVHAVVHTHQPYASALAFLRRPIPALTDEQVRFLGREVAIIDYAPAGTSFLAKNVAKRLGSSANAFIIANHGILAVGTDPDRAIFNMALLEKVCLAYLLALTTETGRVYTIPSAIREIALTKLKSDQKRIAAQVEQFVPVDRDLVEEPLPSADAVAERVRTAPGAGPEVAAPGAAPGAADLGYAISDYPDVDAVMRRIKALTGQPVRGLRHDALLDVLAWFDTKCAASKELTDRAKARIPGGVQHNLAFNYPFPLAIDRADGAHLTDRDGNVYVDFLQAGGPTILGSNYGPVNEQVAEVIRESGPVTGLFHEYELKLAESINRYLPHIEMYRSLGSGTEAVMAAVRAARVKTGKHMVIKVGGAYHGWSDSMVYGLRVPGTFRMNAKGIPFGATAGTRESFPHDVGQLRRKLIENRARGGTAAVIVEPLGPESGTRPAPRDYNARVRELCDEFGALLIFDEVVTGFRVGMGGAAGYFGVTPDLTVLGKAVAGGYPMAGGVGGSAEVMSVFGSGLDGKNGAHVLVGGTLSANPLSCAAGHFAIEEMARTNAPVVAGAAGDRLARGLQRLIDHYGLPYVAYNQGSIVHLQSSGVLLLDMRNPVKLLKESKPRKHLMEQLGAAYAAHGIITLAGSRLYTSMADTDEVIDDALERFDRVFALVEGV

SEQ ID NO: 9282 - protein, 617 aa, Zea mays
FSRLLLDCWRGVEDEWCCPRSADAVSFSSSSPEGEPENRFSQQSRQNKSKMRSSVSERSLIIESDDDDDDHPQSRSSAAARSRRRHHQHEEDSAAGSDSDSGSSSSSCGTPRGPATDSSYTQQWPQSYRQSIDILSSVQSPNLSFLGTPTLSRLSNSFRGKTPEIISNLVKPLLRPTTSDDHHHHHQQQPEERKSSQYLLPSRKPSLQQIPEDQKPVPVAHEVSPYHKCTYTQAVVNGINVLCGVGILSTPYAIKQGGWLGLVILCLFAILAWYTGVLLRRCLDSKEGLETYPDIGHAAFGATGRIAISIILYVELYACCIEYLILEGDNLSKLFPNAHLSVGSLTMNSHVLFTILTTIIVMPTTWLRDLSCLSYLSAGGVFASILGVICLFCVGVVDNVGFENKGTALNLPGIPIAIGLYGYCYSGHGVFPNIYSSLKKRNQFPSILFTCIGLSTILFAGAAVMGYKMFGEATQSQFTLNLPENLVVSKIAVWTTVANPITKYALTITPLTMSLEELLPPNQQKYSNIVMLRSALVVSTLLIALSVPFFGLVMALVGSLLTMLVTYILPCACFLAILRRKVSWHQVAVCSFIIVVGVCCACVGTYSSLSKIIQNYT

SEQ ID NO: 9283 - protein, 244 aa, Oceanobacillus iheyensis HTE831
MNHKNPKDTQNFITSKKHVKEILDHTSINKQDNVIEIGSGKGHFTKELVKMSRWVHSIEIDEDLCQVTQKAVKPFQNIKVIHTDILKFNFHKNKDYKIFGNIPFNISTDIVKKIASESQSKFSYLIVEKGFAKRLQNTKRALGLLLMVEMDIKILTKVPRTYFHPRPSVDSVLIVLERHEPLILKKDYKKYQSFVYRWVNKEYHALFTKNQFRQALRHAKIADLNNVNFKQFLSLFNSYKLFNK

SEQ ID NO: 9284 - protein, 398 aa, Nicotiana paniculata
MASASLLKSSPTVLDKSEFVKGQSLRQTSVSVVRCHPTNAPSLTVRAASPYADELVKTAKTVASPGRGILAMDESNATCGKRLASIGLENTEANRQAYRTLLVTAPGLGQYISGAILFEETLYQSTVDGRKIVDVLVEQNIVPGIKVDKGLVPLAGSNDESWCQGLDGLASRTAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLQRRIPPAVPGIMFLSGGQSEVEATLNLNAMNQAPNPWHVSFSYARALQNTCLKTWGGQPENVKAAQDALLTRAKANSLAQLGKYTGEGESDEAKQGMFVKGYVY

SEQ ID NO: 9285 - protein, 201 aa, Arabidopsis lyrata subsp. petraea
LYEGYAVFENMIRKGSKPNVAIYTVLIDGYAKTGSVEDAIRLLHRMIDEGFNPDVVTYSVVVNGLCKNGRVEEAMDYFQTCRFNGLAINSMFYSSLIDGLGKAGRVDEAERLFEEMSEKGCTRDSYCYNALIDAFTKHGKVDEALALFKRMEEEEGCDQTVYTYTILISGMFKEHRNEEALKLWDMMIDKGITPTAACFRA

SEQ ID NO: 9286 - protein, 239 aa, Thermoplasma acidophilum DSM 1728
MKYSKRMGQVFLQSRRIAEYEVDLLGEPGTVLEIGPGHGVLTKILVERGFKITAVEKDRYIFGELQSLRAANLNLINMDFLDMAPGSYDYIIGNIPYSISSPIVFKLYEFEFRRSVIMVQKEFAEKIAFPDDMSRLYVNAHVRYNVELKRYVSRKNFNPQPEVDSAILVLEKKKYEEPYPLEFLDGVLVQMFSKKRKKLSNIFDICPEDLADKRPSNLTVSEILGLARLLFDSGSSAHR

SEQ ID NO: 9287 - protein, 241 aa, Bdellovibrio bacteriovorus HD100
MKKIFAANWKLFKSPKETREFFGQFKELAGKATGEVVFFPSAISLEAASESLKGTSIKFGAQNCYFQAQGAFTGENSAQVVKDLGGSYVLIGHSERRAIFGEGDALVADKVAFVQGLGLTPMLCIGETLQERESAKTFRVLETQLNLGLAKADKTKPVVVAYEPVWAIGTGKVATPEQVAETHTDVFNILKALGFETAPILYGGSVKPDNAAGLIKQPHVNGFLVGGASLEAKSFSEIASV

SEQ ID NO: 9288 - protein, 1125 aa, Cryptococcus neoformans var. neoformans JEC21
MARTGSRRQIDQLDSDNELARPHQSSQFKRAKTEPGTGDISSSDFNSDNDDAGMDMDDSSDESEYEEPSYEEEALLAAYSDLRRSQKGYVGSASSAGIIKSISLIDFMCHRHLTVDFGPRMNFVVGHNGSGKSAVLTAIAVALGGKANLTGRGTGLKDLIRTGAERAVITITLANSGDSAYRPEVYNPNIVIERTIHSNGSSGYKFKASKDGKTIANKRSELTSISDYFNINIDSPLTVLTQDQSRSFLQNADPSKLYKFFLNGTQLSNLLESYEASSQNIESLVNFIKRQREALPDLKAKVESYKRKIQASKKVMRQKRRNKQLLIELAWSYVIEKEKARDEKKSDVLELREKIEKVQEEIHKTDKELPQVNDAILETESDLKNLDESSKPLALAVRQAKARSQEASKELRSMQSSVAEIEEKIISEKSTLERLERKIEEQLRLNEPEQQEERRRLLQRRAKAEDILSKLQLERPARERERDDKFQAQKRAKEELQSINANLRDVNQSKAQMQRQIQNISRQANSRIAAFGLHIEPLLEEINSTNWKHSKPIGPMGMFVHLEDMRYADVLQVMLGSALCSFAVRDHEDRVKLSNILSKHFARGYRPGNFTARDGARIPTIYRHSGELFDFSNGDLSRHGPTILSKLRKTMLAPTLIEGNRLMDDLLNKNVAQYVTVHCADLMTTSGTKSNRHSGPTNKYRGNPLFALDVGSEIAKCEAQLQDYESQCQQLCNSASMTENRIASLQQDMAKLSAGITDLQKKMIPLEKDLDQTKRKLADMASTEIDTSESIRDEHNADIIKQEDVIKQLDADVVQKRAAFDAQAPTKELLLKNLESQVQRRTNILTRQSHWAQSLINYETKLEEAEEILVDLEQNVQEWTNKALDYAPEKINTIKTPAELEAERKALDQSITEASKALGVNLDELTAEYRLQRQRYQKANENIKDLNFLRIVLRKAMTNRHTWWHQTRSHIAIRAKTAFVVFESFRAMEGRLNFDHGHEKLSLVIHNQTTTESQDGTYTQISHYKGAKALSGGERSFSTVSLLLALWSTVPCPIRALDEWDVFLDAANRKVAAKNLMEGARESDGKQYILITPLDMQGIDTSGPDKKVIRMADPERGQGTLNMSR

SEQ ID NO: 9289 - protein, 354 aa, Myxococcus xanthus DK 1622
MALYPVIMAGGSGTRFWPLSRQARPKQFLPLASKLPLITDTSARLKGLASVKDTFIVCGPLHAKAAAKLVKGLPKANLLVEPVARNTAPAIALAAVQVAARDPKGVMVVLPSDHHVADVPGFKRTLADAADLAEAGHIVTLGIKPSRPETGYGYIQVGEALEGGGRKVQAFKEKPDLETARGYMSSGDYLWNGGIFVFRVDVILEAFAKHMPEMKKGLDALRKAAGKRTFGAVLKKVFPKLPSTSIDYGVMEKASNIAVLPGDFGWSDVGSFAAIPEVRPADANGNVVSGNLAVVVDCHSCVVLADKRPLSVVGLTDMVVVDSGDAVLVVPKDKSQDVRKVVEALKARKLTKYL

SEQ ID NO: 9290 - protein, 473 aa, Silicibacter sp. TM1040
MIHPILLCGGSGTRLWPLSRKSYPKQFAPLVGDITLFQSSAQRLAGEGFASPMVVTNSDFRFIVTQQMAEVGIDPGAILIEPEGRNTAPAVLAAALFLQKHDPDGLMLVAPSDHVVPDSEAFRAAIAAAEPAAQAGQLVTFGIKPDRPETGYGYLELASKPEDFEPKVIGLKRFVEKPDLDTAKDMLRSGNFLWNAGIFLFSVESIIQAFKAHCPHMLVSVQTALDLGEHDLGFLRLDPDAWSGAEDISIDYAVMERAENLAVVPYAGGWTDLGGWDAVWREGVPDQDGVVIHGRASAIDCTDSLLRSEDERLEVVGIGLKNIITVAMPDAVLVADVSRAQDVKKAVETLKAKSVRQAEAFPKDHRPWGWFESLIVGERFQVKRIHVNPGAALSLQSHHHRSEHWIVVEGTARVTVDDTVSLVTENQSIYVPLGAVHRMENPGKVPMVLIEVQTGSYLGEDDIIRYEDVYARA

SEQ ID NO: 9291 - protein, 139 aa, Zea mays
  misc_feature (33)..(33): Xaa can be any naturally occurring amino acid
  misc_feature (44)..(44): Xaa can be any naturally occurring amino acid
  misc_feature (70)..(70): Xaa can be any naturally occurring amino acid
  misc_feature (84)..(84): Xaa can be any naturally occurring amino acid
  misc_feature (93)..(93): Xaa can be any naturally occurring amino acid
  unsure (1)..(139): unsure at all Xaa locations
IIWCKAGLESLGPDGVRFEAAADAYSNRSLKYXETALRDYEAQXLEDDPFVHRPFYSLSDTLLDQNLCTXLSPTSRVAIAHLAXHIELPFDHXENKPADMILDKKFPGTLDQSAGCLIIFGDPHTEDILPATLETISHV

SEQ ID NO: 9292 - protein, 561 aa, Erwinia carotovora subsp. atroseptica SCRI1043
MHAATPLISTIAGGLVLAFILGILAHRLRISPLVGYLAAGVLVGPFTPGFVADTSLASELAELGVILLMFGVGLHFSLKDLMAVKSIAIPGAIAQIAVATLLGMGLSTMLGWNLASGLVFGLCLSTASTVVLLRALEERQLIDSQRGQIAIGWLIVEDLAMVLTLVLLPAFGDMIGAEHADTSKLLADLAWTIGKVIAFITLMIVVGRRLVPWVLAKSASTGSRELFTLAVLAMALGIAFGAVKLFDVSFALGAFFAGVVLNESELSQRAAHDTLPLRDAFAVLFFVSVGMLFDPMILLNDPVSVLITLAIIVFGKSAAAFALVRLFGHSKRTALTISASLAQIGEFAFILAGLGIVLGLLSEEGRNLVLAGAILSIMINPLLFTLLERYLAKNETIEEQIVEEAIEEEKQIPVDMCNHALLVGYGRVGSLIGAKLHQAGIPVVVVENSRTRVDALREQGIKAVLGNATKPEVMDIARIDCARWLLLTIPNGYEAGEIVAAAREKRADLEIIARAHYDDEVSYITEHGANEVVMGEREIANSMITLLKLDEIPPAPQACPI

SEQ ID NO: 9293 - protein, 274 aa, Candida albicans SC5314
MKDYTITVLGCGVMGTAVTSAILKSKFDPYPKKIIACTIPSQEQSLKETFADQPLVHVSAGVENNNKAVTEADVIILGCKPYMYEGIYEEVKESLTGKQLLISLLAGTTIKELSIFTPYVAKVMTNTPARFGCGTAAIAFAPEVSEESQELVMKLIDTVGMTVKIPEKNMDIATSLIGSGPAFCLLMMESMIDGAVRMGMPYDVASVAAAKVMEGTARMVLETGEHPAALKSKVCTPGGTTIGGLLTMEDRGLRSAIARGVEEAANISASFAKS

SEQ ID NO: 9294 - protein, 530 aa, Oceanicola granulosus HTCC2516
MAPRVLISDKLSEAAVQIFRDRGIDVDFQPDLGKDKDKLLEVIGQYDGLAIRSATKVTEKVIAAADNLRVIGRAGIGVDNVDIPHASKKGIIVMNTPFGNMITTAEHAIAMMFAVARQIPEASASTHAGKWEKSRFMGVELTGKTLGVIGAGNIGGIVCTRAVGLRMKVVAYDPFLSEERATELGVEKVGLDALLARADFITLHVPLTEQTKNILSRENLAKTKKGVRIINCARGGLVDEQALADALKDGHVAGAAFDVFAEEPAKENPLFGLPNVVVTPHLGAATTEAQENVALQVAEQMADYLITGAVQNALNMPSVTAEEAKIMGPWIKLSGHLGNFIGQMTDEPIKAINILYDGAASQMNLSALTSAVVAGIMKAGNPDVNMVSAPVIAKERGIQISTTKQDQSGAFEGYIKVTVVTEKRERSIAGTVFSDGKPRFIQIKGINIDAEIGQHMLYTTNEDVPGIIGTLGTTMGSNGVNIANFTLGRSAAKGEAIALLYVDEEVPAKALDALKQTGMFRQVKTLQFEV

SEQ ID NO: 9295 - protein, 138 aa, Rickettsiella grylli
MQNLTISFIGAGNMATSIINGLLKKNFPAKNIWATNNNSEQLNQLKSLNINLTTDNKTAVRRSTVVVLAVKPQILKSVALEIAKCMQERNPLVISIAVGIRLNHLENYLLNQNLALIRCMPNTPALIGCAATALFANP

SEQ ID NO: 9296 - protein, 149 aa, Nostoc punctiforme PCC 73102
MERTFLAIKPDGVQRGLVGEIIRRFETKGFTLVGLKFLKVSKELAEQHYGVHRERPFFGSLVEFITSSPVVAMVWEGDGVVASARKIIGATNPLTSEPGTIRGDFGINIGRNLIHGSDAPETAQQEIALWFKDEELVNWQPHITPWLHE

SEQ ID NO: 9297 - protein, 88 aa, Rickettsiella grylli
METLENAANELGLSKEMAHALTLQTALGSARMAIETKKNLTQLRQQVTSPGGTTEKAIESLNAAHLDDIIKKALTAAQNRAKELAQTF

SEQ ID NO: 9298 - protein, 410 aa, Haemophilus somnus 2336
MTTKVSLDKSKIKFLLLEGIHQNALEVLKAAGYTNIEYHRKALEPDELKIAIKDAHFIGIRSRTSLTEDILAEATKLIAIGCFCIGTNQVDLEAAKARGIPVFNAPFANTRSVAELVLGEILLLMRNIPQANADVHRGLWNKSMVGSYEVRGKRLGIIGYGHIGSQLSIIAEALGMNVYFYDIETKLPLGNAQQMNSLEELLSTCDVVSLHLPENSSTKNLMNAERIAQLKANCIFINAARGTVVDIDALTQALESKKIRGAAIDVFPKEPASIEEEFISPLRAFDNVILTPHIGGSTVEAQENIGVEVANKFVKYSDNGSTLSAVNFPEVSLPEHSNAKRLLHIHHNRPGILNKINQIFVEQNINIAAEYLQTEAKIGYVVIDVETEDTAQLLAKLKQIEGTIRARVLF

SEQ ID NO: 9299 - protein, 219 aa, Haemophilus somnus 2336
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIG

SEQ ID NO: 9300 - protein, 395 aa, Silicibacter sp. TM1040
MKTTSITHRLADLGGAKWDLHTAARDRSDRGEDIVEMTIGEPDVALPEPLARAATRAIEAGRTQYSNGRGENGLRDALAESYSARRGRCFERDNVLCFPGTQTALYAVMQGVAETGDEVLVGDPLYATYEGVIRATGADMVPVPLKAEHGFRMQADDIAQRITERTRAILLNTPHNPTGAILRPAELEAIAEIALKHDLWLISDEVYEDLVFDGNSFTSPLTLEQIADRTIAVSSISKSHAAPGMRSGWAIGPRSFMDALLPVSETMLFGNQPFIADVTEEAVRAGSTVAEGMRQRFAKRAQYLADRLEAETVLRVHRPEAGMFALVDVSPLGMDCDAFAWALLENAGVAVMPGSSFGAHLQNWVRLALTVEDAAMTKAVDRISEFARSVAVAAQ

SEQ ID NO: 9301 - protein, 87 aa, Oryza sativa
MAGAAKASWMVAMSVGAVEALKDQAGLCRWNYALRSIHRAAKANARAGVSRGKKLPASAAAVAERRRAEKAEEGLRTVMYISCWSTN

SEQ ID NO: 9302 - protein, 200 aa, Prototheca wickerhamii
YYALSFVRTADVIYELKDWLARQGATGTSAIGVLAKIESADSVANLEAILDAVDGAMVARGDLGAELPVEEVPYWQSKIVKGCRKRGKPVIVATNMLESMIKCPTPTRAEVSDIAIAVREGADAVMLSGETAHGSFPFKALDVMTTVAKRTELSMLRYEGARRYGSEESDAIDWILPPARRMNSLADVGISEMFAYHAVT

SEQ ID NO: 9303 - protein, 387 aa, Acidobacteria bacterium Ellin345
MTPQSPFCDVETALAEIRAGRMIVVVDDEDRENEGDLTMAAEYITPEAINFMAKYGRGLICLAMTEERLDALRLPLMSAENTSNFGTAFTESIDARDGVSTGISAYDRAHTIKVAIDPGTRPNDLARPGHTFPLRARKGGVLVRAGQTEASVDLARLAGLVPAGVICEIMNDDGTMARVAELTEFCKQHDMKMLTVAELIRYRMANERYIRRLAEATVPTRYGDFRMIAYESDITGESHVALVKGDVEHAPEPVLVRMHAHCLVGDVFGATQCDCSKTIERALEMIAREGRGALIYLHQTSKGYSVEKLGDKLTIQFHHDLRLPTLPEHQRKTQREVGIGAQILSDLGLTRIRLITNRPRRVAGLEGFGIHIVEQVPTAEPRPAAAK

SEQ ID NO: 9304 - protein, 108 aa, Triticum aestivum
GPFCSGQVLVYHDLLGMMQHPHHAKVTPKFCKQFGNVGSVINKALSDYKQEVETRSFPGPSHTPYKITATDVDGFANALQKMGLGEAADAAAAAAENSENDGKPSENS

SEQ ID NO: 9305 - protein, 475 aa, Acidobacteria bacterium Ellin345
MTELRNFLALPYDELEELNLKAKEQRMKRVAADKIQEERLKYLTDEKRIKAVTVLFSDLEGRLHMLDYDKKFLLKSYDNLTFDGSSIRGFTAQRESDLRLYIDWSAFYWGPADIFGPGKVLVFGEVISKEGKHYEADVRGVLKTFSETLHKKEGYTLNAANEIEGFLFKGEDAERRFHDTHAFEYVNTGGYYHSLPGDPLRTFIDTTAEVQRSMGFQNEKDHPEVAPSQFEINYSYGEVVAAADQIQLYKLICRQVATKMGLSASFLPKPVVGVNGSGMHTNVSISKGGKNLFWDPKGEEQLSSFGWSFVDRILTHGNDICLMLNASVNAYRRLDPHFEAPNQIKASPTDRGSMVRIPIGNEKSMRVEVRSVGPDANPYMVMYSVFKTGLHGEIAKIKNLRQAERYLPDNIYTALEHFRLADWTTKLLGADVKGRYADLKQASADRCARLLGTVVKAPEVQFHHDVYNQYLWNQF

SEQ ID NO: 9306 - protein, 534 aa, Magnetospirillum magnetotacticum MS-1
  misc_feature (263)..(263): Xaa can be any naturally occurring amino acid
  unsure (1)..(534): unsure at all Xaa locations
MTKPKVLISDALSDAAVQIFRDRGIEVDFQPALGKDKEALAAVIGNYDGLAIRSATKVTGKLLAEANRLKVVGRAGIGVDNVDVPAATSRGVIVMNTPFGNSITTAEHAIAMMFALARQIPQADASTQAGKWEKNRFMGVELTGKTLGVIGCGNIGAVVADRAIGLKLKVVAYDPFLTPERAAEIGVEKVELDQLLARADIITLHVPLTDKTRNILSTENLARTKRGVRIVNCARGGLVDEAALRAALDSGHGGGRAGLSDRXFRSPSPAVENPLFGHPNVICTPHLGASTSEAQENVALQVAEQMADYLLSGAITNAINFPSISAEEAPRLKPFVALCEKLGSFLGQLTEAPIKGIRITYEGAVAGMNTRALTSAAVTGVLRPILQDVNMVSAPVIARDRGIVVDEIKREGGASDYESVVRITVEAEDMPRDAAGTVFHDGKPRVIEIRGIDIDAAFAPHMLYVRNHDKPGFIGRFGSVLGEAGVNVATFALGREAEGGNAIAFVAVDGPVPAEVLKTIEAIPQVKRVRPVRF

SEQ ID NO: 9307 - protein, 285 aa, uncultured bacterium 311
MSLVEGKNCLITGATSGIGRSTALALSEKGANIFFIARNQQKAEELTEEVERVSGKSPNAIIADLSSFKQIERAAEEFKSLNKPIDVLLNNAGIMNTERRVTEDGLEEVFAVNHLAYFLLTNLLIEKILESGLKRVVNVSSDAHRFLKSMNFDDLQSEKEFKMFAAYGQSKLANILFTRKLSSLYQEEGLTTNCLHPGFVSTSIGAQNENLAFFARLIRWVSPLIAKPSDKGAETSIYLCSSEEVSSTSGEYFIDCKKAPITKAAESKEDAEKLWQISLELTGLK

SEQ ID NO: 9308 - protein, 182 aa, Arabidopsis lyrata subsp. petraea
SEDMCCTPKLADAGSCKLGEVMISADPNDPEWPKRIPTFFKRSEEEVKMYPEAVIIKKTGWYTVYFMTCDPELDGTTIRGRTVWKNRGGYLQGDKAPLMKFYASMLLAYVVLGLLWFPQVAQYWKDGIQLHSHISLVIVFTMGELAFLYFDFAYLDSAGTSPMEVTVWAITLSSMRKALSRL

SEQ ID NO: 9309 - protein, 476 aa, Escherichia coli
MKIVPVVLAGGSGTRLWPLSRTMYPKQFLKIFGHMTMLQTTLSRMNSFHDATDAIVICNEAHRFVVAEQLNQIDKKSTIILEPCGRSTAPAVALAAMHIVETINADQDVLLLVLPADHIIKDLDTFHQAVKVASSFACGGKLVTFGIPPLTPETGYGYIQRGNSIGTVEGSECFEVSKFVEKPDVNTATQFLNDSNYYWNSGMFMFSARTYLEELQKYCPDIVSVCQKSYDNSVCDLDFIRIDEKQFSNCLDLSIDYALMEHTNEAIVVPMDGDWSDVGSWASLWDITNKDNNGNVLWGDILTRDSSNNYIYGESGLITTLGVEDLVIVQTKDALLVANRKSVQDIKQLVEQLKLRDRSEYYIHRETYRPWGKCDTIDKGKRYQVKRIEVKPGEGISLQLHHHRSEHWVVVSGTAKITINGVEKIISENESIYIPLGAKHCLENPGKITLELIEIRSGSYLAEDDIIRFFDKYGRI

SEQ ID NO: 9310 - protein, 330 aa, Clostridium thermocellum ATCC 27405
MKKLKESTQDYVSGEELSNILGVSRTAVWKCINELKKEGYVIDSSSKKGYKLCYVPDIINSWEIKEGLGTRIIGQNIHCFSEIDSTNNYAKTLAQKGCDDGTVVLAEHQTQGRGRLGRSWDSMGGKGIWMSIVLRPAVGLEDVQIITLAAAVAVVLAFKKVMGIDAGIKWPNDIVLDGKKVCGILTEMSMEMERINFLILGIGINFSHEESEFPEEIRDRATSLGIYLKEKKGMDISRFKRSHLIRAILSELEEVYDMINEGKAGVIVEEWKKYSVTLGKEVVIKYREEQYTGIAQDVDQSGRLIVKQDDGTVREILSGEVSVRGLLGYT

SEQ ID NO: 9311 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 9312 - protein, 244 aa, Aspergillus oryzae
MDNKWDIIAEIPDLTGKVAIVTGAKYIDYSRWKGTIADHKSSSPQGIGYHIAHQLAIKGAKVYVGARNREKSQNAIDEMLQSTPSLVHERLVPLAMDLNDFQQVQSTARGILEREERLDILVNNATRFLGPYLFTTELLPLLKMTARQAPGVRIVNVSSRVHLALPTGVQFSSLDDFNQDFGSEDDHQSNRLRYGLSKLAMVLFSKEIQRRANEEGIPMVATSMHPGGVRTDISVRGMIDSRIS

SEQ ID NO: 9313 - protein, 258 aa, Streptomyces coelicolor A3(2)
MTTRTPLMAGNWKMNLNHLEAIAHVQKLAFALADKDYDAVEVAVLAPFTDLRSVQTLVDGDKLKIKYGAQDISAHDGGAYTGEISGPMLAKLKCTYVAVGHSERRQYHAETDEIVNAKVKAAYKHGLTPILCVGEELDVREAGNHVEHTLAQVEGGLKDLAAEQAESVVIAYEPVWAIGTGKVCGADDAQEVCAAIRGKLAELYSQELADKVRIQYGGSVKSGNVAEIMAKPDIDGALVGGASLDSDEFVKIVRFRDQ

SEQ ID NO: 9314 - protein, 248 aa, Oceanicola granulosus HTCC2516
MRRKLAAGNWKMNGSRAALAEVEALCAAHPDSAVELLLCPPATLVAPMADARGSHPLRVGGQDCHSSESGAHTGDISAAMLKEAGASHVIVGHSERRTDHGETSETVAAKAAAAHAAGLVAVICLGETLAEREAGTTLAVVADQLGASLPEGATAANTVVAYEPVWAIGTGKVPTLEQIAEVHEYLRKELATHLPDAADGIRLLYGGSVKASNAADIFSVRDVDGALVGGASLRAEDFSPIVSALEQA

SEQ ID NO: 9315 - protein, 477 aa, Pseudomonas aeruginosa UCBPP-PA14
MTADKKAKILATLGPATRSRDDIRALVEAGANLFRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNGHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 9316 - protein, 353 aa, Escherichia coli CFT073
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 9317 - protein, 526 aa, Zea mays
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLLVADAASWARQRHVAATVFGTPAFRSFVLCTMARQTARLLVPFLDCAAADQEGDGGVVDLEDVFMRYSLDVTYASVFDADLDMLCVAAASAPVPPFGLATRVASESVLFRHIVPAWWWRLLRWLNVGSERRLAEAKAVLNEFVYREIAKRKSRLATTSQAGEGYDLLSLYMAWPREPGMSERQRDQFLRDSAVSYLFAAKDLIVAALTWFFYMLCTHPHVEAKILDELRSLHPTATVAATGGGEHAVFDSDALQPASYLHAAVLETLRLFPPAPFEEKEAVRSDVLPDGTTVAKGTRVIFCIYAMGRMEGLWGSDCHEFRPERWLSDIGRVRHEPSHKFAVFNCGPRSCLGKNLGLSNIKIAAAAILYNFRVELIDGHIVEPQNSVVLLTKNGMRVRIKRRHAA

SEQ ID NO: 9318 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVILTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 9319 - protein, 245 aa, Guillardia theta
KPIVGGNWKCNLDKAGVSALVTSLNGMDCTDCEVVVAPVAVHLGSVVDNVKAPIEVSGQNCNFKGNGAYTGEVSADQLVDMGAKWVILGHSERREYFKEDNEMLRQKLEYALSKGLKVIFCIGEKLEERNANKTLDVCKSQLEPVKDLLKPETVVIAYEPVWAIGTGVTATPEQAQETHKQIRDYLATVNADMASKIRIQYGGSANAANAPTLSACPDIDGFLVGGASLKPEFADIIKAIAAAKK

SEQ ID NO: 9320 - protein, 188 aa, Brassica napus
MAGGGGGTEAFPDLGEHCQNPDCKLLDFLPFTCDGCKLVFCLEHRSYKSHDCPNSDHGSRTVSICETCSIAIETTGFDQEGIKSLLEKHERSGDCDPSKKKKPICPVKRCKEVLTFANNITCKDCGVKFCLKHRFPTDHVCNKKTVANSGTRSRWNEKFMEALSLRNEKGCGRGTTSVSSSSSPSIRS

SEQ ID NO: 9321 - protein, 109 aa, Arabidopsis thaliana
  misc_feature (85)..(85): Xaa can be any naturally occurring amino acid
  misc_feature (102)..(102): Xaa can be any naturally occurring amino acid
  unsure (1)..(109): unsure at all Xaa locations
MASSMLSSTAVVTSPAQATMVAPFTGLKSSASFPVTRKANNDITSITSNGGRVSCMKVWPPIGKKKFETLSYLPDLSDVELAKEXFDYLLRNKWIPCVEFEXEHGFFVP

SEQ ID NO: 9322 - protein, 432 aa, Listeria monocytogenes
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLDSFKEALAIWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDPVTNYAEAGATNGELFGRFFKGMLEEGINLAPSKYEAWFITSAHSEADILETIQAVDTVFGKMVQDN

SEQ ID NO: 9323 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVLHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 9324 - protein, 253 aa, Flavobacteria bacterium BBFL7
MKITILGTGTSQGIPVIGSDHPVCRSTDSRDKRLRVSAMIEHQGKRLVIDCGPDFRQQMLRHQVNHLDAVLFTHEHADHTAGLDDLRPFFFRQGEINCYMTKRVHLALQERFSYMFATVNKYPGVADLTVHEFDDHAFKVSGIEVTPVLADHGFIPVHGFRVLNFAYMTDVKTINATEKHKLKNLDVLVLNMLREQEHKTHLNLDEALDLVRELQPKRTYFTHISHHLGFHEEVEKNLPEGVYLAYDNLEINL

SEQ ID NO: 9325 - protein, 88 aa, Glycine max
MSSTSKAWTVAVSIGVVETLKDQLGLCRWNYMFRSVNQHLRNNVRTVSQGKRFSSSVAAANSSGESEKAKQCEESLRTVMYLSCWGPN

SEQ ID NO: 9326 - protein, 608 aa, Vibrio parahaemolyticus RIMD 2210633
MSLPFLFHSQTVDGLAFDGKRVKVCLKTEALTFDAVYVRIEPDNEEYLVAMVQCGRAGELLLWEVSFEPNRDRDITHYVFKVVRNGQQYWLDARGVQKRIPPKEFHFKLNVNHQPPKWVQEQVFYQIFPDRFAASQSESAIREAYYEYDPDAEIKMWGEPVGNHQNSGAREFFGGDLKGVEQKLGYLEQLGVTALYFNPIFSSPSNHKYDTTDYFTIDPMLGTNEHFASLCEKIRSKNMKIVLDAVFNHTSVHHPWFDIQQKGKGAYGNPKSDFRDYYFFDGESNHYIGWKGIDNLPVLNFENHEVREYIYQGEASVIKHWLKPPYSVDGWRFDVIHMLGEGEGAKNNAHYVKAFRQATKSVNPNAYVLGEHFFEATQWLQGEQEDGAMNYYGFAHPVRAFIAHQDITYDPIDIDGFEFKAWLDEARAKVPFANQLSQLNQLDSHDTARFLTLVNGDEKKMKIALALLMTYVGAPCIYYGSEVGLEGSFDPDNRRCFPWHLVQGSPWLHLYQQWIEIRKQFQALQSGSMQWLYCDERAFAYARQLGEETIIVAVNIGLQESTIDLPLWQLGLNAKHLHQLLDKCEIIDYEGHVSVNMAALSINLWQVK

SEQ ID NO: 9327 - protein, 248 aa, Burkholderia xenovorans LB400
MYKLVLIRHGESTWNKENRFTGWVDVDLTEQGNNEAQQAGVLLKDSGYTFDIAYTSVLKRAIRTLWHVQDKMDLMYLPVVHSWRLNERHYGALSGLNKAETAARFGDEQVLVWRRSYDTPPPALEPTDERAPYNDPRYAKVPREQLPLTECLKDTVARVLPLWNESIAPAIKSGRQVLIAAHGNSIRALVKYLDDISDNDIVGLNIPNGVPLVYELDENLRPIKHYYLGDQEAIAKAQAAVARQGKAG

SEQ ID NO: 9328 - protein, 248 aa, Nostoc punctiforme PCC 73102
MTTEKRIAVVTGSNRGLGYAISRQLSKIGNRVILTSRNETDGLAAKGQLTNKGFDVDYHTLDVTNDGSVQQFTEWLRETYGKVDILVNNAGVNPTTKPEESSLLTVQLETMRSTFETNVLAVLRISQALIPLMKVQNYGRIVNISTEMASLTSVPTDYYPLAPSYRLSKVGVNGLTVLLAKELQGTNILVNAYSPGWMKTDMGGDDAPFTAEEGAETAVYLATLPDGGAQGLFFAEMRKFGGPIQVQW

SEQ ID NO: 9329 - protein, 695 aa, Methanosarcina mazei Go1
MEDYLLANVDVILGFAVVILTIFYRFEFPPILGFLVTGMLIGPYGLGILSGGEIDMTSELGVVFLLFTIGVDLSLNDLWKMKKAIMGGGVLQILFTTTLAFIICTWIGFSSSTSIFIGLLISLSSTAIVLKVFQDKNEVDTPHGKTSLAILIFQDLAIVPLILITPILAGSSISFDGAFSNIFFKGSLIIFVFILSSRFLVPWIFYCVGRTGSKQLFLVSVVFICLSAAVFTSSIGLSLALGAFLAGIVISGSQYSHQAMGNILPLKDMFMSFFFVSIGMLLNISYLLDHLPLLALAAVALIIIKSIAGMLITIILGYPLRTTIITGLALSQVGEFSFVLSKLGLEYSLLSKETYQAFLAVSIITMGVTPFLINASYRPAEFFVKKASDSVYGMKLVRGFCSGSFEWKECVEPEIKDHLIMVGFGFSGKTISKAAKAAGIPYIILETNPDIVKQEKTKGERIQYGDATFGAVQEHAGIRNARVLITGISDSVATRKIVEKAKELNPNIYVIAKVRNLQEMKHLHHLGADEIIPEEYETSVEIFVRLLEKYLVPRENIEKMINDLRANGYRRLRKLSVDQDTDNEFSIKDELPGVEIQVLKVGKGSGFDGKTLAEMEFRKKHGVTVLSVRRGSEMIHTPEGDFLLKAKDACVLLGKPESLLNVRKLFESITGEVRPSFQSGSKIELIPKPDSFPHN

SEQ ID NO: 9330 - protein, 975 aa, Burkholderia mallei ATCC 23344
MKLEHPDRLMNRTPLSLAALETHDAFAERHIGPDAASQQAMLDTLGFATRAALIDAVIPASIRRAETLPLGPFAQPKSEAEALAALRALADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGANGDVRDYRALADAIHAAGGHVVVAADILALTVLMPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALLAAGIRHLGYATVNDTFFDTLTIDTGARTAQLHAFAQAKRINLRRAGDTRVGVSVDETTTRADLADLLTIFAQAAGATAPDIDALDAGLLPAPALPPSLERTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRDVCLIPASAHGTNPASAHMAGMKVVVVACDAQGNVDIADLKAKADAHSHDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFIAAMIAIRDEIRAVEEGRADREDNPLRHAPHTAAVVTANEWPHAYSREQAAFPVASLVANKYWPPVGRADNAYGDRNLFCSCVPVSDYA

SEQ ID NO: 9331 - protein, 1126 aa, Arabidopsis thaliana
MVRSKAPAKKQQKKGIDFKKIKRKLGRKLPPPKNATNTEIKSKAIILPEQSVAAEKSGLATSKKGLTLKELLPQTSHHNAKVRKDALYGIKDLFKNHPEELQSHKYAIIQKLRERISDDDKLVRDVFYQLFDIDIFPLCKEDNQGLMVSLLMPYIFSAMAHSAIDVRLMAFKFFHLVVEFYPPTFSLDAEKILENYKDIIQKNHFYVEDKSKLKVALSGLSHCLSVLPCDESDTKSQKKGPSQNETLLTYEQDATKDCVRYAHVYQRLKEVVAVLINCFQDFIPLIHAPRGFDAHSFDCIQHILRSIGYAIKFSIRRHKQRQTAWRPASEEVTLMILDQDIASMLLKKLLGSFPLDPENNLYGKGDDKYFKLNSVLTEIFLEVSEWSHLPTDLSNRYLEFIENTLLGKITRSIRLRKDIHEKTLLALLPFLPKLILRVDRDWRDNLLEAFTITFSDCKPESKLKLACISTVRDMIIPNGDILYPNASDPTVHYYQVAWVNKLPSLLNQLGNEHPVSTQVVLQLLLDLGRVGCLNASPTCEDDIRNFFSLCQGEGDVPGGPFASLPREAQELALCFLYYFTTDKFSSPMMKAIVSCCLYPQLEPAVLYRIVEILHTAYRAGYIQITDHFSFLITLIARFKVVPEKLQSSIECNERETYCGTFKEVTKLVCSCLSEMGDSSLVLQIVEKVLLEQIVLKPALDNGCAILRMICVLDSTPTTLSERSVTTLSEFLPGYMINIVNCIPEDKENSYLYIQTCLYYLVPCYFLFNRSSKLTEQVLIRMRSMISENTKALESVQDRESGRNSLNMIQCIISVILLMHNDVKVRKIISSFKPEIDLILQNVITLQSSRSTSLTVEGKHMMKIAGERLRIASKSLLAKRNGYRLDHFERKRKKEAREVHKHSTMAQKSLGIKGKMIAKKNYAEKALMKKTLKMHEESSSRRKADENVQEGAVPAYLLDREDTTRAKVLSNTIKQKRKEKAGKWEVPLPKVRPVAEDEMFRVIRSGKRKTKQWKRMVTKATFVGPAFTRKPPKYERFIRPSGLRFTKAHVTHPELKCTFCLEIIGIKKNPNGPMYTSLGVMTRGTIIEVNVSELGLVTPAGKVVWGKYAQVTNNPENDGCINAVLLV

SEQ ID NO: 9332 - protein, 592 aa, Oryza sativa
  misc_feature (359)..(359): Xaa can be any naturally occurring amino acid
  unsure (1)..(592): unsure at all Xaa locations
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARAXRLVPAWLAKVHPSTGTPMNATIFLDRANGSIKYTNNFTEVKVLTTVSDHENCNAGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 9333 - protein, 398 aa, Bacillus cereus E33L
MHHLLNSRVKQIEISKIRQISEMAARYDNVISLTIGQPDFYTPEHIKSAGQAAILNNKTSYPPTSGYKELLISAAGFLQQKYGLHYDSNSEILVTNGATEGIYIALRSILDEDSEVILPAPIYSGYEPIIRLCGARPVYVDTSSTDFKITAQALENAISEKTRCIILAYPMNPTGATLSKKEMNEIRNVLIDKEIFVVSDEIYSELNLDNEHVSIAQTEGMKYKTIIVNGLSKSHAMTGWRIGFTFAPSYITEQMKKVHQYAVTAVSSISQMAAIDALTVGRNDASVMREEYRKRRDYVLKRLKSMKFDVIKPEGAFYIFPSISKFKITSHQFAIDLLENAKVAVVPGDAFSEFGEGYIRISYASSMVELKEALDRIENYMNTKYESFYRMYSAKLEL

SEQ ID NO: 9334 - protein, 670 aa, Methanosarcina mazei Go1
MKFKYILMATDLLTDLLIIFGLSIPVVFTFSKLKIAPLVGFLLVGILAGPFGLGLVQDLGNIEMLAEIGVILLLFTIGMEFSLRELLQLRRIVIFGGGLQLFITTLAAAFIFLILGISRETAIFLGLLVALSSTAIVLKILQEKGEIYSLHGRTSLGILIFQDVAAVMIILLIPLLAGTQGTEKSFLELIMQGFGLILFTIFSARYAVPFIMFQVAKTRNSELFLLSVVAIGLAVAWLTSMVGLSLALGAFLAGLIISESEYSIQALGNLIPFRDMFMSIFFISMGMLLDLGVLREHLPLILAATLGVLILKAAANSLSTFLIGFPLHTMILVGFSLSQVGEFSLILAKVGFTSGLITTEIYQEFLDIAVISMVLTPFIMSMGYRTTSFAESLPLPSIVKTGWYRHFKEHVPQDAPENHVIVIGFGINGRNVAAAAKSSSIPYRIIEINPETVRQEKQKGEHILYGDAAQKAVLEHAGIRAAKSVVVTAGDPVSARRVIEAARRLNPEVHIIARTHFLSELDKFHIAGADEVISDEFESSIEIFTRVLHRYLVPSSEIDSLGSTLRSDHYRMLRSPDIPRKKFCDLALDFADVEIRSIRVGELSRAAGMTIGDLNVRKKYGVSILAISRNHKLISELQAETKIHSSDILLVISPPEKLDEVKKLFEDQVG

SEQ ID NO: 9335 - protein, 471 aa, Acidovorax sp. JS42
MAKTVADVMKMVKENEVKFVDFRFTDTRGKEQHVTVPISHFDEDKFASGHAFDGSSVAGWKGIEASDMLLMPDPNTANIDPFFEETTMIMACDVVEPADGKAYDRDPRSIAKRAEAYLKASGMGDTAYFGPEPEFFIFDGVRWSTDPNHTFYEIEEYEAPWNTGAKLEGSNRGHRPTTKGGYFPVPPVDSTQDMRAEMSLILESLGIPVEVFHHEVAGAGQNEIGTRFSTLVERADWTMLQKYVIHNVANAYGKTATFMPKPYHGDNGSGMHVHQSVWKDGKNLFAGDGYAGLSDFALYYIGGIIKHARALNAITNPGTNSYKRLVPHFEAPVKLAYSAKNRSASIRIPFVANPKGRRVEARFPDPLMNPYLGFAALLMAGLDGVENKIHPGEAATKDLYHLPPEEDKLVPTVCHSLDQALEALDKDRAFLTKGGVFTDSMLDAYIELKMQEVTRFRMAVHPVEYDMYYSL

SEQ ID NO: 9336 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGITLTDTFVKLVS

SEQ ID NO: 9337 - protein, 255 aa, Triticum aestivum
RLCTCLPLPSIKSPFSIPISISKSVTMSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWG

SEQ ID NO: 9338 - protein, 333 aa, uncultured bacterium 311
MKLDISSLGNAIVDVQFSIEEDFVSKLEKMSIPKGSMTLIEAEEQSNLIKLLMAEYGNSKLSCGGAATNSIVAASNFGSKCHFSCRVKNDDLGIFYLEDLGKNNVLHSNRVSESDLSTGQSVIMVTPDAERTMCTYLGVSNLLSNDDLNKSAIKDSQYLFLEGYLVASESALEACFEASKVAKASGTKIAISLSAEAIINAFRDQMNSLIKQGCDILFCNESEARAFSQCEDVLEAEKSLREVSSQNLITLGKDGSRIWDGSKTETIKGFEAKAIDTNGAGDIFAGSVLHKICEGKDLKTAAKFGCYAASKQVEKFGPRLTESEYRKIKEEFS

SEQ ID NO: 9339 - protein, 329 aa, Arabidopsis thaliana
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQVE

SEQ ID NO: 9340 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 9341 - protein, 93 aa, Oryza sativa (japonica cultivar-group)
MERVASSCLSLLAQRRGYSVAAAVAKGAGRRADEKKVAAAVAKRTMAKAAEEKTAWVPDPVTGYYRPAGGAKEVDAAELRAKLLSNSKRMAAN

SEQ ID NO: 9342 - protein, 131 aa, Cryptococcus neoformans var. neoformans JEC21
MSSGGKGKASSETKSSSRSSKAGLQFPVGRIHRLLKKGNYAQRIGSGAPVYLAAVLEYLAAEILELAGNAARDNKKSRIVPRHLQLAVRNDEELNKLLGSVVISQGGVLPHIMAELLPVKTKGKAKASQEV

SEQ ID NO: 9343 - protein, 362 aa, Medicago truncatula
MKITIHHHTYMSCSNKRNPILVVVVSCVPKLRFNSNSKNCALFFCCIARCTVASDNTQHNITMVVTTTRISSLLHCTHTFPQHHRDTIITTTTTTLNSRRRKGSLRVSMAAVKEVMVVMEEEEKKKLQLEDQSKWPKSVVDVGCGIGGSSRYLAKKFGANCVGITLSPVQAERANALAAAQGLADKVSFQVADALQQPFPDGQFDLVWSMESGEHMPNKPKFVGELARVAAPGGTIIIVTWCHRDLRPDEESLQQWEKDLLKKICDSFYLPEWCSTADYVKLLETMSLQDIKSADWSPFVAPFWPAVIRSALTWKGFTSILRSGLKTIKGALAMPLMIEGFRKGVIKFAIITCRKPENADGQ

SEQ ID NO: 9344 - protein, 108 aa, Arabidopsis thaliana
MASSMLSSATMAASPAQATMVAPFHGLKPSAAFPATRKVNNDITSITRNGGSVHWMHVWPPIAKKKSGTLSYLHDLTDSELPKEDDYLIRNPRIPCAEFELGYRTRVP

SEQ ID NO: 9345 - protein, 367 aa, Vibrio vulnificus YJ016
MTLNKLSPIITCRCLLDSVILLPVIFNQKLSCGATIMTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 9346 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 9347 - protein, 336 aa, Debaryomyces hansenii CBS767
MTSFDPESISYFNPNVDRRVALITGGNSGVGWYTVLHLYLHGYIVYIAARSKTRVNTSINELKEEAMVIRLKYTSQQSSNERFLGELYFLDIDLLSLSSVLNAVKTFKSREKHLNILINNASVMALPYSITKDGFEIQMQTNYISPFLLTTKLLPLLESSSELFPKSGPPKIIYLSSIGHQLAFKYFNLNSTFNYRPNIVFTWFRYGLAKTCGIHFMKMLALRNPKILCMSVHPGFVMNTNLFSYWTRLPIIGILFWCLFQIFGFLFGVSSEQGSYATVRCCLDPKLSLEEDNGKYFATNGAEAEPSKIARNMNFAARTWIWTVQELSERKISIPN

SEQ ID NO: 9348 - protein, 480 aa, Cryptococcus neoformans var. neoformans JEC21
MPASQPLQLLFLGTATSTGLPLTPCLTLSTPYPHRWSNMVPLLQGRDLSDRSPSPASTTISSTYSGSTYDPEGQWPKNIPCACCRSTVDPDVPEGWKNKRGNTSVLLRKQSAEGDWKNVLVDVGKTFREQAMRFFPTWGVKTIDAVLLTHGHADAYFGLDDLREWCVRQGKAIPVYLNKETFHKVEETFPYMVDKTKVSGGGDVPQLIWKIIEDEGEFQVEGIDVKVLPVHHGIYFHSILPPTNAEPVREPPAKIEPEPLICLAFEFDDSIIYMSDVSGIPQRTWDRMLQTSSRRQTIFPTPVDSRGGDDTPKGVPKNQSISDLANLSISPRVPGRLEQLRTHNVPVLIIDALWPLQPHASHFSLAQALIAALRLRAANTYVIGSTHPTSHFMWEEICNSLTHRDGRDYEVRDHPDAAQAEWLVKRVWDKVFGEGEHEGLGERWMEEGGKVKPAWDGLVIEVGGDQGLERADLSSKGLLI

SEQ ID NO: 9349 - protein, 388 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 9350 - protein, 449 aa, Bacillus halodurans C-125
MAKFTREDILRIAQEDNVRFIRLQFTDLLGTIKNVEIPVDQLPKALDNKMMFDGSSIEGFVRIEESDMYLYPDLDTWVIFPWTPEKGKVARLICDVYQPGKPGEEPKPFLGDPRGILKRVLKEAEALGFTAFNIGPEPEFFLFKNDESGEPTLELNDKGGYFDLAPTDLGENCRRDIVLELEDMGFEIEASHHEVAPGQHEIDFKYADAVTTCDNIQTFKLVVKTIARKHGLHATFMPKPLFGVNGSGMHCNMSLFRGKENAFFDESTESQLSGTAMQFLAGILKHADSFTAITNPIVNSYKRLVPGYEAPVYVAWSMRNRSPLVRIPSSRGLSTRIEVRSPDPAANPYLAMAAMLAAGLDGIKRKLTPPAATDRNIYVMSKEERDEEGIRDLPSTLKEAVDNFLKNDVLVEAIGEHAVEHFVEAKEIEWDMFRTQVHPWERDQYMQTY

SEQ ID NO: 9351 - protein, 393 aa, Streptococcus mutans UA159
MVYSVKTFNNINQVGLKELGNKFQVDGDLAENPDAYIIRSQNLHGVDFPKNLKAIARAGAGTNNIPITEATEAGIVVFNTPGANANAVKEAVIASLLFSARDYISANGWVNTLTGDDVPKQVEAGKKQFAGSEIAGKTLGIIGLGAIGARIANDARRLGMNVLGYDPYVSIETAWNISSHVKRVNDLKDIFENSDYITIHVPLNDETKNTFNADSFALMNKGTTIINFARGELVDNEALFEALETGTVKRYITDFGTEELLNKKGITVFPHVGGSTEEAELNCAIMAGKTIRRFIETGEITNSVNFPNMHQTLTAPYRITLINKNVPNIVARLSTAVSNLDINIANILNRSKGDYAYTILDLDETDKAKIDDLVANFEASDNIVRVRLIKGKK

SEQ ID NO: 9352 - protein, 473 aa, Rickettsiella grylli
MIKISNPNGLVYTISGFAALAGLLFGYDTGIISGAILFIKKDFFLTNFQIECVVSAVLLGALIGSGVSGRVSDLFGRRKILLFTSMTFILGSLITAFSPNLTFLMIGRIVLGLAIGIGSFTAPLYLAEIAPKRIRGLLVSLNQLAITIGIVFSYMINYYFSVSGGWPWMFGLGVIPAIILFLGTLYLPESPRWMILKGWNQKARTVLQYLRHNENITKEFDEICQTVAIEKGTHRQLLAKWLRPILFISLGLSFFQQVTGINAIVYYAPTILQLAGFKYASNAILATLGIGIINVLFTLVALPLIDRWGRRPLLLYGLLGMFISLVSLGLAFYLPGFTQLRWVAVASMILYIASFAMSLGPIMWLIISEIFPLNIRGVGASLAISMSWGFNLLVSLTFLTLIEWIGTSYTFWLYSFLCILGWIFVYFIVPETKNCSLEQIENNLRLGRPSRELGAALRLSSLFEKLKKTVAFF

SEQ ID NO: 9353 - protein, 255 aa, Haemophilus somnus 129PT
MARRPLVMGNWKLNGSKAFTKELITGLKDELNAVSGCDVAIAPPVMYLAEAETALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSVNDANAAELFTQPDIDGALVGGASLKASAFAVIVKAAAKAKN

SEQ ID NO: 9354 - protein, 1115 aa, Gibberella moniliformis
MSATALFTRRSVSTSNPELRPIPGPKPLPLLGNLFDFDFDNLTKSLGELGKIHGPIYSITFGASTEIMVTSREIAQELCDETRFCKLPGGALDVMKAVVGDGLFTAETSNPKWAIAHRIITPLFGAMRIRGMFDDMKDICEQMCLRWARFGPDEPLNVCDNMTKLTLDTIALCTIDYRFNSFYRENGAAHPFAEAVVDVMTESFDQSNLPDFVNNYVRFRAMAKFKRQAAELRRQTEELIAARRQNPVDRDDLLNAMLSAKDPKTGEGLSPESIVDNLLTFLIAGHETTSSLLSFCFYYLLENPHVLRRVQQEVDTVVGSDTITVDHLSSMPYLEAVLRETLRLRDPGPGFYVKPLKDEVVAGKYAVNKDQPLFIVFDSVHRDQSTYGADADEFRPERMLKDGFDKLPPCAWKPFGNGVRACVGRPFAMQQAILAVAMVLHKFDLVKDESYTLKYHVTMTVRPVGFTMKVRLRQGQRATDLAMGLHRGHSQEASAAASPSRASLKRLSSDVNGDDTDHKSQIAVLYASNSGSCEALAYRLAAEATERGFGIRAVDVVNNAIDRIPVGSPVILITASYNGEPADDAQEFVPWLKSLESGRLNGVKFAVFGNGHRDWANTLFAVPRLIDSELARCGAERVSLMGVSDTCDSSDPFSDFERWIDEKLFPELETPHGPGGVKNGDRAVPRQELQVSLGQPPRITMRKGYVRAIVTEARSLSSPGVPEKRHLELLLPKDFNYKAGDHVYILPRNSPRDVVRALSYFGLGEDTLITIRNTARKLSLGLPLDTPITATDLLGAYVELGRTASLKNLWTLVDAAGHGSRAALLSLTEPERFRAEVQDRHVSILDLLERFPDIDLSLSCFLPMLAQIRPRAYSFSSAPDWKPGHATLTYTVVDFATPATQGINGSSKSKAVGDGTAVVQRQGLASSYLSSLGPGTSLYVSLHRASPYFCLQKSTSLPVIMVGAGTGLAPFRAFLQERRMAAEGAKQRFGPALLFFGCRGPRLDSLYSVELEAYETIGLVQVRRAYSRDPSAQDAQGCKYVTDRLGKCRDEVARLWMDGAQVLVCGGKKMANDVLEVLGPMLLEIDQKRGETTAKTVVEWRARLDKSRYVEEVYV

SEQ ID NO: 9355 - protein, 346 aa, Bacteroides fragilis YCH46
MLAYTYVEHGKFELLEKLRPQIKDARDVIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 9356 - protein, 418 aa, Brucella melitensis 16M
MTAHTNSPRIMVIGTGDTKSDELLFMADVIERAGGSPVMIDVSILGNPPYEPAYSKHDVAEAAGTTVQAIIDSGDEHSAMALMAEGATALVRGLSQRGQVDGMIALGGSLGTDLALDIAAILPLVVPKFIVSTIAYSHLLPPERIAPDLMMILWAGGLYGLNPICRSVLSQACGAVVGAAKLVEKPSAEKPLIGMTHLGSSCLKYMRFLKPELEKRGYDVAIFHATGMGGRAYEAVAAQKGFVAVFDFCIQEVTNAESGSVVTSGPDRMENAGRAGIPQIIAPGAVDMVDMPAWQNVPEQFRDRPYHAHNRLIASITVSPEQRRAVARVVAAKLERAAAPVAFILPTGGVQEWDRNGEPLHEPEALGAFLDEMRGAVSGTITFEEVDAHINAPEFASRALAVFDRWVAEGIVVKGNVA

SEQ ID NO: 9357 - protein, 465 aa, Vibrio cholerae O1 biovar eltor str. N16961
MFIPVIMAGGSGSRLWPLSRSAFPKQFLSLDSSSQHTMLQATIERLQGLPIAEPIVISNEDHRFIVAEQIRRYGKKSRIILEPAGRNTAPAIALAAFTAIEQEDDPVLLVLAADHFVKNKSAFQAAISQAAQQAEAGKLATFGIVPTTPETGYGYIHRGEEVTQGTYEINSFVEKPQLNIAEQYLASGEYYWNSGCFMFKASVFLNELKQHSPEIYRQCELAMQGLSHDYDFIRVGVEEFLKCPDDSIDYAVMEHTKLGVVVSMDAGWSDVGSWSALWEVSDKDADGNVCQGDAILSGTSNCYIYAPNKLVAAVGLKDIVVVETKDAVLVADKNQVQEVKKIVEHLKAENRAEYREHRERYRPWGKSDAIDKGERYKVNRITVEPGKKQSLQMHYHRAEHWVVVSGTAKVTCEGNVKVITENQSLYIPIGTNHMIENPGKIPLELIEIQSGSYLNEDDVVRFEDK

SEQ ID NO: 9358 - protein, 308 aa, Coccidioides immitis RS
MADQNEIDLDSIIDRLLEVRGSRPGKQVQLLESEIRHLCTKAREIFISQPILLELEAPIKICGDIHGQYYDLLRLFEYGGFPPEANYLFLGDYVDRGKQSLETICLLLAYKIKYPENFFVLRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 9359 - protein, 181 aa, Kluyveromyces lactis NRRL Y-1140
MRQLTEEETKVIFEKLAGYIGRNIVYLVDNKDQPHVFRLQKDRVYYVPEHIANLATSVARPNLMSLGLCMGKFTKTGKFRLHITSLSVLAQYAKYKVWIKPNGEMPFLYGNHVLKAHVGKMSDDIPEHAGVIVFSMHDVPLGFGVSAKSTSESRDLQPTSIVAFRQADIGEYLRDEDTLFT

SEQ ID NO: 9360 - protein, 288 aa, Brucella melitensis 16M
MRRHRSHRKGQPDMSAPVTRKRLTPKVIQAMKGECPIVSLTAYTTPVARLLDPHCDLLLVGDSLGMVLYGMESTLAVTLDMMIMHGQAVMRGTSHACVIVDMPFGSYQESKEQAFRNAARVMQETGCDGVKLEGGEEMAETVAFLVRRGIPVFGHVGLMPQQVNTVGGFRSLGRGDDEAGKIRRDAQAIAQAGAFAVVIEGTVEPLAREITALIDIPTVGIGASSACDGQVLVSDDMLGLFQDFTPRFVKRFAHLAPQVSQAAEAYAEEVRARRFPGPEHVFGAKPGA

SEQ ID NO: 9361 - protein, 473 aa, Pseudomonas fluorescens PfO-1
MPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 9362 - protein, 461 aa, Rhodopseudomonas palustris CGA009
MSIAAIDDRPASRAPLIPPTPPRAPENLSALGRLAAIRHNAIASWGDRAYQDDVVRGRFFAHSSYILNTPDAIRHVLVDNTDNYRRTATGIRVLRPMLGEGLLLAEGRAWKHQRRTLAPAFTPRAVATLVPHMASATDEVVEGLRRKTGVPLDLRETMQHLALEIAGRTMFSFEMGTHGQALRGFVIDYGTRLASPRFLDLLLPLGWPTPQDVSRALFRRRWTRFIGELIAARRAAGKAEGAPPRDLFELMLAARDPETGEAFSDAQLGDQVATMILAGHETTATALFWALYLLALDPDAQERLANEVRRVGFGGTEIERLPFTRAVLDETLRLYPPAFLIVREAAGPDRVAGFAVRKHDVMLIAPWLLHRHDKLWSDPNAFVPERFLPGVPSPDRFAYLPFGVGPRVCIGAHFALVEATLALAKIVGTFRIELIDTEPVIPIGVVTTQPDRSPLFRLTPR

SEQ ID NO: 9363 - protein, 290 aa, Mannheimia glucosida
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 9364 - protein, 108 aa, Magnaporthe grisea 70-15
MSAKYAFTQSLKEVRFLFCQTADHSAGVRSFLMRAYPTMKKNNPTTPILIREAAGTIPKVYARYDLGVEKSQSLEGLSDKQIEDAVTGLVKQGHIPKLQALVLLGGKS

SEQ ID NO: 9365 - protein, 174 aa, Arabidopsis lyrata subsp. petraea
EEKKIKKVVDVGCGIGGSSRYLASKFRAECIGITLSPVQAKRANDLAAAQSLSHKVSFQVADALDQPFEDGKFDLVWSMESGEHMPDKAKFVKELVRVGAPGGRIIIVTWCHRNLSTGEKALQPWEQNILDKICKTFYLPAWCSTDDYVKLLQSHSLQDIKCADWSENVAPFWP

SEQ ID NO: 9366 - protein, 291 aa, Streptococcus mutans UA159
MKIADKTVTRAILERHGFTFKKLFGQNFLTDTNILQKIVDTAEIDKTVNVIEIGPGIGALTEFLAENAAEVMAFEIDDRLVPILADTLRDFDNIKVVNEDILKSDLQTRIKEFANPDLPIKVVANLPYYITTPILMHLIESKIPFAEFVVMMQKEVADRISAQPSTKAYGSLSIAVQYYMTAKIAFIVPRTVFVPAPNVDSAILKMTRREQPLVQVQDEDFFFCVGKAAFVHRRKTLWNNLTSHFGKSEEVKVKLEQALEAADIKPSIRGEELTITDFARLADALREVDLK

SEQ ID NO: 9367 - protein, 251 aa, uncultured bacterium 578
MGYYSPLIKLLPDDLECHFFDTISSTNLFLNNSPTSKKNQLCVAREQTQGKGQHGRKWLSQKDGSILFSIRKIFAQETNLNGLSLVVGLAIIKVLEEECLVEGFKIKWPNDIYFKSKKIAGILLENQIQLDNQFVVIGVGVNYNLNQNFVCKIPWTDLSNSAKKLPDMHSLTAKLIDSILFTSEHFKMNGLSSLLDQWDRYDMLKESKVRLIESGQPIEGKVTGISQQGALQVLTQNGVKELYSSKYIEFI

SEQ ID NO: 9368 - protein, 425 aa, Xylella fastidiosa Ann-1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIAAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKLRSAAA

SEQ ID NO: 9369 - protein, 192 aa, Arabidopsis thaliana
  misc_feature (32)..(32): Xaa can be any naturally occurring amino acid
  unsure (1)..(192): unsure at all Xaa locations
VAEFVFSGQVNVRNHISTIVPPPSRLCLLVAXVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 9370 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 9371 - protein, 424 aa, Triticum aestivum
  misc_feature (151)..(151): Xaa can be any naturally occurring amino acid
  misc_feature (351)..(351): Xaa can be any naturally occurring amino acid
  unsure (1)..(424): unsure at all Xaa locations
MSAFVGKYADELIKTAKYIATPGKGILAADESTGTIGKRLASINVENVESNRQALREMLFTAPGALEYLSGVILFEETLYQTAADGTPFVDILKAGNVIPGIKVDKGTVDIAGTVGETTTQGLDSLGARCAKYYEAGARFAKWRAVLKIGXAPEPSELAVKQNAEGLARYALICQENGLVPIVEPEILTDGPHDIKACAAATERVLAAVYKSLNDHKVLLEGTLLKPNMVTPGSDSPKVGAEVIAEYTVAALRRTVPPAVPGVVFLSGGQSEEQATQNLDAMNKLAVLKPWTLTFSFGRALQQSTIKKWAGKKENVADAQATFLARCKGNSEATLGKYGGAAAGGDAAASXESLHVAGYQVLRHRRSRAIPGPRISVQPVCACARRGTWIAPRFVRACRYICSSFSAVYLNSLSLPLLLFNQNY

SEQ ID NO: 9372 - protein, 330 aa, Coccidioides immitis RS
MKAASIKLNSGYEMPLVGFGLWKVNNDTCAEQVYNAIKVGYRCFDGACDYGNEVEAGQGVARAIKDGLVKREDLFLVSKLWNTFHDPEHVEPICKKQLADWGIDYFDLYLIHFPIALKYVDPSVRYPPGFTYEGNKIILSNASTQQTWTAMESLVDKKLTRSIGISNFNAQLIMDLLRYARIPPATLQIEHHPYLTQPDLVRYAQKSGIAVTAYSSFGPQSFVELEMEAAKRAPLLLEHPDIKSIAQDHGKAPSQVLLRWATQRGIAVIPKSNNPNRLAMNLDVLGFDLTEDEIKTISGLNQGLRFNNPPRVSFDLLESSSHQRAIWLTC

SEQ ID NO: 9373 - protein, 295 aa, Pasteurella trehalosi
AQNRDDIEVVGINDLIDVDYMAYMLKYDSTHGRFDGTVEVRDGKLVVNGKEIRVTAEKDPANLKWDEIGVDVAVEATGIFLTDETARKHITAGAKKVVLTGPSKDNTPMFVNGVNFNTYAGQDIVSNASCTTNCLAPLARVIHETFGIKEGLMTTVHATTATQKTVDGPSAKDWRGGRGASQNIIPSSTGAAKAVGKVLPALNGKLTGMAFRVPTANVSVVDLTVNLEKPATYEQIKQAIKDAAEGKTFNGELKGVLGYTEDAVVSTDFNGAVETSVFDADAGIALTDTFVKLVS

SEQ ID NO: 9374 - protein, 493 aa, Schizosaccharomyces pombe
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 9375 - protein, 324 aa, Arabidopsis thaliana
MMESSIPSENGSVTSDRDRSALIFLGTGCSSAVPNAMCLIQRSDNPCYVCSQSLSIPPEKNPNYRGNTSLLIDYCQSDGKHKYIQIDVGKTFREQVLRWFTLHKIPQVDSIILTHEHADAVLGLDDIRSVQPFSPTNDIDPTPIFVSQYAMESLAVKFPYLVQKKLKEGQEVRRVAQLDWRVIEEDCEKPFVASGLSFTPLPVMHGEDYVCLGFLFGEKSRVAYISDVSRFPPNTEYAISKSGGGQLDLLILDTLYKTGSHNTHLCFPQTLDTIKRLSPKRALLIGMTHEFDHHKDNEFLEEWSKREGISVKLAHDGLRVPIDL

SEQ ID NO: 9376 - protein, 558 aa, Lactobacillus plantarum WCFS1
MEKWWKNAVVYQVYPSSYQDSNNDGIGDLPGITKRLDYIKKLGVDIVWLSPIYKSPQVDNGYDISDYRAINPDFGSMEDFDKLLGKAHDLGLKIMMDLVVNHTSDENKWFEESRKSKTNPYRDYYIWRDGNAGKSPNNWGSFFRGPAWKYDEQTGQYYLHLFAPQQPDLNWENPNVRHSVYDMMNWWASKGVDGFRMDVINYISKPEGLPDAQLQADEELGNPEPLVANGHRVHEFLQEMNNKVMSKHRMVTVGEAPSVTTDEAIKYAGLDGKELDMVFQFEHMGLDGNENPVLGHWSDRKASLKDLRSNLTKWQEALEGKAWNSLYWNNHDQPRVVSRFGDDSNEEYRVLSAKMLATMLHLQQGTPFIFEGEEIGMTNSYFKKLSDYVDLDSINTYHQFVDKQHLVGSQTMLKYLAMHSRDNARTPMQWNSTDNGGFSKHEPWEHVNPNYKHINVKQSLDDPNSIFYYYQKLIRLRHELPVITDGKYRLVKGNEDDEAVYAYTRKDENTTLLVILNYTKTTLDRDYQVPDNAELVINNYPDDKGNTLRPYEAKVYKY

SEQ ID NO: 9377 - protein, 540 aa, Novosphingobium aromaticivorans DSM 12444
MTVSHSDGLDRNMTKPKVLISDKMDPNAARIFTEMGCDVDVITGETPEQLIARIGEYDGLAIRSSTKVTKAILDAATNLKVIGRAGIGVDNVDIPAASAQGVVVMNTPFGNSITTAEHAIAMMFALARQIPEANAQTQAGLWPKNGFMGVEVTGKTLGLIGAGNIGSIVASRALGLKMKVVAFDPFLTPERAVEMGVEKADLETLLAKADFITLHTPLTDQTRNILSRENIAKCKKGVRIINCARGGLVDEAALKDALDSGHVAGAALDVFETEPAKESPLFGTPNFICTPHLGASTTEAQVNVALQVAEQMADFLVTGGVTNALNMPSLSAEEAPKLRPYMALAEKLGSLVGQLAHDNLTKIAIEVEGAAAQLNQKPITAAVLAGLMKQYSQTVNMVNAPFLAKERGLDVREVRHDREGEYRTLVRVTVSTSQGERSVAGTLFGNGQPRLVEIFGIGIEADLDGDMLYIVNSDAPGFIGRIGTLLGQNTINIGTFHLGRREAGGEAVLLLSLDNPVSEDVLKEAREIQGVRVVKALKFA

SEQ ID NO: 9378 - protein, 312 aa, Brassica napus
  misc_feature (160)..(160): Xaa can be any naturally occurring amino acid
  misc_feature (179)..(179): Xaa can be any naturally occurring amino acid
  unsure (1)..(312): unsure at all Xaa locations
QTHTITPCSPSKQRHLRSSTGDTKSKPLRSSSSSATPEWIAEAINGGSLRRVDPETGTDGWASPPGDVFSLRSDSYLTKKQKSPAGDYLLSPAGMDWLKSTSKLENVLARPDNRVAHALRKAQSRGQSLKSFIFAVNLQIPGKDHHSAVFYFAAEGPIPXSGSLLHRLINGDDSFRNQXRFKIVNRIVKGPWVVKAAVGNYGACLLGKALTCNYHRGDNYFEIDVDICSSAIATAILRLALGYVTSVTIDMGFLAEAQTEEELPERLIGAVRVCQMEMSSAFVVDAPPPQQLASQPCRTLSLAKVNHDEDED

SEQ ID NO: 9379 - protein, 459 aa, Listeria monocytogenes
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVKEGFRPDAVIVDPPRSGCDQGLIKSLLDVEAKQLVYVSCNPSTLARDLALLAKKYRIRYMQPVDMFPQTAHVETVVLLQLKDK

SEQ ID NO: 9380 - protein, 532 aa, Anaerobranca gottschalkii
MTSKILRVLLVFLLIFAIVGCTSDKQGPQETYKNIDDTVTHGQNYDGSFSREGIQEVTFENGVFYQIFVYNFRDSTGDGVGDLGGIIESLDYIESLGVNGIWLTPITHGASYHKYDVVDYYAVDPEFGTMEDFETLISEAHKRGIKVIIDLVINHTSDRHPWFKAAASDPNSKFRDYYIWAAHDEPRPGSGWRHLSGTTWFYLAHFWERMPDLNFDNPAVREEVKRIAKFWLDKGVDGFRLDAAKHLYSDPAKNHQFWNEFYQYLRTLKEDVYLVGEIWDSPEVIAPYFANGLNANFNFQIGGRVASSINSGVDNLGKELDRIYKLYREHNPDFIDAPFLSNHDTRRIMSEFDYDFEKMKMAANVLLSLPGDPYIFAGEEIGMISNDNHMDIREPFKWYKDTGPGQTTWRPNAFNSTEKWSPSVEEQDKDPNSLLNHFRKMVNLRNSHYPLRYGNDFQLVENNNLTVLSFIREYQGERVLVVHNFYSQPQTITVTVEGTFTNFKGTKSGANFTQRGNEITITIPPLSSMFIY

SEQ ID NO: 9381 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 9382 - protein, 857 aa, Brassica oleracea var. alboglabra
MKDVRIYHHSFLLVFVVVILFHPALSIYFNILSSTATLTISSNRTLVSPGDVFELGFFKTTSSSRWYLGIWYKKLYFGSIKNYVWVANRDSPLFNAIGTLKISNMNLVLLDQSNKSVWSTNLTRGNERSPVVAELLANGNFVMRDSNNKDASGFLWQSFDYPTDTLLPEMKLGYDHKTGLNRFLTSWRSSDDPSSGEISYKLDTQSGMPEFYLLINGSPDHRSGPWNGVQFSGIPEDQKLSYMVYNFIENTEEVAYTFRMTNNSIYSRLTISSKGILERWTWTPTSFSWNLFWSLPVDLKCDLYMACGAYSYCDVNTSPECNCMQGFMPFNMQQWALRDGSGGCIRRTRLSCSSDGFTRMKKMKLPETRMAIVDPSIGLKECRKRCLSDCNCTAFANADIRNGGTGCVIWTGELEDIMTYFAADLGQDIYVRLAAADIVKKRNADGKIITLIVGVSVLLLMIMFCLWKRKQKRAKAMATTIVNRQRNQNLLMKLMTQSNKRQLSRENKTEEFELPFIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAIINGVARGLLYLHQDSRFRIIHRDMKPSNILLDKYMIPKISDFGMARIFARDETEANTENAVGTYGYMSPEYAMDGVISEKTDVFSFGVIVLEIVSGKRNRGFYQLNPENNLLSYAWSHWAEGRALEIVDPVIVDSFSSLPSTFQPKEVLKCIQIGLLCIQERAEDRPTMSSVVWMLGSEATDIPQPKPPIYCLITSYYANNPSSSRQFEDDESWTVNKYTCSVIDAR

SEQ ID NO: 9383 - protein, 487 aa, Medicago truncatula
MELQWFWMFAATLLACYIFVSKVMRNLNGWYYDLIFKNKQYPLPPGDMGWPLIGNLWSFFKYFYSGRGEMFINNIIFKFGRTGIYKTHLYGSPSIIVIAPAICKKVLIDEVTFKIGYPKSALELGDSKILHKERGRFKQLVSSPINGHNVLEMYLERIEDIVINKLEELSSMKHPVEFLTEMKKASFEFVIHIFFDSCDQDTVNKIGDLFNVMSIALLSFMPINVPGFAYNKALKARMEFVKIIENIICGRRMAIKNGQIGENNNLLDIILETKDERGEKLEDKDIIDLLIAFLFGAHDSIATASMWSVMYLAQNPLCLKKAKEEQEGILKARSTSQKRLSIEEIKKMIYLSQVVDETIRHITIFSAFREAAIDVNINGYFIPKGWKVLVWLSALHMDPEYYSNPKEFNPTRWDDYNPGSGTFIPFGVGRRLCPGRDLAKYEISIFLHYFVLNYKLERINPECPITSFPYSKPIDNCLAKVIKISDS

SEQ ID NO: 9384 - protein, 477 aa, Colwellia psychrerythraea 34H
MNTKTTSSAVSIFPAIMCGGSGTRLWPLSRALFPKQFLPLVNDTSMLQDTLLRLPENSKEAVFICNEEHRFLVAEQVRQLSSSQGTILLEPEGRNTAPAVALAAINALEKDKGALLLVLAADHVIQDTAAFHQAVEQASIVAQQGKLVTFGIVPTHAETGYGYIKKGNVQSSGTFDVAEFVEKPKQDIADEYLASGDYLWNSGMFLFKASRYLEELAKHRGDILENCQRAMKGVEQDLDFMRPNKADFLACASESIDYAVMEKTDSAVVIPLDAGWSDVGSYSALWEVCQQDDDKNVLKGDVIAQQTTNSYIHSQNKLIATVGVDNLVIIDTPDAVLVANKDKVQEVKQIVEQLKADKRSEAVLHREAYRPWGKYDCIDTGERFQVKRITVKPGAKLSVQMHHHRAEHWIIVSGTAKVTIDEKVVLLTENQSAYIPVGAVHALENPGKLPLEMIEVQSGSYLGEDDIVRFEDKYGRS

SEQ ID NO: 9385 - protein, 125 aa, Brassica napus
MGTSVQVSPLCGVYNENPLAYLVSIDGFNFLLDCGWNDLFDTSLLEPLSRVASTVDAVLLSHPDTLHLGALPYAMKQLGLSAPVYATEPVHRLGLLTMYDQYLSRKQVSDFDLFTLDDIDSAFQN

SEQ ID NO: 9386 - protein, 141 aa, Halomicrobium mukohataei
ERTFVMVKPDGVQRGLIGDIVSRFEDRGLKLVGAKFMQIDRKLAEEHYGEHEGKPFFEGLVEFITSGPVFAMVWEGQDAVRQVRSMMGETDPAESAPGTIRGDFGLDLGRNVIHGSDHEDEGSNEREIELFFDDAELVDWD

SEQ ID NO: 9387 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 9388 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 9389 - protein, 983 aa, Synechocystis sp. PCC 6803
MPNLEPAVVVPTSEAIAVDLTKLEEKLAPADSFLDRHLGPGETEQRQMLQTLGFDTLGDLIDQAVPPAIRFPRSLQLPASQSEYGAIAQLKSIASKNQVFRSYIGMGYYDTITPPVIQRNILENPGWYTAYTPYQAEIAQGRLEALLNFQTMVMDLTGLEIANASLLDEGTAAAEAMALSYGVSKSKANAFFVAQDCHPQTIEVIKTRANPLGIEVIVGDHHTFSFSTSIFGALLQYPATDGAVYDYRSFIDKAHQHQALVTLAADPLSLTLLTPPGELGADIAVGSTQRFGIPLGYGGPHAAYFATKAEYQRKMPGRIVGVSKDAHGNPALRLALQTREQHIRRDKATSNICTAQVLLAVMASMYGVYHGSTGLKNIALRIHQLTVLLAIGLKRLNYSLNNDYFFDTLRVGVGEQSAPAILKAAEGRGINLRPLVPGEVGISLDETVTVQDLLDLWQVFAGKDNLPFTPEELWSEVKTSFPADLTRQSLYLQDAVFNQYHSETELLRYLHQLESKDLALNTSMIPLGSCTMKLNATAEMMPVTWPEFGKIHPFAPAGQTEGYQILFAQLEAWLGEITGFDAISLQPNAGSQGEYAGLQVIRQYHLSRGEEQRNICLIPESAHGTNPASAVMCGMQVVPVKCDGEGNIDVEDLTSKAEKYGDRLAALMVTYPSTHGVFEATIGTICDIVHRFGGEVYMDGANMNAQVGLCRPADFGADVCHLNLHKTFCIPHGGGGPGMGPIGVKSHLQAFLPRTSLNSTAELQAEDQSIGMISAAPYGSASILVISWMYIAMMGPQGLTKATEVAILSANYMAKRLENYYPILFRGNNELVAHECILDLRPLKKQAAIEVEDVAKRLMDFGFHAPTVSWPVLGTMMVEPTESESLGELDRFCDAMIAIYQEAQAITHGEIDPADNPLKNAPHTAQSLICGEWNHPYSQEEAAYPAPWTKQFKFWPAVGRINNTYGDRHLVCSCEGMEAYKEG

SEQ ID NO: 9390 - protein, 141 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 9391 - protein, 447 aa, Methanosarcina mazei Go1
MVQMKKCTTKEDVLEAVKERDVKFIRTQFTDTLGIIKSWAIPAEQLEEAFENGVMFDGSSIQGFTRIEESDMKLALDPSTFRILPWRPATGAVARILGDVYLPDGNPFKGDPRYVLKTAIKEAEKMGFSMNVGPELEFFLFKLDANGNPTTELTDQGGYFDFAPLDRAQDVRRDIDYALEHMGFQIEASHHEVAPSQHEIDFRFGDVLCTADNVVTFKYVVKSIAYHKGYYASFMPKPLFGVNGSGMHSNQSLFKDGKNVFYDPDTPTKLSQDAMYYIGGLLKHIREFTAVTNPVVNSYKRLVPGYEAPVYISWSAQNRSSLIRIPATRGNGTRIELRCPDPACNPYLAFALMLRAGLEGIKNKIDPGEPTNVNIFHLSDKEREERGIRSLPADLKEAIDEMKGSKFVKEALGEHVFSHYLCAKEMEWDEYKAVVHPWELSRYLSML

SEQ ID NO: 9392 - protein, 321 aa, Vibrio sp. Ex25
MRKDHSTKLHILKSLSNGEFHSGEALGEALNVSRAAIAKHIKGLSEWGIDIYRVQGRGYQLASPLQLLDEALLTASAESLVELVPVINSTNQYLLDRVAESEKGRVCIAEYQAQGRGRRGRQWISPFGSNLYLSMYWRLDAGMAAAMGLSLVIGIAAVEALEEMGIQGVKLKWPNDLYYQDKKLAGILVEMSGQAGGAAHLVIGMGLNIGMPDEQPEIDQPWTTLNQVNESLVIDRNVLATTLIQHWNSALIEYELKGLTSFVERWNRLDNFLNRQVKLLIGPREVHGVIRGIDHQGGILLETSQGLETYIGGEISLRKSD

SEQ ID NO: 9393 - protein, 141 aa, Haloarcula vallismortis
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 9394 - protein, 387 aa, Arabidopsis thaliana
MEALFTSTHTPNLQTKPLLKSPLPTSSQSSCWFCNSLPKTQFPKLRLSNGSSHGLRIQALLRNETPSEGEDNNGFGFFPGDIFSLSQEKLGSNSNGETSHSVIDVEASLAHPQGGGGNRAGLFRTPISGGVQNATSAHALPRPALAVRNLLEQARFAHLCTVMSKMHHRREGYPFGSLVDFAPDRMGHPIFLFSPLAIHTRNLLNEPRCSLVVQIPGWSGLSNARVTLFGDVYPLSEDEQEWAHKQYIAKHPHGPSEQWGNFHYFRMQNISDIYFIGGFGTVAWVDVKEYEGLQPDKIAVDGGERNLKELNAIFSKPLRELLSTESEVDDAALISIDSKGIDVRVRQGAQFNIQRLAFEEGHGVETLEEAKSALWKVLEKVKLNLQK

SEQ ID NO: 9395 - protein, 294 aa, Triticum aestivum
  misc_feature (141)..(141): Xaa can be any naturally occurring amino acid
  unsure (1)..(294): unsure at all Xaa locations
MGGLSLQHPWAFAFGLLGNVISFMTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVXFSVSVFVAPLSVIRLVVRTRSVEFMPFSLSLSLTVSAVVWFLYGLLIKDKYVALPNILGFAFGVIQMGLYALYRNAMPTPVPKQVDDVDAIKVPEHVVNIAKPSPTAAIELNTHNPIEPGMPPPTKDNSLACTRVVTKGEVDKVEKATLVEQV

SEQ ID NO: 9396 - protein, 238 aa, Gibberella zeae PH-1
MVAEEPRQRKDPAVSGKENSKQQRRRTAENLAPPFFALLFALLAFYILFSPPSSSLSPPVPVCHSTISSSVSSSQVIPDKNIAKMSSSEQTFIAIKPDGVQRGLVGPIISRFENRGFKLAAIKLMTPGKEHLEKHYADLAGKPFFAGLIEYMNSGPICAMVWEGRDAVKTGRSILGATNPLASSPGTIRGDYAIDVGRNVCHGSDSVENAQKEIALWFKEGEVVSWKSAQFNWVYEKA

SEQ ID NO: 9397 - protein, 387 aa, Haloquadratum walsbyi
MSMEAVVYQGEKDVAIESVDEPEIEHPNDVIIDITTTCICGSDLHMYEGRTAADPGIVFGHENMGIVTEVGDAVSGLEEGDRVVAPFNVACGFCENCEEGYTGFCTNVNPGFAGGAYGYVAMGPYTGGQAEKLRIPYADFNALQLPDGDEHEDAFSLLADIFPTGWHGTELADIQPGDSIAIYGAGPVGLMAAYSAKVKGAAEIYTVDRVPSRLELAEEHCDATAINFEEGNPVEQIKDIHGGGVDKGVDAVGYQAVDPDKEGDSAYDPARENPAVVINNLIRTVKPTGQLGIPGLYVPEDPGAPSEMAAQGRLGIDFGLLFEKGQALGTGQCNVKEYNRELRDLIIEGRADPSWVVSHRVGLEEAPEMYERFDNREEGVTKVLLEP

SEQ ID NO: 9398 - protein, 231 aa, Brassica napus
  misc_feature (172)..(172): Xaa can be any naturally occurring amino acid
  misc_feature (182)..(182): Xaa can be any naturally occurring amino acid
  misc_feature (198)..(198): Xaa can be any naturally occurring amino acid
  unsure (1)..(231): unsure at all Xaa locations
MASASFVKLNSLSSPRISHRSFAHPSASPPPRVSFAIRAGAYSDELVKTAKTIASPGRGILAIDESNATCGKRLASIGLDNTEENRQAYRQLLLTTPGLGDYISGAILFEETLYQSTKDGKKFVDCLNDAKIAPGIKGDKGLVPLPGSHEESWCQGLDGLASPSAESYKQGXARFAQRGTVXSIPCGPSALAGKEAAXGLAPYAGHLLRTTGLWPYIGSPENSFWMGDPPP

SEQ ID NO: 9399 - protein, 399 aa, Thermus thermophilus HB27
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEVTAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 9400 - protein, 448 aa, Streptococcus mutans UA159
MAITAADIRREVKEKNVTFLRLMFTDILGTMKNVEIPATDEQLDKVLSNKAMFDGSSIEGFVRINESDMYLYPDLNTWTVFPWGDENGAVAGLICDIYTAEGEPFAGDPRGNLKKALRHMESLGYKSFNLGPEPEFFLFKMDEFGNPTTEVNDKGGYFDLAPTDLADNTRREIVNVLTKMGFEVEASHHEVAIGQHEIDFKYADVLTACDKIQLFKLVVKTIARKHGLYATFMAKPKFGINGSGMHCNMSLFGSDGKNAFFDPQDPKGMQLSEVAYQFLGGLVKHAYSYTAIMNPTVNSYKRLVPGYEAPVYIAWAGRNRSPLIRVPASRGVSTRLELRSVDPTANPYLALAVLLESGLDGIENKIEAPAPVESNIYVMTVEERKEAGIADLPSTLHNALKALQEDEVVKAALGNHIYTSFLEAKRIEWSSYAAFVSQWEVDNYLDLY

SEQ ID NO: 9401 - protein, 541 aa, Lactobacillus plantarum WCFS1
MQAHWWQRATVYQIYPRSFQDSNGDGIGDIPGIISRLDYLATLGVDALWLSPVYKSPNTDNGYDIADYQAIDPAYGTMADMDQLIAQAAQRGIKIVMDLVVNHTSDEHLWFVDACQNPDSPTRDYYVWADAVDGHAPNDLTSGFSGGSAWELDELTGQYFLHLFSKKQIDLNWQNPDLRRAIYRMMNFWIDKGIEGFRMDVIDMIAKEPRAKILVNGPHLHEYLHEMNRQTWRNRDFLTVGEAWSASPEDARQYSDEQREELSMVFQFGHLWADRQVGGEKWEQRPLDVAQLKQALYACQTTMATHGWNSLFWSNHDLPRAVSRFGATGQYRELSAKMLAIALHGLKGTPFVYQGEEIGMTDCPVATIDQVNDVEARTIYRQLRAQGDDAGTAMQKINIFNRDNARTPMQWTAKQHAGFTTGKPWLAINANYPRINVAAAQADYQSIWWTYQRLIRLRKQSAVLQQGEFTELSAVPAPIVAYTRTWQQTQWLICANFADTLITVDLPKRASELIISNYQDYPEQLGRVVLRPYEAFILALS

SEQ ID NO: 9402 - protein, 110 aa, Zea mays
GRPLNTPANGRREGEEAMGVTKEDVEAAITSALSPSNLVVTDTSGGCGASYEIEVVSEKFEGKRLLERHRMVNTALAPHMAEIHAVSIKKALTPAQAQPQPEPAADKPQA

SEQ ID NO: 9403 - protein, 374 aa, Arabidopsis thaliana
MSAILAAAIGGAVGALALIALFVFLLWFCVFRRKNLSRTSETGSSDPSTQEGRNVAIELSMREARRFEMEELAQATKSFTNKSLIGIGKFGEVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWVCNHTQNRANRLGGTYTAEGVEELITLTLRCVDVSSEKRPTMSFVVTELERILDKEVSLTTVMGEGTPTVTLGSQLFKATK

SEQ ID NO: 9404 - protein, 281 aa, Micrococcus luteus
MPTYRGGRHEHGQNFLTDHTTIDRLSRLVGDSTGPIVEIGPGQGRLTRELQKLGRSLTAVEIDSRLADRLASASQFREQKHVTVVNADFLHWPLPTTPYVVVGNVPFHLTTAILRRLLHDGAWTQVVLLVQWEVARRRAGIGGSSMMTAQWWPWIDFSLHGRVPRSAFKPAPSVDGGLLEMTRRPDPLLSPDARESYRQFVHDVFTSRGRGIGEILANVSSSLGKRGALQLLKSEGIRSSSLPKDLSAEQWARLFTSASPTKSAKTGRNAHPAHSARRQGR

SEQ ID NO: 9405 - protein, 496 aa, Oryza sativa
  misc_feature (296)..(296): Xaa can be any naturally occurring amino acid
  misc_feature (368)..(368): Xaa can be any naturally occurring amino acid
  unsure (1)..(496): unsure at all Xaa locations
MGEYCGAAPEEDPAMALVTPLPTTTTTTTTAAAAAIKQPHYYGCFDRCSTKQVFDNLHGNISLDPLAREFVDTEEFQRLRDLKQLGLTYLVYPGAVHTRFEHSLGVYWLAGEAMNNLRLYQGEELGIDRVDMQTVKLAGLLHDIGHGPFSHLFEHEFLPRVVPGSTWTHENMSALLLDSSVDKHQIDIEADHLKIVMEMIVASSKFTATESTKEKRFLYDIVANGRNGIDVDKFDYIGRDCRACGLGCNFQYWRLLQGMRVMGDEICYPAKDYLSIHKLFTTRADLHRTVYTHAKXKAVELMLVDALVEANEYLGIALHAQDPADFWKAGGTIIKSIETAPNDELNKAKGIIQRIRRRELYKFCNEYXVPKDKLGHFKNITGQDIVCSQKSSKVLLKEEDVAVSNVKIDLTRGKDNPLESIKFFKDFGCDEKFPITDERVSHLLPAYNQDRIVRVYAKKHELVEAVSEAFENLQLRMYGEKTQVHDTPRKKRIRFH

SEQ ID NO: 9406 - protein, 226 aa, Prunus avium
MAMLKSSLAFLVLAFAFFFCYVMSSGSYDYFQFVQQWPPTNCRVRIKRPCSKPRPLQNFTIHGLWPSNYSNPTKPSNCNGSKYEDRKVYPKLRSKLKRSWPDVESGNDTRFWEGEWNKHGRCSEQTLNQMQYFEISHDMWVSYNITEILKNASIVPHPTQKWSYSDIVSPIKTATKRTPLLRCKTDPATNTELLHEVVFCYEYHALKQIDCNRTAGCKNPQAISFQ

SEQ ID NO: 9407 - protein, 219 aa, Methylobacillus flagellatus KT
MATQDELKQQVAKAAIEYVKGGIIGVGTGSTANFFIDELAKVKDRIDGAVASSEATAQRLRGHGIKVFDLNDVDGMEIYVDGADEITEKLHMLKGGGGALTREKIVAACAKDFICICDQTKLVPVLGKFPLPVEVIPMAREYVARELVKLGGQPKLRDFTTDNGNVILDVHGLTITDPVALESRINEIVGVVTNGLFASRPANVLLLATADGVKTLTAR

SEQ ID NO: 9408 - protein, 370 aa, Methanococcoides burtonii DSM 6242
MSGRGFAQRVLDIDISGIRKMFEAAGSDAVNLGLGQPDFDTPGHIRQAAIDAINEGFTGYTYGAGIVELREALSQKFREQNGFEVSPDGIIVTSGASEALEIAIAALIDPGDEIIISDPGFVSYNALAGFMGGKVVGVPLGDDLTMRPENVMESITPKTKAVIVNSPCNPTGGVLSKSDIKAYAEIADDNDITLISDEVYEHFLYEGEHVSPAKFTDNVITVNAFSKTYAMTGWRVGYTAASQEYTNQMLKVHQYVQACANSIAQKAALAATTGPQDFVYMMRDEFKSRRDVLVEGVNALGMECEAPKGAFYMFPKVENSTEVATKLVANGVVVVPGTAFGKNGDGYIRMSYATSMDEIKRALKIMEKVL

SEQ ID NO: 9409 - protein, 244 aa, Brassica napus
MANANGKAATGVSEKVSEKANPEANEATEIAGNIIYHAKYSPHFSPLKFGPEQALYATAESLRDRLIQLWNETYLHFHKVDPKQTYYLSMEYLQGRALTNAIGNLDLKGPYADALRKLGYELEEIAEQEKDAALGNGGLGRLASCFLDSMATLNLPAWGYGLRYRHGLFKQLITKKGQEEVAEDWLEKFSPWEIVRHDVVFPVRFFGHVQINPDGSRKWVGGDVVQALAYDVPIPGFKPRHNQS

SEQ ID NO: 9410 - protein, 226 aa, Prunus avium
MGMLKSSLAFLVLALAFFLCFIMSTGDGSYDYFQFVQQWPPTNCRVRIKRPCSNPRPLQYFTIHGLWPSNYSNPTKPSNCNGSQFDGRKVSPQLRAKLKRSWPDVESGNDTRFWEGEWNKHGRCSEQTLNQMQYFERSQNMWRSYNITEILRNASIVPHPTQTWTYSDIVSPIKKATKRTPLLRCKQDKKTQLLHEVVFCYEYNALKQIDCNRTAGCQNQPAISFQ

SEQ ID NO: 9411 - protein, 229 aa, Prunus avium
MAMLKSSLSFLVLGFAFFLCFIISAGDGSYVYFQFVQQWPPTTCRVQKKCSKPRPLQNFTIHGLWPSNYSNPTMPSNCNGSRFKKELLSPRMQSKLKISWPNVVSSNDTKFWESEWNKHGTCSEQTLNQVQYFEISHEMWNSFNITDILKNASIVPHPTQTWKYSDIVSAIQSKTQRTPLLRCKTDPAHPNANTQLLHEVVFCYGYNAIKQIDCNRTAGCKNQVNILFP

SEQ ID NO: 9412 - protein, 141 aa, Halobacterium salinarum
ERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDAELVDWD

SEQ ID NO: 9413 - protein, 735 aa, Arabidopsis thaliana
MKVQEGLFLVAIFFSLACTQLVKGQHQPGENCQNKCGNITIEYPFGISSGCYYPGNESFSITCKEDRPHVLSDIEVANFNHSGQLQVLLNRSSTCYDEQGKKTEEDSSFTLENLSLSANNKLTAVGCNALSLLDTFGMQNYSTACLSLCDSPPEADGECNGRGCCRVDVSAPLDSYTFETTSGRIKHMTSFHDFSPCTYAFLVEDDKFNFSSTEDLLNLRNVMRFPVLLDWSVGNQTCEQVGSTSICGGNSTCLDSTPRNGYICRCNEGFDGNPYLSAGCQDVNECTTSSTIHRHNCSDPKTCRNKVGGFYCKCQSGYRLDTTTMSCKRKEFAWTTILLVTTIGFLVILLGVACIQQRMKHLKDTKLREQFFEQNGGGMLTQRLSGAGPSNVDVKIFTEDGMKKATNGYAESRILGQGGQGTVYKGILPDNSIVAIKKARLGDSSQVEQFINEVLVLSQINHRNVVKLLGCCLETEVPLLVYEFITNGTLFDHLHGSMIDSSLTWEHRLKIAIEVAGTLAYLHSSASIPIIHRDIKTANILLDVNLTAKVADFGASRLIPMDKEELETMVQGTLGYLDPEYYNTGLLNEKSDVYSFGVVLMELLSGQKALCFKRPQSSKHLVSYFATATKENRLDEIIGGEVMNEDNLKEIQEAARIAAECTRLMGEERPRMKEVAAKLEALRVEKTKHKWSDQYPEENEHLIGGHILSAQGETSSSIGYDSIKNVAILDIETGR

SEQ ID NO: 9414 - protein, 141 aa, Halogeometricum borinquense
ERTFVMVKPDGVQRGLIGEIVSRFEDRGLKMVAGKFMQIDEELAHEHYGEHKDKPFFDGLVDFITSGPVFAMVWEGQDATRQVRRMMGETDPAESAPGTIRGDYGLDLGRNVIHGSDHEDEGANEREISLFFDDAELVDWD

SEQ ID NO: 9415 - protein, 261 aa, Candida albicans SC5314
MGVHKLIILRHGESQWNHENKFCGWIDIPLSQKGKQEAIYAGELIKKNHLDPDILYTSKLMRSIETGLTILEVLHKPWIDHIKTWRLNERHYGQYQGRDKHEVFVELGKDKEKFQYIRRDYHGLPPLIEYGQDKSIDEKYKDVLNKDILPRGESLSMVMDRLIPFFKYEILDNQMIQLNKTVLIVTHGSIVRSLIKYLNHVSDDDISKINVPTGIPLVFELNDRGELIKPYYYLDQEKAEKGIAKVKMEGLERKGQTDEKL

SEQ ID NO: 9416 - protein, 280 aa, Synechococcus sp. WH 5701
MPLRPGDLVARKQAGVAILMLTAWDALSAALVEEAGAEVVLVGDSLAMVVLGHATTLPVTLAEMIGHTQAVARGLRRPQGQQPLLICDLPFLSYQCGSDQAVAAAGRVLKESAAAAVKLEGGEPETVAVVDRLVRSGIPVMGHLGLTPQSVHRLGYRRQARDPISQERLRRQALDLEAAGCFALVLEHVPADLAGSLRRQLAIPVIGIGAGDDCDGQVRVTADLLGLTPSQPPFSPPLLAGRQLCVEALRGWLQSATPPVASREVDGLPTRPEAPSAPHC

SEQ ID NO: 9417 - protein, 141 aa, Halorubrum saccharovorum
ERTFVMVKPDGVQRGLIGEIVSRFEERGLKLVGGKFMQIDEDLAHEHYGEHEGKPFFDGLVDFITSGPVFAMVWEGADATRQVRAMVGETDPAESAPGTIRGDFGLDLGHNVIHASDHEDEGANEREIDLFFDDAELVDWD

SEQ ID NO: 9418 - protein, 141 aa, Natrialba asiatica
ERTFVMVKPDAFARGLVGEVISRLEDRGLKLVGIKVENMPRGRAEEHYSEHEDKPFYDDLVDFITGGPVVPMVWEGQDATRQVRQMIGETDPLEAAPGTIRGDYALDLGRNVVHAADHEDEGANEREISIHFDDAELVDWD

SEQ ID NO: 9419 - protein, 427 aa, Clostridium thermocellum ATCC 27405
MTLSKSKLLFERAKKVIPGGVNSPVRAFGAVGGYPPFIKKAKGARIYDADGNEYIDYVGSWGPMILGHSHPRVLEAVSKTMVDGLSFGAATELEVQMAELITELVPSVEMVRMVNSGTEAVMSAIRVARGYTKREKIIKFAGCYHGHADSMLVKVGSGAMTNGIPNSGGVTAGAAKDTLIARYNDIDSVKLLFEQNKGNIAAVIVEPVAANMGVVPPKDNFLEELRKLCDKEEALLIFDEVITGFRLAIGGAQQYFGVNADLVTYGKIIGGGMPVGAYGGRREIMECVAPVGDVYQAGTLSGNPIAMSAGIATLRELYENPGIFENINRLGQRLSEGLGKITKYTVKAVGSLVCVFMTEEEVNDYDSAVKSDTGLFGRYFNHLLNNGIYIAPSQFEAMFVSNAHTDKDIDETLEKVSLFFARKSPPA

SEQ ID NO: 9420 - protein, 481 aa, Rubrobacter xylanophilus DSM 9941
MAQLLVGGERVSARGGGEMPVVNPATEEVVDTVPKGTAEDVEAAVAAAKGALAEWSGKDPDERAAIMRAGIGAVKERGREIAELLVREQGKPLSEAMGELHHFIHGMDFYADLASKVRGAYAPLPSSLGKSYGMVIKRPVGVCAAIVPFNFPLTLMGTKVGPALAGGNTVVVKPAETTPLATLRVAELFAEAGLPAGVFNVVTGEGPEVGEALVAHPDVRRVAFTGSTEVGRRIMELAGPQFKRVSVELGGSDPVIVCPDADVDAAVKGVNIGRFFNAGQACLAAKRVYVFDEVYDEFMEGLIKRVSRYELGDGLTKAEKPKIRMGPMNSARYRDQVASQLEEALGRGARVVYQGEWGGEKGYFFPPAVIEGAPHDSRVVREETFGPLLPVFRVGDLDEALRLANDSRYGLGSSIWTRNIRWIHRAAQEIEAGMTWVNQLHYGYDELPFGGVKDSGVGREHGPEALEYYLESKSVVIGGLD

SEQ ID NO: 9421 - protein, 527 aa, Oryza sativa
  misc_feature (436)..(436): Xaa can be any naturally occurring amino acid
  unsure (1)..(527): unsure at all Xaa locations
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAVSTVGRICAEAESVYNQLVHFKKLVKHVGDPMPHEESVASSAVRTAMKVKAAAIVVFTFSGRAARLVAKYKPPMPVLXVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 9422 - protein, 247 aa, Methanosarcina acetivorans C2A
MNESTVYECLKYGNENINRALEVLRAGKMIQIYDSDSREGETDLVIPAKAVTYKDVKWMRKDAGGLICVAVDPVASKQLKLPFMADLVREASRTSESLGEVVEKDGDLKYDSHSSFSIWVNHRDTRTGIPDLERALTIRKIGEITEKSLSGNGIRFGNEFRTPGHVALLRAAEGLLDERMGQTELSVALARMAGITPAMVVCEMLDDESGRALSKENSKDYGKDHGLVFLEGQEILEAYMLWTGSEC

SEQ ID NO: 9423 - protein, 159 aa, Prunus avium
PSNYSNPRMPSKCTGSLFNFRKVYPQLRSDLKISWPDVESGNDTRFWESEWNKHGRCSEASLNQMQYFERSHAMWISYNITEILKNASIVPSATKNWTYSDIVSPIKRATKRTPLLRCKYDKSTQLLHEVVFCYEYDALKQIDCNGTAGCPNQKVISFQ

SEQ ID NO: 9424 - protein, 510 aa, Cryptococcus neoformans var. neoformans JEC21
MATVLPEPEGIPCIRPAASYDPLTELSKPFTIDPASRSYKHQYANIYFVRLVEQRPAVEKKATEKWKDVKGNPPLLPRILNLTRSQLCYIVGTVYMEMPLKPNILEDMARDHWLAAPIPRTKFFSAQDSIHLEDESGRVRLIGDAIQRERDREGGGLVTGVIMAALGMETPSGDFEVIDICFAGMPDKLVLNPAPSSAKRKGKEKVENDEDIDMQEDAKIELPENAKTWIAMVSGLSIGTQEASTDLKAEMLVEWLMGEIGGHSDQLGGGRIARLIIAGNSLTLPVKGEDDKKIKRFNSTSKPLFPNHPTKTLATLFADLLSSSLPIHLIPGPSDPAGATLPQQPLPKILFGGKAKTEGLECETNPTWMEVGGRSFLTTGGQAIDDIFKYVPGNSRLGMTQRTLEWRHMAPTAPDTLWIYPFPDTDPFIMNYRPDVYIVGNQPEFETTIIGDEDAPTRLVLLPSFAKTGVIAFVCLETLECRTLEFEAPMWVGETMAGEAEGVDNEEMES

SEQ ID NO: 9425 - protein, 226 aa, Prunus avium
MAMLKSSLALLVLAFAFFFCYVMSSGSYDYFQFVQQWPPTNCRVRTKCSNPRPLQYFTIHGLWPSNYSNPKMPSNCIGSQFNESKVYPRLRSKLRISWPDVESGNDTKFWGDEWNKHGTCSQRILNQFQYFERSQQMWRSYNITNILKKAQIVPNATQTWSYSDIVSPIKTATNRTPLLRCKSQPKSQANFQLLHEVVLCFDYNALVHIDCNRTAGCWNNVDIKFQ

SEQ ID NO: 9426 - protein, 832 aa, Zea mays
  misc_feature (254)..(254): Xaa can be any naturally occurring amino acid
  unsure (1)..(832): unsure at all Xaa locations
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGSVLSLASRHGSMVNQSVPLMDPIVTLFGSVHENMPQAGGSMRSTLFPNFGSTGPQFPGRPTRPPTRLSWCLGCPCRHHPIGELCLXVLAIPSLFFFGLTIFYLPESPRWLVSKGRMAEAKKVLQKLRWKDDVSGELSLLLEGLEVGGDTSIEEYIIGPATEAADDLVTDGDKEQITLYGPEEGQSWIARPSKGPIMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTISVIVYFCCFVMGFGPIPNILCAEIFPTRVRGLCIAICAFTFWIGGIIVTYGSLPVMLNAIGLAGVFSIYAVVCLISFVFVFLKVPETKGMPLEVITEFFAVGAKQAAAKA

SEQ ID NO: 9427 - protein, 223 aa, Prunus avium
MAMLKSSPAFLVLAFAFFLCFIMSNGSYVYFQFVQQWPPTNCRVRIKRPCSSPRPLQYFTIHGLWPSNYSNPRMPSNCTGPQFKRILSPQLRSKLQTSWPDVESGNDTKFWESEWNKHGTCSKETLNQMQYFERSYAMWMSYNITEILKNASIVPHPTQTWKYSDIVAPIKAATKRTPLLRCKQDKNTVLLHEVVFCYEYNALKQIDCNRTSGCQIQPAILFQ

SEQ ID NO: 9428 - protein, 296 aa, Spiroplasma kunkelii CR2-3x
MTTNIHWFPGHMAKAIKQIDEQSKLIDLIIEIVDSRIPFSSSNPLVDNLRGLKPKLIILNKKDLADPVAIKAWFKYYQSQQIAVLPLDSKHGNITKLIIEKIYFVLAGKIERNQNRGIKSPKLKVMVIGIPNVGKSTFINALIKRNSTRVGNKPGVTKGQQWLKLNHQIDLVDTPGILWPKINDPQVAINLAFIRSIKEDILPKEEICLAAIKWMHKYYFSLLVKQYHLLPSDNFDVTDEQKLFELLLVMQKNRFHKVDEDNVNNIVTDFLNNLWNNKFGLMSFEFPPGKRTINYE

SEQ ID NO: 9429 - protein, 537 aa, Pichia angusta
MSILALVATSIGSAQAAAIKKDTAGQHPLGMNSNFGDVFVEKGKSLLDRVSEVVSESSKNISPELRDIWNEMEAKFPDTLRNMKLKSEPAVKITKKPADFWDFNVLNEKFSNYKLRVKKTDPGALGLDHTRQYSGYLDVEDEDKHFFYWMFESRNDPVNDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKVGAEVDTYESCNFDVNRNFLFAGDWMKPYHKNVINLLEQGLPVLIYAGDKDFICNWLGNQAWSNELPWSGHDEFESAELYNLTLKDGTKVGEVKNAGKFTFARMFDGGHMVPYDQPESSLAMVNRWIAGDYSLGTKK

SEQ ID NO: 9430 - protein, 475 aa, Oryza sativa
MGEYCGAAPEEDPAMALVTPLPTTTTTTTTAAAAAIKQPHYYGCFDRCSTKQVFDNLHGNISLDPLAREFVDTEEFQRLRDLKQLGLTYLVYPGAVHTRFEHSLGVYWLAGEAMNNLRLYQGEELGIDRVDMQTVKLAGLLHDIGHGPFSHLFEHEFLPRVVPGSTWTHENMSALLLDSIVDKHQIDIEADHLKIVMEMIVASSKFTATESTKEKRFLYDIVANGRNGIDVDKYGSYKACESWVMKYATLPKIVDLSIHKLFTTRADLHRTVYTHAKVKAVELMLVDALVEANEYLGIALHAQDPADFWKLDDTIIKSIETAPNDELNKAKGIIQRIRRRELYKFCNEYSVPKDKLEHFKNITAQDIVCSQKSSKVLLKEEDVAVSNVKIDLTRGKDNPLERFLIYKPTFQTLIFLRATYQILTCYFCWSAYLLSPASSSLRILVADEKFPITDGAGQPPATCVQPGQNCPGSTP

SEQ ID NO: 9431 - protein, 256 aa, Zea mays
MASRKFFVGGNWKCNGTGEDVKKIVTVLNQAEVPSEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 9432 - protein, 311 aa, Glycine max
MSHLLCVNCQLSTMLNKIKDNLCFASALSVISCFIIMEQMFFATSILHVRLMQWDDDNLVEQAVNRCNQIWESIAPDKRRQCPGLLFYNELLHIFYRLRLCDYKNAAPHVDNLDAAMKIDMQQTQRIQELVKELNTLDQSLSRSDLHYRDRTALSKKQTMIQEQLQNMTGLSSIGQESLQPVYFGNVRRIIGDKLQLAPPPIDGEWLPKSAVYALVDLIVVVFGRPKGLFKECAKRIQSGMNIIQDELVKLGITDGVREVDLQHSSIWMAGVYLGVNLDIPESIGLSAPLPAPSSSRLVDIDTRRRGKRRI

SEQ ID NO: 9433 - protein, 861 aa, Nicotiana tabacum
MMMVGKLFSLLHFFTLFCLFTVTFASTKEATALLKWKATLQNQSNSLLVSWTPSSKACKSWYGVVCFNGRVSKLDIPYAGVIGTLNNFPFSSLPFLEYIDLSMNQLFGSIPPEIGKLTNLVYLDLSFNQISGTIPPQIGSLAKLQTLHILDNHLNGSIPGEIGHLRSLTELDLSINTLNGSIPPSLGNLHNLSLLCLYKNNISGFIPEEIGYLSSLIQLDLNTNFLNGSIPASLENLHNLSLLYLYENQLSGSIPDEIGQLRTLTDIRLNTNFLTGSIPASLGNLTSLSILQLEHNQLSGSIPEEIGYLRTLAVLSLYTNFLNGSIPISLGNLTSLSSLSLYENHLSGPIPSSLGNLDNLVYLYLYANQLSGPIPSELGNLKNLNYMKLHDNQLNGSIPASFGNLRNMQYLFLESNNLTGEIPLSICNLMSLKVLSLGRNSLKGDILQCLINISRLQVLKIPDNNLSEEIPSSICNLTSLRILDLSRNNLKGSIPQCFGDMGGHLEVLDIHKNGISGTLPTTFRIGSVLRSFTLHENELEGKIPRSLANCKELQVLDLGDNLLNDTFPMWLGTLPKLQVLRLKSNKLYGSIRTSKDENMFLELRIINLSYNAFTGNIPTSLFQQLKAMRKIDQTVKEPTYLGKFGADIREYNYSVTVTTKGLELKLVRILTVYIIIDLSSNRFEGHVPSIMGELIALRVLNLSRNGLQGHIPPSLGNLFVIESLDLSFNQLSGEIPQQIASQLTSLAVLNLSYNHLQGCIPQGPQFHTFENNSYEGNDGLRGFPISKGCGNDRVSETNNTVSTLDDQESTSEFLNDFWKAALMGYGSGLCIGLSILYFMISTGKLKWLSRITEWLQNRFII

SEQ ID NO: 9434 - protein, 121 aa, Triticum aestivum
  misc_feature (89)..(89): Xaa can be any naturally occurring amino acid
  unsure (1)..(121): unsure at all Xaa locations
MAEQTFIMIKPDGVQRGLIGEVISRFEKKGFYLKGLKLQNVEKSFAEQHYADLSSKPFFAGLVEYIVSRARSSLWVWEGKSVVSTGRKXIIGGTNPLGSEPEPSVGDFAVDIGRTHPWRSI

SEQ ID NO: 9435 - protein, 304 aa, Alkaliphilus metalliredigenes QYMF
MPRILVNDKIDQKSLDAISAMGIELTVENYPADELKKQIKEYDGIIVRSATKVTQEIIDEALETGKLRLIIRAGVGLDNIDGAYAMKNGITVRNTPDASKVSVAELTIAHMLMIARKLQQSNVTMRQGKWLKKEYRGVEIEGKTLGLIGFGRIAKIIAQRAAALGMKVVYNTRSGKVQGFDEFKYLSKEDLIQSADFISLHVPHSQEAGAVIAKKEFDMMKDGVYVLNCARGGVICEASLLEALDSGKVAAAALDVFEEEPVKNEAIYLHEKISLSPHIGASTAEAQEGVGKEIVQIIKEFFKI

SEQ ID NO: 9436 - protein, 98 aa, Arabidopsis thaliana
  misc_feature (18)..(18): Xaa can be any naturally occurring amino acid
  misc_feature (29)..(29): Xaa can be any naturally occurring amino acid
  misc_feature (42)..(42): Xaa can be any naturally occurring amino acid
  misc_feature (82)..(83): Xaa can be any naturally occurring amino acid
  misc_feature (85)..(85): Xaa can be any naturally occurring amino acid
  misc_feature (87)..(88): Xaa can be any naturally occurring amino acid
  misc_feature (92)..(92): Xaa can be any naturally occurring amino acid
  unsure (1)..(98): unsure at all Xaa locations
PLQSEQLASVSLPATMVXSPAQATMVAPXNGLKSSAAFPATXKANNDITSITSNGGRVNCMQVWPPIGKKKFETLSYLPDLXXSXFXXREVXYLIRNK

SEQ ID NO: 9437 - protein, 303 aa, Arabidopsis thaliana
MEKNQSDDDGTALIFLGTGCSGAVPDFRCLLQPSDPPCHVCSQSLSLLPHLNPNYRCNTSLLIDYCSKEEDGRHKYILIDVGKSFREQIILTHEHADAVHGLDEIRSLQPRGATIVDTDPLPVFLSQFTMESIATRFPYLVEKKVKEVPRRVSLLDWKNIEENCDEPFAASGLSFTPLPVMHGEDYIALGFLFGDKSKVAYISDVSRIPPSTEYAISKAGAGQLDLLILDTNIPWKRGPHPTHICFTEALEILKRLCPKRALLTGMTHEFDHHEYNEILAEWSLREGIHVQLAHDGLRLPIDL

SEQ ID NO: 9438 - protein, 298 aa, Bradyrhizobium japonicum USDA 110
MRSGFNMSHSSEQPLERVTIPALQQWKDKGRRVVMTTAYDAVAARIADPIVDIILVGDSVGNVCLGFDNTLPVSVAMMNHHLEAVARTRPHALLVADMPFLSFHVGSEDTIRNAGGFLQRGADAVKLEGGAKRIEMVRALVDCDIPVMGHLGLTPQSVNVMGGFKVQGRTTDTALRLLDDAHRLQEAGCFALVLEGIPAELAARATESLTIPTIGIGAGADCSGQVLVFHDVLGLTEGHRPKFVRAYTNGFQLFQEALSRWAADIRKGAFPGSEECYRLPDQLRHAVANWVPSSSTSR

SEQ ID NO: 9439 - protein, 857 aa, Brassica oleracea var. alboglabra
MKGVRNIYHHSYTSILLVFVVMILFHPAFSIYINTLSSADSLTISSNRTLVSPGNIFELGFFRTTSSSRWYLGMWYKKLSDRTYVWVANRDNPLSNSIGTLKISGNNLVILGDSNKSVWSTNITRGNERSPVVAELLANGNFVMRDSNNNDGSGFLWQSFDYPTDTLLPEMKLGYDLITGLNRFLTSSRSLDDPSSGDYSYKFESRRLPEFYLLKGSGFRVHRSGPWNGVQFSGMPEDQKLSYMVYNFTQNSEEVVYTFRMTNNSIYSRLTISSEGYLERLTWTPSSGMWNVFWSSPVDLQCDVYKICGPYSYCDVNTSPVCNCIQGFNPLNVHQWDLRDGTSGCIRRTRLSCSGDGFTRMKNKKLPETTMAIVDHSIGLKECKKWCLSDCNCTAFANTDIRNGGTGCVIWTERLEDIRTYFTDGQDLYVRLAAADLVKKRNANGKIASLIVGASVLLLLIMFCLWKRKQNRVKASAISIANRQRNKNLPMNGMVLSSKKQLRRGNKTEELELPLIELEAVVKATENFSNCNKLGEGGFGIVYKGRLLDGQEIAVKRLSKTSVQGTDEFMNEVTLIARLQHINLVQIFGCCIQADEKMLIYEYLENSSLDSYLFGKTRSSKLNWKERFEITNGVARGLLYLHQDSRFRIIHRDLKVSNILLDKNMIPKISDFGMARIFAREETEANTMKVVGTYGYMSPEYAMHGIFSEKSDVFSFGVIVLEIVTGKRNRVFYNLNYEDNLLNYAWNNWKEGRALEIVDPAILDSLSSLPSTFQPQDVLKCIQIGLLCVQDLAENRPTMSSVVWMLGSEATEIPQPKPPGYCLVRSPYEPDPSSNRQREDDESWTVNQYTCSVIDAR

SEQ ID NO: 9440 - protein, 146 aa, Brassica napus
MSCFKSKYADELIANAAYIGSPGKGILAADESTGTIGKRFASINVENVELNRRALRELLFTTPGALQYISGIILFEETLYQKTASGKPFVDVMKEAKVLPGIKVDKGTVELAGTNGETTTIGLDGLGDRCKKYYEAGARFAKWRAV

SEQ ID NO: 9441 - protein, 474 aa, Deinococcus radiodurans R1
MSVAAVPAIGAHAHKFEPHVGDLETGGQGAARQLGQGRHFHIEDGAAGAADRVVVFLAGVAVVVAGGLPGAFDGHDHAVAYQRVEGAVHRAETDMRQLLTHLGVDLRRVGVRARVRSTSMTAARCLVCRTIVIPFLIADDGRAACYPLPILRPVPLPPVGGCPVTLWRMPARLLPLLTDRPQSGDDLGRALDLGRVTVNTLARRLQEDGVPVLISRAGYALEPGTPAPGLVPLRGQFGRALRYQGTVTSTQDEVRFWADSERGPAPHGAVVVAERQTAGRGRRGRVWDTTHGTLAFSVLLREALSLADLVRMPLAAGVALHAACTALGVPCGLKWPNDLLTPDGRKLAGILLEADLRGEEARRAVLGIGINVGTAPEGAAHLHESVPDLTRAAVLGEVLFQLEHWLAQPAPAIIATWKATSLTLGRPVRVTTARGTVEGVARDLDEQGNLLVETAAGLETVSAGDVQLVGQLKT

SEQ ID NO: 9442 - protein, 438 aa, Bdellovibrio bacteriovorus HD100
MEIRDPVHGSIYYSEQEVAVLDTAEYQRLRAIKQLGYAEFSFPGATHNRYIHSVGVGHLAGETFDAIFRVYPFSKPSVKTRFRQVLRLGALLHDVGHGPLSHTTEQVMPHLSELKIQLYKEQEQYGEEAHTVMNHNRRANHEDYTIKYVTDSAISETLRTNFPDIQPIHVACLIDKALHCPDDFFVDNGVDFRPILSQLVSSELDVDRMDYLERDSYFCGTNYGKIDLSWLIQNMTFHRRENKMYLGLNRRALYSFDDFLISRHHMHLMVYCHHKSIIYEEMLNRYLTSPDCTFVLPGDINEYTKYNDYRLHEHLSGANNPWAQRIAQRKPFKVLIEQHNTAESESPEAIKKALEADGIEVIRTSSKARLSKYHTASPEERALQIYVVDQYDRWAQPSPINQTTEIFQRYEGARIIDRIYVAPENLRQAELILKSLKL

SEQ ID NO: 9443 - protein, 355 aa, Rhodopseudomonas palustris CGA009
MHRPDPHDCGIFLISPRYGSNSMSSAQYDVLAIGNAIFDVLVRTEEDFLVKHGMAKGGMALIDEARAAAIYADMGQATEMSGGSAANTIVGLASFGARTAYLGKVKDDQIGKLYTHDIRAAGVTFDTKPATAGPATGCSYILVTPDGQRTMNTYLGAAQDLSPADIDEAKIAASAITYLEGYLWDPPQAKEAFLKASQIAHGAGRKVALTLSDAFCVDRYRGEFLELMRSKTVDLIFANEAELHSLYQTSDFDAALTLLAQDVALGVVTRSEKGCAVVDKDGVTLVPAAAIDQLVDTTGAGDLFAAGFLFGLVRNLGYENAGRLGALAAAEVIQHIGARPQVSLKELAQQHGLAV

SEQ ID NO: 9444 - protein, 461 aa, Rubrobacter xylanophilus DSM 9941
MVDPATGEEVDSVPVCGEAEVDAAVRGAAGAFPGWSGTPASRRGELLARAAEAVLGARDELAGLLTAEQGKPLREARLEIRRFVHTLEHYAGLAKNIRGGYVPDLDEGAYGLILRRPVGVVGAIVPWNFPTTLLANKLGPALVAGNVVVAKPAETTPLTTLRIAEIMHGAGLPAGVFNVVTGDGPTTGQALAGHPSVRKVAFTGSTPVGKKLAALAAGDLKRVTLELGGSDPMIVCDDADLDRAASAASVGRFFNCGQACLAVKRLYVFESVAEEFVEKLVGKAKRLRVGPGRAEGTIIGPLHTPEGRELLEGQVRDAVESGARVLAGGRRPEGEVFERGNFYEPTLLLEPSHESRVATEEVFGPALPIWRVGDLEEAIERANGSIYGLGSSVWTADLDRATEAAERIEAGYTWINSPQVIYDELPFGGWKQSGYGKEHGMEAIEYYTETKSVVVRRAYQG

SEQ ID NO: 9445 - protein, 355 aa, Zea mays
  misc_feature (6)..(6): Xaa can be any naturally occurring amino acid
  unsure (1)..(355): unsure at all Xaa locations
MSAYCXKYKDELIKNAGYIGTPGKGILAADEPTGTIGKRLSSINVENVEENRRALRELLFCCPGALQYISSVILFEETLYQKTKDGKPFVDVLKEGGVLPGIKVDKGTIDVAGTDKGTTTQGHDDLGKRCAKYYEAGARFAKWRAVLKIGPNEPSQLAIDLNAHGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 9446 - protein, 502 aa, Zea mays
MATGRPVRLVLDASLLLDPSSTREAAAVALRPGVEELLRRLRYSNLNVAICYAEGMPNNESGFLEKVASSHLFGSIALLAKSGNLSLTELMLEWSRTSFCFYATSRVDKGLISELQNQNWRVLSVANECSIEVPGVLNVQRLQQLLLTLATLIKRELCDSSVLVIGYIMKKSREEDFARRGAFPIYPSKGSLIFVPLSFELPLSLQLQEVDMVLHKITDEIVKIDPNCSIDFPKGISFSTGMSEIIRFVEEHPDFRIMDPFKNIYPLLDRLQIQKILVRLQELGTEGKPKLRAPYSCKVDNFHNGELDKHLAEANLSFPLIVKPQVACGVADAHNMALVFQIEEFSNLSVPLPAVLQEYVDHGSKIFKFYAIGDKVFYAVRDSMPNARFLKPSSGGEALTFNSLKTLPVATNEQRPQTAAEDGKLLDADLVEEAAKFLKGLLGLTVFGFDVVVQEGTGDHVIVDLNYLPSFKEVPNSEAVPAFWDAVRQACESTRGNANVQG

SEQ ID NO: 9447 - protein, 497 aa, Rhodopseudomonas palustris CGA009
MSPTAAARAADQAASLRDRLKDPSLLREQCYIDGAWSGTSTIAVTNPASGQTIAKVPHLGAAEATQAVEAAAQAFPAWAKLTAKQRSNILRKWFELIIANREDLALILTSEQGKPLTEALGEVDIGAAYVEFFAEEARRVYGETIPTQRADARLIAIKQPIGVCGAITPWNFPSSMITRKVSPALAAGCTVVLKPAEETPLSAFALAALAEKAGVPKRVFNVLTGDAPAIGKVLCEHPAVRFVGFTGSTEVGKILYKQASVGVKKLGLELGGNAPFIVFDDADVDAAVEGAMVSKYRNMGQTCVCANRLYVQDGVYDAFVEKLAAKVKAMKVGDGTEQGVTQGPLINEAAVEKTERHIADALSNGAKIITGGKRHALGGTFFEPTVLADVRPDALVAHEETFGPLAPVFRFKDEAEVIKLANNSPFGLASYFYARDLGRVWRVAEALESGMVGVNTGLITTEVAPFGGVKESGLGREGSHHGIEEYVEIKYVMMAGI

SEQ ID NO: 9448 - protein, 529 aa, Vibrio parahaemolyticus RIMD 2210633
MEIILITTAFLAGFIALKCNLPPLVGFLLAGFGLHAFGYQSNDVIVTLADLGVTLLLFTIGLKLDVKTLLSKEIWGGATAHNILSTVFFALALSGLKLLGLTSLASMESGQILLLAFALSFSSTVFAVKTLQEKGELNATYATLAIGILVMQDIFAVVFLTVSTGKVPEWYAIGLFALPLLRPLFYKLLDKVGHGEMLVLFGIFFALVVGAGLFELVGMKPDLGALILGMMLAGHRKASELSKSLFNMKELFLVCFFLNIGLSASLSLTGIALALLFIVLLPIKGLLYFLTINHFKFRVRTSLLASLSLFNYSEFGLIVGGLAYKMGWMPSDMLAAIAVAVSLSFIISAPLNRLGHKIYQHSGKWLQETAAEKLNQRDQLINPGHAQVLILGMGRIGTGAYDELRARYGKISLGIEIREEAAQQHRSEGRNVISGDATDPDFWERILDTGHVKLVLLAMPHHQGNQTALEQLQRRNYKGQIAAIAEYPDQLEGLLESGVDAAFNIYSEAGSGFARHVCKQLEPQFTSIK

SEQ ID NO: 9449 - protein, 275 aa, Cucurbita pepo
MAGRSSPREEFVYLAKLAEQAERYEEMVEFMEKVSAAVDNEELTVEERNLLSVAYKNVIGARRASWRIISSIEQKEESRGNDDHVSIIRDYRSKIETELSNICGFRILNLLDSRLIPSAASGDSKVFYLKMKGDYHRYLAEFKTGAERKEAAESTLTAYKSAQDIANAELPPTHPIRLGLALNFSVFYYEILNSPDRACSLAKQAFDEAIAELDTLGEESYKDSTLIMQLLRDNLTLWTSDIRGSRDDIKEAAPKRDCTNSSEQIDLHVQDSTSP

SEQ ID NO: 9450 - protein, 338 aa, Cordyceps bassiana
MAPVKVGINGFGRIGRIVFRNAVEHNDIDVVAVNDPFIEVKYAAYMLKYDSSHGLFKGEVAIDGNDLVINGKKVRFYGERDPAAIPWKETSAEYVVESTGVFTTTEKAKAHLQGGAKKVIISAPSADAPMYVMGVNEKSYDGSADVISNASCTTNCLAPLAKVIHDKFGIVEGLMTTIHSYTATQKTVDGPSAKDWRGGRGAAQNIIPSSTGAAKAVGKVIPELNGKLTGMSMRVPTANVSVVDLTARLEKGASYDAIKAAIKEAADGPLKGILGYTEDEVVSTDLNGNTNSSIFDAKAGISLNDNFVKLVSWYDNEWGYSRRVLDLISYVAKVDASK

SEQ ID NO: 9451 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASSTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 9452 - protein, 208 aa, Prunus avium
LCFIMSTGDGSYDYFQFVQQWPPTNCRVRIKRPCSNPRPLQYFTIHGLWPSNYSNPTKPSNCNGSQFDGRKVSPQLRAKLKRSWPDVESGNDTRFWEGEWNKHGRCSEQTLNQMQYFERSQNMWRSYNITEILRNASIVPHPTQTWTYSDIVSPIKKATKRTPLLRCKQDKKTQLLHEVVFCYEYNALKQIDCNRTAGCQNQPAISFQ

SEQ ID NO: 9453 - protein, 273 aa, Bacteroides thetaiotaomicron VPI-5482
MAGYISDDTRKVTTHRLVEMKQRGERISMLTSYDYTMAQIVDGAGMDVILVGDSASNVMAGNVTTLPITLDQMIYHAKSVVRGVKRAMVVVDMPFGSYQGNEMEGLASAIRIMKESHADALKLEGGEEIIDTVKRIISAGIPVMGHLGLMPQSINKYGTYTVRAKDDSEAEKLIRDAHLLEEAGCFAIVLEKIPATLAERVASELTIPIIGIGAGGHVDGQVLVIQDMLGMNNGFRPRFLRRYADLYTVMTDAISRYVSDVKNCDFPNEKEQY

SEQ ID NO: 9454 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 9455 - protein, 952 aa, Ustilago maydis 521
MVKEVSSAVEFDAELNAAGSKLVVVDFHATWCGPCKVIAPIFQRLASQYTSVVFLKVDVDRVQPVAQRYSVCAMPTFLFLKNKSVVDTLQGADPNRLTALVKQHSSGASLAFSGSGQTLSGGSSSSSSSFGARVAGITDGHSSLLNTVEPKRSSALNEKPNHRLQDILGGPTGGKWLESDADEQLLIHFTFKQQVKLSGILLRTLPSQLAHAPKEIKIFANRPGLSFDDATADKGDQEAELSEDFVRGGENGGGGKALSLRFVKFQKVDSLTIAVLTNQSDAETTRIDAIDLYGVADQTTDMSELQKIAAEGGDRDFDFRTASKTGLKGGSSSRSARTGFHGPRSSSIPDMSTPAEPPLRPARSHSTSSLNSALPRYRRTTSSTSVPPMQHVDEEDGNDYADDGNYSRHSQPQTAFVPQAPPSLSEEEQAEFEAAQKAASETLGGWHYAPLAVALAPPLGSLLGGHSDAWSDAILLILASFWLYQFLRVPWEIYYASRTRSILTHDQDQDEIEHAEQVTLDGSPSSAPESSETGVQKEVRRAAAAELRRSELLSLVFCMLSPIMGAYMLHWMRETMTDGNKYLNTFNIRLFTLAAGIKPWSHAMSLVRRRMLHLQEEVHYPSSKVEKMNQRLRRLEADLSSLRKLYATKTELRLLREHDAELGRALRRSERKEEHLRLSAEEKFSIVEGRLEDLLREVAINAELIEEERRERERAASLRISLFEAIKYLLGSGLTIRRASPKHYLHDMPRSLPSTASLGIGAQSAEADLNMEAHTPGAPLPASVPIVSPTRPPRTIASATPDRPSSSSRGLASIQSEQPAAANVVNRPDHPKVGAVVERSRSRNNAHHISDPWWERGAAFYLFLPLNVSSAAVRFAGEKVKHILEDSENEAARNQRKTLQYQKHLADQQLQQHQRKISQKQYQHQPMLSPTRNRADASTIKIASASANPRTR

SEQ ID NO: 9456 - protein, 509 aa, Capsicum chinense
MEGTTWTAYAAVFLGTLFLLLLSKFLRQKKLNLPPGPKPWPIIGNLHLMGNLPHRSIHELSVKYGPILQLQFGSFPVVVGSSVEMAKIFLKSMDINFVGRPKTAAGKHTTYNYSDITWSPYGSYWRQARRMCLTELFSAKRLDSYEYIRAEELHLILRNLNKLSGKPILLKDYLTTLSLNVISRMVLGKRYLDESKNSIVTPEEFKKMLDELFLLNGVLNIGDSIPWLGFMDLQGYVKRMKVLSKKFDKFLEHVLDEHNVRRKAVENYVAKDMVDVLLQLADDPSLEIKLERHGVKAFTQDLLAGGTESSAVTVEWAISELLKRPDIIKKATEELDRVIGQNRWVQEKDIPNLPYIEAVVKETMRLHPVAPMLVPRECREDCKVAGYDVQKGTRVLVSVWTIGRDPTLWDEPEAFEPERFLEKSIDVKGHDFELLPFGAGRRMCPGYSLGLKVIQASLANLLHGFKWSLPDNMTPEDLNMEEIFGLSTPKKFPLSAMIEPRLPPSLYSV

SEQ ID NO: 9457 - protein, 411 aa, Colwellia psychrerythraea 34H
MKAITKSSKLHNVCYDIRGQVAVEAKRLEDEGHKILKLNIGNPAPFGFEAPDDILKDVIHNLPNSQGYSESQGIYSARVAVMQYFQQQGIKDVMVDDIFIGNGVSELIVMAMQALLDNGDEVLIPAPDYPLWTAAVSLSGGKPVHYRCDEQNHWFPDLEDMESKITKKTKAIVLINPNNPTGAVYSEEVLHAIIALARKHGLIIYSDEIYDKILYDEAKHVPTAALATDVFIITLGGLSKNYRIAGFRAGWMVISGPKLHAEDYIKGIKLLSSMRMCANVPSQHAIQTALGGYQSINELIRDDGRLIKQRNVAYKMINDIDGLSCNPAMGALYLFVKVDNKKFNITNDERMVLDLLKQEKILLVHGRAFNVKEHNYFRLVFLPHVDELIPALEKLKSFFASYKQVQPSKSA

SEQ ID NO: 9458 - protein, 570 aa, Oryza sativa
  misc_feature (441)..(441): Xaa can be any naturally occurring amino acid
  misc_feature (446)..(446): Xaa can be any naturally occurring amino acid
  misc_feature (468)..(468): Xaa can be any naturally occurring amino acid
  misc_feature (511)..(511): Xaa can be any naturally occurring amino acid
  unsure (1)..(570): unsure at all Xaa locations
MEDYGFEYSDDEPEEQDVDIENQYYNSKGYASCPWRASGWGQLAVSRDCVREGALTSVHGLWWSRYREKKVKRRNNRRREGMVETDPEGALAGFDQVVRMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYTKALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQVIPVQLKSCALNRADPMLFLTEXLGFCXNLLSYSVQDALSSIVLSMFCTXELNFPEKDVEQLLVSLILDNRIQGHIDQVNKLLERGDRSKGMXEIPSHRQVEYSAEEHLPNGAQQSWVREIAGCLGCTALGTCLHVLLWWVNAASVWCVHYI

SEQ ID NO: 9459 - protein, 340 aa, Coprinopsis cinerea
MSQVNVGINGFGRIGRIVLRNALQHGKINVVAVNDPFIDLEYMVYMFKYDSVHGRFKGHVEAKDGKLWVEGKPISVFQEKDPANIPWGSVGADYIVESTGVFTTTEKASAHLKGGAKKVIISAPSADAPMFVVGVNLESYDPKYTVISNASCTTNCLAPLAKVINDKFGIVEGLMTTVHSTTATQRTVDGPSHKDWRGGRAVGNNIIPSSTGAAKAVGKVIPSLNGKLTGLAFRVPTIDVSVVDLVVRLEKPASYDEIKQAVKEASEGPLKGILEYTDEKVVSTDFTGSTSSSIFDAEAGIALNKNFVKLISWYDNEWGYSRRVCDLITYAAAKDKEAGV

SEQ ID NO: 9460 - protein, 140 aa, Erythrobacter sp. NAP1
MAVTRTFSIIKPDATKRNLTGAVTKKLEEAGLRVVASKRIHMTREQAEGFYAVHKERPFFGELVEFMMSEPVVVQVLEGEDAVKRNRDVMGATNPAEADEGTIRKEYALSIGENSVHGSDSEENAAIEIAFFFNDDEIVG

SEQ ID NO: 9461 - protein, 122 aa, Triticum aestivum
RPVRVSSYRYELGSDTFIRNHLRRLYDAMLEQNLIKVIEPFSRVEIDHIANMVGLDTQQVERKLSQMILDKVIIGVLDQGAGCLIIFDETHRDESYDAALATIEKLSSVVDVLYTNQASMLE

SEQ ID NO: 9462 - protein, 618 aa, Haemophilus influenzae
MSQLANPELMKVVILLASSVTIVPLFKRLGLGSVLGYLVAGCLIGPSVFGIVQEPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDTIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 9463 - protein, 99 aa, Brassica napus
  misc_feature (58)..(58): Xaa can be any naturally occurring amino acid
  misc_feature (83)..(83): Xaa can be any naturally occurring amino acid
  misc_feature (94)..(94): Xaa can be any naturally occurring amino acid
  unsure (1)..(99): unsure at all Xaa locations
MSGIFSFSGDEDFFNGGTMHLSPGSCPGVYLPPRKRLRVAAPSPYSAFNQKQTSIEVXPDECLFEILRRLPSGKERSACACVXKHWLNTLTSIXANESV

SEQ ID NO: 9464 - protein, 292 aa, Schizosaccharomyces pombe
  misc_feature (95)..(95): Xaa can be any naturally occurring amino acid
  unsure (1)..(292): unsure at all Xaa locations
MPPKKAAKGKGDPGKAAKKDPTKKAADATFGLKNKNRSTKVQAKIRQIEQNAAASGSKDAKRQEALRKRREEEKRAAEAAKAEVAALFNAIPKKXTPQNFLTRKEEVKESPQIDLYSDVRDQQTDLPLEKRPWINTDIVCKFFLEACETGKYGWLWQCPNGNMTCIYKHALPYGYVLSRDKKKDDTKEEISLEAFIEIERHRLGPNLTPVTEENFKKWSDGRRDRILKQAEERRSNRAVGRSNLSGREYFESNKDKTHEVVGDEEDWDFSALRRETEALAKAQDATAPIVSV

SEQ ID NO: 9465 - protein, 136 aa, Mycobacterium leprae
MTERTLVLIKPDAVERQLIGEIISRIERKGLTIAALELRQVGEELASQHYAEHESKPFFGSLLEFITSGPVMAAIVEGPRAVAAVRQLTGGTDPVEKAAPGTIRGDLALETQFNLVHGSDSTASAQREIALWFPGI

SEQ ID NO: 9466 - protein, 359 aa, Arabidopsis thaliana
MSCFKSKFADELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 9467 - protein, 292 aa, Glycine max
MSMLRSVCQLRVGVTTQKPCLHPSILFSFSLSHNTHTLTLTSFPRTFRFHPPSLPLSPFVLFMPPKATASYGTGASGAAEGDRPREILVQHLLVKEDDQKLLLYLQQKISSGEDLSDLAVEYSLCPSKEEGGMLGWVRKGQMVPEFEEAAFTAPLNQVVRCKTKFGWHLLQVLSEREESILQDIQPDELHMKIQDPSFLDEAQLIDVREPDEVAKASLPGFTVLPLRQFGSWGPEITTKFDPQKDTYVMCHHGMRSLQVAKWLQSQGFRKVYNLSGGIHAYAVQVDPSVPTY

SEQ ID NO: 9468 - protein, 712 aa, Haloquadratum walsbyi
MQHPGPPRFIAVGESLQLSPRDPDPEMSYQWYIERAPASSTIKLPSEEPVVEFAPDTPGTFQIGVESPVNDYSLTIRVFPGSFAPITIPEGESGSGGVSGHQSGSAQPVRKSAGVSGSGSGMRDDTVERGRPRIQLQGDVAGDELVITADAQTRPDNESTHSDIDVEFLIDDRDDVSSDVVSTTDREMRIPMEAVGRRVRIHAVAVTDVYSVPDSIEFTRDPQPDGGEVVVETETPAGDTNRQTDIVESDAEQLDISNRAINIRRPNEPPKWATDVTLYEIYVRGFVDDEETDSIFTALTERLDYLAELGVDCLWLTPVLQNDHAPHGYNITDFFHIASDLGDSEAYETFVDAAHDRGMTVLFDLVLNHSARDHPFYQDAVGNPDSPYHDWYAWRSEDEPETYFEWEYIANWNFQNLEVRRHLLDVVDKWMEVADGFRCDMAWAVPNSFWRELRDRVKTHDPEFLLLDETIPYIADFHGGMFDMHFDTTLYSTLREVGRGHADAAGILDAIDQREAVGFPPHAAFMLYAENHDETRYIVECGEDAAMAVAGALFTLPGVPMLYGGQEIGQRGRRDALAWDDAREKIYTHYQRLIELRNEISALGVDGSINPVDYTIVDDIETSVDTERVVAYERRADEESYVCILNFGETPVTVTIAETSIPRNNDEIKSNESVNVDVSAENLVTGESAAGAEGLVVNNVGVFAATINSDIN

SEQ ID NO: 9469 - protein, 518 aa, Methanococcoides burtonii DSM 6242
MNFTKRPFLLTILDGWGYSPEVEGNAIHAANTPNLDDLLETYPNTLLSASGEDVGLPEGQMGNSEVGHLNIGAGRVVYQDLTRINRDIGNGDFFKNPVLKQAIENAKAQGSALHLMGLFSYGGVHSHMKHLRALIEFAKDEGITEIFIHAFLDGRDVSPRAALEDMKEHVEYCNNLSVGKIATVSGRYYAMDRDNRWDRTEDAYNAITRGDGVYYSKGPVDAISEGYGRGENDEFIKPTVIVDENGRPIGRMNENDTVIFFNFRPDRARQLTYAFVNDEFDNFERKSHPKVHFVCMTEYDEKLEVPIAFPSEELKNTLGEVLSKEGIKQLRIAETEKYAHVTFFFNGGVEKQNEGEERCLIPSPKVATYDLKPEMSAYEVTEELIERIGSGKYDVIVLNLANMDMVGHSGIMEAAVKAVEVVDDCVGKIITAIKEVGGEAMVMADHGNAEKMVEFCNNTERQCYTAHTSNPVRCIYVTQEKRVELQKGRLSDVAPTILKIMGIEKPPEMTGVPLIKNT

SEQ ID NO: 9470 - protein, 153 aa, Brassica napus
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNM

SEQ ID NO: 9471 - protein, 431 aa, Myxococcus xanthus DK 1622
MRIRDPIHGTIAVSDPEKAVIDSRHYQRLRYVRQLGFGDLAFPGATHTRHIHSLGAMHVASRVFGAVAARSSLPEDVRERFCAAVRLAVLCHDLGHMPLSHASERIAPKRSLLRLPSWLDGTAEGELATHEDYTAKILLDSSLTPIIEKHFGGMGITPMAAVALVSGAKPPKDPGFTHQGVDWTPLLRAIVSGELDADRMDYLLRDSFYTGVNYGRYDMDWIVSNLNPAMKDGRAYLALSRAAAFAFEDFLLSRYHMFVSVYLHHTSVNFDYMLRRYYEESPGEFEIPSDPEEFLLCDDSALWYTLRRSKNPWAQRISQRQGYKLLAQFTERDTGYDLDVLRSALVSHKFDHYVVESQNVLSKYTSGPSGRGPSLYIIDASTGRLTEVARYTPLYQRYSGAVRLVRLYVRPDQADKAHALMGRVLGQAVES

SEQ ID NO: 9472 - protein, 142 aa, Lycopersicon esculentum
MIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 9473 - protein, 280 aa, Burkholderia thailandensis E264
MKRLSRAEILERLRATIARGEPIVGGGAGTGLSAKCEEAGGIDLIVIYNSGRYRMAGRGSLAGLLAYGNANEIVVDMAREVLPVVKSTPVLAGVNGTDPFCNFDAFLDELIRLGFSGVQNFPTVGLIDGNFRANLEETGMGYALEVDMIRLAHRKGLLTTPYVFSEADAIAMTEAGADIVVAHLGLTTGGTIGANTARTLADCVPLVRSWADAAKSVRDDVIVLCHGGPIASPEDAAYILRACPQCHGFYGASSMERLPAETALTDMTRRFKEIDRRAAS

SEQ ID NO: 9474 - protein, 477 aa, Pseudomonas fluorescens Pf-5
MRRRGSLAGILPLTSEQIKPIIEVFMNAPFDQLSSWLKDHKITEVECVVSDLTGIARGKIAPTNKFLHERGMRLPESVLLQTVTGDFVDDDLYYELLDPADIDMVCRPDSSSIYLVPWAIEPTAIVIHDTFDKFGNPIELSPRNVLKKVLQLYTDKGWKPIVAPEMEFYLTQRCEDPDLPLKAPLGRSGRAESGRQSFSIDAANEFDPLFEDVYDWCEAQGLDLDTLIHEDGPAQMEINFRHGDALDLADQITVFKRTLREAALKHNVTATFMAKPVADEPGSAMHLHQSVVDIDTGKPIFVDANGEKSKLFLHHIGGLQKYIPKLLPMFAPNVNSFRRFLPDTSAPVNVEWGEENRTVGLRVPTASPDAMRVENRLPGADANPYLAIAASLLCGYLGMVEGIEPSAAVEGRAYERRNLRLPITIEDALAHMEDCPTIEQYLGRKFVRGYVAVKRAEHENFKRVISSWEREFLLLSV

SEQ ID NO: 9475 - protein, 341 aa, Gibberella zeae PH-1
MASIIDTVKNTIAENFGGPAEQLATHQFSLSETPNLSGKVAVVTGGSEGIGYGVTHTLLTHDISKIFILSLSKEVVEGAKKSVAEELGQEKADRTEWVQCDLSNWAEVKKAADQIKDSTDRLDILVNNAGRGIQTYQLSSYGVDQHMATNHFGHVLLTSYLLELLKKTSEKHGIVRIVNQASNAHQGAPSDVKFESLEELNTDLGPNPQYGRSKLANILYTRYFDRNVTKAGSPKILMNATHPGFVSTRQSLEHIHEAYPLAGYAMSVGMEPFKKDQFQGATSAMYAATMTDKSGQYICPPAVPELGNEKSQDEKLGDQLMELTRKIISEKFESFDDRKFY

SEQ ID NO: 9476 - protein, 258 aa, Triticum aestivum
  misc_feature (231)..(231): Xaa can be any naturally occurring amino acid
  unsure (1)..(258): unsure at all Xaa locations
TSLYKKAGWYRSGIPGISSTHASAHASGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVXRKQAGQPDARQSGSIQILTSHTLQPVP

SEQ ID NO: 9477 - protein, 254 aa, Listeria monocytogenes str. 4b F2365
MRKPLVGINMKNYINTRAQTSEWLEATIPLLKNFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVRANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 9478 - protein, 475 aa, Zymomonas mobilis subsp. mobilis ZM4
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALQEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 9479 - protein, 807 aa, Yarrowia lipolytica CLIB122
MKRRTSYLQNELERLSNELQLVFSDVGFSHAEKEEKERLHFQKLVEALQIRLLEEKSYRDELKQKCVDKQIRLKVLKTTSLPDVAAGVTAASGLVAVIDEPILPPYKELLERLDRSGSKLEQVFEERCDIVRRVQNKLDYLDQVMGPDTHSNEDSWRVDLDGCVPPRLTLDVLKGVEDQLERRQEEYESRKSQIDFLATEINEHWSLLGVENNELDETIIHHRSVPLALTNAKITYLQDTLKELQLLREERQKTIETYKAEVEHLWSRLDEDEGVIGRFLGTVAGETAVVVEKWHEELLRMRQQKQAHLEVFIAEARDNLKSIWDALYYSEEQRHDFVPFYMTEDSSEALLEVHEKEIAAREAELTENEGILDLVKQHKQLVQDAKDLEESSRDPARLMGKSQRGDPGRLLREEQMRKQIARKMPRLLVSLKESLMEYEEEQGKPFLVFGKSYLQVMQQQEVAQTPRRRAAASVAQSASRSVSQSASRGGPPSVSRSVSATSAPRSAQASPTKTRNMTQPITRSAPRPGARPVTAGNDTTSIRGNLNSLRNPGRPSTVGASTSRTAASRILGSVPRMQPLQNISSNRINKPSTIPGPKRRSLNKKLTAAQVNHNLMGGQETPVRESTPMKDISALHAQRNVPVWERLSPKKAADTEPRSSPQRSPQKSPQRSPAKSLKTTNSPMVTIKSPVKEFAVPNQYIAPGSVSSTVTMSQSPKRSPKKYGQLDRFHIGCPEAEIRSVSGSSTTSTTSSVSVFSDSCDLPSSDEEDPEYAALMMQQRRQISRGLPKKRSDQPRLSVFNWDKDVF

SEQ ID NO: 9480 - protein, 287 aa, Staphylococcus epidermidis RP62A
MAIQWYPGHMAKAKRQVSEQLKKVDVVFELVDARIPYSSRNPMIDDVIKQKPRVVILNKKDMTNLKELEKWETYFKDEGFYPVAVDAKHGKNLKNVEVEAIKATQEKFDREKAKGLKPRAIRAMIVGIPNVGKSTLINKLAKRSIAETGNKPGVTKQQQWIKVGKSLQLLDTPGILWPKFEDEEVGKKLSLTGAIKDSIVHLDEVAIYGLNFMIKHDVSALKRHYNIDTHEDAEILDWFDAIGRRRGLLQKGNEVDYESVIELIINDMRNAKIGTYCFDILKEMKSE

SEQ ID NO: 9481 - protein, 314 aa, Triticum aestivum
MEKPSHVATADGKQASHRIAVVTGGNKGVGLEVCRQLAAQGVTVILTARDEKRGKDAVESICRESNLSNVVFHQLDVRDDSSVASLARHIESRYGELDILVNNAAVVGVAADEEGLKALNLDAETWTSGRAATVLKDVFQNTYEVARDCLDTNYYGCKRVTEALLPLLKLSKSGARIVNASSLASELKRMPNEELRKDLSNIDIWDEARIEAVLNTFMDDLKNGRLEEAGWPAMLPAYSVSKMVINLYTRILARRYPEMRVNCVRPGFVRTDINWNLGTLTPEQGARGPVMLALLPQDGPTGCYFDQTEMVNVW

SEQ ID NO: 9482 - protein, 274 aa, Candida albicans SC5314
MKDYTITVLGCGVMGTAVTSAILKSKFDPYPKKIIACTIPSQEQSLKETFADQPLVHVSAGVENNNKAVTEADVIILGCKPYMYEGIYEEVKESLTGKQLLISLLAGTTIKELSIFTPYVAKVMTNTPARFGCGTAAIAFAPEVGEESQELVMKLIDTVGMTVKIPEKNMDIATSLIGSGPAFCLLMMESMIDGAVRMGMPYDVASVAAAKVMEGTARMVLETGEHPAALKSKVCTPGGTTIGGLLTMEDRGLRSAIARGVEEAANISASFAKK

SEQ ID NO: 9483 - protein, 314 aa, Methylobacterium extorquens
MTKKVVFLDRESLDATVREFNFPHEYKEYESTWTPEEIVERLQGAEIAMINKVPMRADTLKQLPDLKLIAVAATGTDVVDKAAAKAQGITVVNIRNYAFNTVPEHVVGLMFALRRAIVPYANSVRRGDWNKSKQFCYFDYPIYDIAGSTLGIIGYGALGKSIAKRAEALGMKVLAFDVFPQDGLVDLETILTQSDVITLHVPLTPDTKNMIGAEQLKKMKRSAILINTARGGLVDEAALLQALKDGTIGGAGFDVVAQEPPKDGNILCDADLPNLIVTPHVAWASKEAMQILADQLVDNVEAFVAGKPQNVVEA

SEQ ID NO: 9484 - protein, 248 aa, Corynebacterium glutamicum ATCC 13032
MTNGKLILLRHGQSEWNASNQFTGWVDVNLTEQGEAEAKRGGELLVEAGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 9485 - protein, 482 aa, Debaryomyces hansenii CBS767
MLRVKNISNSVRLASRARHGSLSSRAFSNFSRLNAAVNDESNVKPFKHALGRDAQRYSDEPGTFGKTTFTESMDEVDMTWGRDDDPKHVEKQNTKIRHFTINFGPQHPAAHGVLRLILELHGEEIVRADPHVGLLHRGTEKLIESKTYMQAIPYFDRLDYVSMMTNELVFALAVEKLLNIEVPLRAKYIRTLFGEITRILNHCMSVLSHIMDVGGLTPFLWGFEEREKLMEFYERVSGARLHSNYVRPGGVSQDMPVGLLDDIYMWATQFGDRIDETEELITDNRIWAARTKDVGVVTAEDALNYSLSGVMLRGSGIPYDIRKAQPYDAYELVDFDVAVGMNGDCYDRYLIRMAEFRQSLRIIYQCINDMPNGPIKTEDFKVSAPPRSMMKEDMEALIHHFLLYTKGYAVPQGETYTAIEAPKGEMAVYVVSDGSERPYRCKIRAPGFAHLGAFDHISRGNLLADAVAIIGTMDLVFGEVDR

SEQ ID NO: 9486 - protein, 331 aa, Costaria costata
VGMDQKDAYVGDEAQSKRGVLTLKYPIEHGIVTNWDDMEKIWHHTFYNELRVAPEEHPVLLTEAPLNPKANKERMTQIMFETFNVPAMYVNIQAVLSLYASGRTTGCVLDSGDGVSHTVPIYEGYALPHAINRLDLAGRDLTDNLMKVLTERGYSFTTTAEREIVRDIKEKLTYVALDFDQEMKTAAESSQLEKSYELPDGNVIVIGNERFRCPEVRFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 9487 - protein, 92 aa, Shewanella oneidensis MR-1
MFKTAAAVHILVKHKEQAEDIIKQLNNGANFGALAKRYSSCPSAKKGGDLGEFKRGQMVPQFDKVAFSGELLVPHLVKTKFGWHVVKVLYRT

SEQ ID NO: 9488 - protein, 453 aa, Streptomyces coelicolor A3(2)
MDKQQEFVIRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALARTSDLGFTFYTHPEIEFFLLKDKPVDGSVPTPADNSGYFDHTPQNIGMDFRRQAITMLESMGISVEFSHHEGAPGQQEIDLRYADALSTADNVMTFRLVMKQVALEQGLQATFMPKPFSEYPGSGMHTHLSLFEGDRNAFYESGAEYQLSKVGRSFIAGLLRHAAEISAVTNQWVNSYKRIWGGTERTAGAGGEAPSYICWGHNNRSALVRVPMYKPGKTGSARVEVRSIDSGANPYLTYAVLLAAGLKGIEEGYELPPGAEDDVWALSDAERRALGIEPLPQNLGEALALMERSDLVAETLGEHVFDFFLRNKRQEWEEYRSQVTAFELRKSLPVL

SEQ ID NO: 9489 - protein, 184 aa, Zea mays
MAAGAGAGASAPVAWLLAAAVAAAALAASASAQSGCTTTLISLYPCLNYISGNVSTPPPSCCSQLASVVQTSPQCLCAALSSDSSSLGGVTIDRTRALQLPQACSVKTPPASKCNSVGGGSAPGAATPAAPSSGVPATAAAGTGSGSKATPTAPFLTSGGASVRGAVSLALAFAAVAVYAISAA

SEQ ID NO: 9490 - protein, 387 aa, Xanthomonas campestris pv. vesicatoria str. 85-10
MLALNYHGSRDVRVETVPDPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLVVPDALHDEQVLFLSDILPTGYQAVVDAGVKQGSTVAIFGAGPVGLMAAACCRMLGAERIFMVDRHAYRLDFASRAYGVIPINFDEVDDPADVIVSQTDGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSSIISHRMPLADAARGYELFDKKQDDCRKVVLTP

SEQ ID NO: 9491 - protein, 152 aa, Neurospora crassa
MSNQEQTFIAVKPDGVQRGLVGNIISRFENRGFKLVAMKLTQPGQAHLEKHYEDLNTKPFFAGLIKYMNSGPICAMVWEGKDAVKTGRTILGATNPLASAPGTIRGDFALDMGRNVCHGSDSVENAKKEIALWFKPEELNQWNHHSAAWIFE

SEQ ID NO: 9492 - protein, 229 aa, Zea mays
MAAARRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 9493 - protein, 471 aa, Klebsiella pneumoniae
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIISTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 9494 - protein, 405 aa, Burkholderia thailandensis E264
MVPHRKQIYVAATVDTKGAEAHFVKDRIADAGLAAVVVDLSTRAPGLAADIGAAAVAAHHPDGAAAVFCGDRGRAIAAMAVAFEHYIRSRDDVAALIGIGGSGGTALVTPAMQALPVGVPKLMISTMASGDVSAYIGSSDIAMLYSVADIAGLNRISRQVLANGAYMIAGAVRDMQPLPADLKPALGLTMFGVTTPCIQAVTSRLDARFDCIVFHATGHGGHAMEKLADSGLLDGVLDLTTTEVCDLLMGGVLACGDDRFDAIARSKVPYVGSCGALDMVNFGHIDTVPPRYAQRLLYKHNPQVTLMRTTPDENRRIGEWIGAKLNACDGPVRFLIPEGGVSALDAPGQAFWNPEADAALFDALEATVVQTENRRLVRVSAHINDPLFADIAVEHFLSLHAAHRN

SEQ ID NO: 9495 - protein, 251 aa, Bacteroides fragilis YCH46
MMPYPESFPVPLIHIAKADSTNGYLNALCEKEKVSELTTVVADFQTAGRGQRGNSWESEDGKNLMFSFVLYPTFLEARKQFLLSQIASLAVKETLDLYIGDVSIKWPNDIYWKDKKICGMLIENDLMGIHISQSIAGVGININQKEFHSSAPNPISIIQITHRESDRMEILAQVLQRIKEYYKILQEGDIEFITDRYQAALFRKEGIHFYKDSEGTFNAGIVEVEADGHLVLQDETGKIRRYLFKEVQYIL

SEQ ID NO: 9496 - protein, 258 aa, Haloquadratum walsbyi
MITVSVIGCGHMGSALLEGLATVEGYRTIGYDVDPAVLDDVKSYCDRTTTDIDAISDSDIVALTVKPDIVPTVLAEINLHAEQTLMTAAAGVERSFVSNQTDATVIRLMPNLAASLREMAAAVAWDEPDPAVETMLSDLGSYVVIDETHMNIATALNGSGPAFVYYLIQSMQTRAIKEGLDKSDAQTLAIQTFIGAAEMVRAADEPIESLIDAVCSPNGTTIEGMNVLFDSNVDAEVGDALTAATERSAELAAEVDHE

SEQ ID NO: 9497 - protein, 282 aa, Moorella thermoacetica ATCC 39073
MAIEGSKQQVLEFLRRHRGEYISGEDLSRDLAISRTAVWKHIQSLRQEGYRIDAQTRRGYCLLATPDCFYPEEVTAGLETAWLGRTLYYYDEVGSTNQVAKELADDGAPEGTVIVAECQTGGRGRRGRSWISPARKGIWFSVILRPRVAPAQAPQLTLLAAVAVVAAVRERTGLPLGIKWPNDLLAGGRKVCGILTEIKAEIDAVEYIVLGIGLNANLEAGDFSPEVSPQATSLYLELGRPVERLPLFQRILSCLEKWYERWQDEGFAPVREAWKEASITLG

SEQ ID NO: 9498 - protein, 312 aa, Zea mays
MEGVISTSPGARIAVVTGGNKGIGLEVCRQLAGNGITVVLTARDETRGAAALEELRALGLSDVVFHLLDITDASSIARLAGFLKARFGRLDILINNAAFGGVEYARGPAAAAAGSVTSEEELSGMDRDQRLECLWRNTRETYDAAKKGLLTNYYGTKHVIEALLPLLRASSDGRIVNVSSDFGLLRFFRNEELKQELHNVEKLTEGRLDELLDAFLEDFEAGEADARGWPAAFAAYKVGKAAMNAYSRILAAEQPTLRVNCVHPGYIKTDITLRSGLLTPEEGAGNVVKVALLPGGGVTGAFFEDGQEASFV

SEQ ID NO: 9499 - protein, 575 aa, Deinococcus radiodurans R1
MDMRVSWFLLLLPFVLTSALAATSAASHASGPPAFMGQLTLLLLVAGATAFASFRLGLVPIIGFLFAGVLAGPSALGIIDDPALIGAASEIGVMLLLFTIGIEFSLDKLARIFRLIFVGGGLQVLLTVAAVTGVLLAFGVSLPNAVFTGFLLSLSSTAIVTKILESRGGVGSPTGQASLGILIFQDLAVVVMVLLVPMLAGQGGGAGGLVVALLKAGGIVAAVLLLARRVVPKLLEVVARTCSQEIFLLSTLSLCFATAYLTSLAGVSLALGAFLAGLLVSESRFGQQAFGEILPLQILFSAAFFLSVGLQLDLGFLWTHLPLVLGAVAVFAVLKALAAALSVRLLGFPLATAAATGWLLAQVGEFSFVLESSGRALGLSPAGLGETGTQTFIAATVLLMALTPVMATLGERLGALGRARPAPTAAPAEAPTRAEPNPEAPLAHLSGHVLVAGFGDHARRLVKGLAAQQVPFGVLTLSPDGAAQVTAHGYPVLIGDYARAGLLGDAGLASARALVVLDDVPEMTARVIGVARTLNPELTIVAHTDEPGEIATLRGVGATHVLTSTDAVARGVLGL

SEQ ID NO: 9500 - protein, 491 aa, Sinorhizobium meliloti 1021
MALTPALTRHIRRPKIFASLDEVTRSSGQPAGPVFDVSNPSTGELLATLPDMGIDDARTAIDAAALAQPLWAGKPAKDRSIILRRWHDLIVEHADDLAAILTAEMGKPVGEAKGEVLHAASYVEWYAEEAKRVYGETFPAPANDRRMLVIKQPVGVVGTITPWNFPASMVARKISPALAAGCTIVLKPAEQTPLVAGAMFVLAEKAGFPEGVLNLLYASEGAPIGRELCGNPKVRKISFTGSTEVGRLLMRQCSDQIKKVSLELGGNAPFIVFDDADIDEAVDGAVQAKFRNAGQTCVSANRIYVQSAVHDAFAEKFVTRVRELTVGDGFAPDVAIGPMIDAHAIDKIEAHVADAVAKGAQVRSGGSRIGTTGTFFEPTVLTGISHDMRIAQEETFGPIAPIIRFETAEQVVAEANDTIYGLAAYFYAENLKRVWHVAEALEYGMVGINTGRMSSEAAPFGGIKQSGIGREGSRHGLEDYLEMKYLCMGNI

SEQ ID NO: 9501 - protein, 341 aa, Glycine max
MVSEGILLGIGNPLLDISAVVDQDFFKKYDITSNNAILAEDKHTPMFEELVEKYNVEYIAGGATQNSIKVAQWMLQVPGATSYMGGIGKDKFGEEMKKNSRLAGVNVHYYEDETTPTGTCAVCIVGDDRSLVANLAAANCYKSDHLKRPENWALVEKAKYIYIAGFFLTVSPDSIQLVAEHAAANNKIFSMNLSAPFICEFFRDVQEKALPYTDFVFGYETEARTFSKVHGWETDNVEEIALKISQWPKASGTHKRITVITQGVDPVCVAEDGKVKKFPVQLLPKEKLVDANGTGDAFVGGFLSQLVQEKPIEECVRAGCYAANVIIQRSGCTYPEKPDFH

SEQ ID NO: 9502 - protein, 443 aa, Rubrobacter xylanophilus DSM 9941
MSEITRENVVREARERNVKFIRLWFTDILGTLKSFAITIDELEDALDGGMGFDGSSITGFNAIEESDMIAMPDISTFKIIPWSPKDAPTARMICDVRTPEGDPYVGDPRYVLRRALERAHEMGFDNFYCGPELEFFYFKDSSAPEPLDYGSYFDLTTLDAATALRRDTVLALQELGIDVEYSHHEVGVSQHEIDLRYDDALSMADAVMTYKTVVKEIATQHGVYATFMPKPIQNQNGSGMHTHQSLFSNGRNAFFDPDDEYFLSETAKQFIAGQLRHAREISIIFAQYVNSYKRLVPGYEAPVYIAWSRRNRSALVRVPLYHPGKEQATRVELRCPDPAANIYLCFAALLHAGLEGIEKGYELPEPMERNLYHLTHEEREKLGIQSLPEDLGEAIKEAENSELLHKTLGDHVYNRLLQLKREEFEEYRVQVTPYELQRYLPVL

SEQ ID NO: 9503 - protein, 256 aa, Prochlorococcus marinus subsp. marinus str. CCMP1375
MLPKELVRFKELGNQITILTAWDSLSSAIVEAAGADVVLVGDSLAMFIHGHTTTLPVTLEQMLHHTQAVGRGFLSPKNKQPLVVCDLPFLSYQCGEDKAVAAAGTLLKNSCAAAVKIEGAEPEVISVIERLIRMGIPVMGHLGLTPQSVNNLGYHRQAEDALGQEKLVTQALKIEQVGCFSVVLEHVPSKVASKVTQMLKIPVIGIGAGEECDGQVRVTADLLGLTDKQPPFAKPLIDGRSLFIESLTSWVDQLRN

SEQ ID NO: 9504 - protein, 424 aa, Methanosarcina acetivorans C2A
MVSEVTLDKSRQMYEKAKTLIPGGVSSPVRAIKPYPFYTASADGSKIRDLDGNEYIDYCLAYGPAVLGHNHPVIKAAIKEQLDKGWLYGTPTELEVTLAEKVAGYYPSIDMLRFVSTGTEATMSALRLARGFTRKNKFIKIEGGFHGAHDAVLVKAGSGATTLGEPDSLGIPADFTKYTLQAPYNDIETMTTLVEKNRDDLAAVIIEPVLGNIGPILPLPGYLKELRKLTKENDVLLIFDEVITGFRLAMGGAQEYFGVVPDMTTLGKIVGGGLPIGVFGGRREIMEMIAPSGAVYQAGTFSGSPCSVAAGIAVLDYLKKEDIHAKLNSTGDYMRAVVSEIVEDEGLDYTVCGIASMFKIFFGAEPHNYQEALKCDKEGYLSFFHRMLANGVFLPPSQFETNFISAAHSEEDIEKTLEAYVENL

SEQ ID NO: 9505 - protein, 354 aa, Triticum aestivum
  misc_feature (231)..(231): Xaa can be any naturally occurring amino acid
  misc_feature (235)..(235): Xaa can be any naturally occurring amino acid
  misc_feature (251)..(251): Xaa can be any naturally occurring amino acid
  misc_feature (253)..(253): Xaa can be any naturally occurring amino acid
  misc_feature (256)..(258): Xaa can be any naturally occurring amino acid
  misc_feature (303)..(303): Xaa can be any naturally occurring amino acid
  unsure (1)..(354): unsure at all Xaa locations
MKSTVVALLLLVAVQCLALGPGTTAAAKPRRTRQGDYLNRLRGSPSSRVSWESLAAVEEEETTTKATGRPAPAAAAAEAGRKEADRVEALPGQPSGVDFSQYAGYVTVDPAAGRALFYYLAEAVGGNGDGSSSKGKPLLLWLNGGPGCSSLGYGAMEELGPFRVMSDGKTLYRNPYSWNHAANVLFLESPAGVGYSYSNTTADYGRSGDNRTAEDAYLFLANWMERFPEYXGREXYITGESYAGHYVPQLXHXHLXXXSPAINPQGIMIGNAVINDWTDSKGMYDFFWTHALISHETAAGINXNCNFNGAGRGAGPKALCNMEWEEGNKTLGKVRLKNHTAPLAVETRICICCL

SEQ ID NO: 9506 - protein, 270 aa, Corynebacterium glutamicum ATCC 13032
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 9507 - protein, 365 aa, Triticum aestivum
MANSAALLHSLLSTGWTPRRRLDRASATRLAPSPGLSCRSSRPTRSVRPMASSTTAARADAAPPGLKEGIAGLYDESSGLWESIWGEHMHHGFYDSGEAASMSDHRRAQIRMIEEALAFAAVPDDPTNKPKTIVDVGYGIGGSSRYLANKYGAQCSGITLSPVQAERGNALAAVQGLSDKASFQVADALEQPFPDGQFDLVWSMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKFSIITCHKPQAAIEGEPEAASPRV

SEQ ID NO: 9508 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGGTGKPSQEL

SEQ ID NO: 9509 - protein, 338 aa, Sordaria macrospora
MVVKVGINGFGRIGRIVFRNAIEHDDIQIVAVNDPFIEPKYAEYMLRYDSTHGNFKGTIAVEGSDLVVNGKKVKFYTERDPSAIPWSETGADYIVESTGVFTTTEKASAHLKGGAKKVIISAPSADAPMYVMGVNNESYDGSANVISNASCTTNCLAPLAKVIHDNFTIVEGLMTTVHSYTATQKTVDGPSSKDWRGGRTAAQNIIPSSTGAAKAVGKVIPDLNGKLTGMSMRVPTANVSVVDLTVRIEKGASYDEIKEVVKKASEGPLAGILAYTEDEVVSSDMNGNPASSIFDAKAGISLNKNFVKLVSWYDNEWGYSRRVLDLISYVAKVDASKA

SEQ ID NO: 9510 - protein, 451 aa, Solibacter usitatus Ellin6076
MRPRTHMNRYLLKSTIVAALGGLLFGFDTVVISGATSTLSDVYHLTPMLLGFTVASALLGTVLGSMVAAAPSDRYGRRQCLQALAVLYVVTAIGCAAAWNWPAFVVFRFIGGLAIGGSSVIGPMYIAEIAPAAKRGRLVGLFQFNIVAGILIAYLSNYFVGTLALGPEEWRWKLGLAALPAVLFFVTLFGIPQSPRWLIRRGFIAEAREIFRRIGEPDPDREVADVVRSVESEDRTKVEPLFQHKYRRPIFLAIAIGFFNQLSGINAILYYLNDIFKSAGFDKVSSDLQAVAIGGTNLLFTMIAMSLIDRLGRKKLLLTGAAGTAVCLAGVAVIFSTGQGEHLLVWLLIGFIGFFAFSQGAVIWVYLSEVFPNLVRAKGQSLGSFTHWIMNAIIAFTFPLVAALSRPAPFVFFAAMTVVQFVVVLFLFPETAGITLEDMEKQLERKASSGV

SEQ ID NO: 9511 - protein, 380 aa, Methanosarcina barkeri str. fusaro
MSSARLKRVEESATIKISNIATRMIKEGTDVINFSLGEPDFNTPKNICDAAAKAMYEGKTHYAPSGGIPELRAAIAEKLRTENNLDVTESGVLVTPGAKQGIFEVMMSVLDDGDQALLFNPAWVTYDACIRFAGAETVWVPTVPEKGFIPDNFEEYITDKTKLIVVNSPGNPTGGVFGKKTLQCIADLAIDHDLIVVSDEIYEKIIYDREHISIGSLDGMQERTITVNGFSKAYAMTGWRLGYLTAPPEILKLLLKIQSHSVSSATTFVQYGGLEALQGPQDSVKAMVDRFKVRRDVLIDGLNKMGFECKKPDGAFYAFANVSEYGNGTQVAERLLKEAQVAVTPGIAFGSSGEDFVRISYATSIDRIREALERLEKVFS

SEQ ID NO: 9512 - protein, 377 aa, Bacillus thuringiensis serovar konkukian str. 97-27
MKAVTYQGPNKVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRIHYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFKKITNKEFDPKEIITHKIPLEEASYGYQIFNNREDDCIKVILKP

SEQ ID NO: 9513 - protein, 326 aa, Oryza sativa
  misc_feature (29)..(29): Xaa can be any naturally occurring amino acid
  misc_feature (98)..(98): Xaa can be any naturally occurring amino acid
  misc_feature (144)..(144): Xaa can be any naturally occurring amino acid
  misc_feature (226)..(226): Xaa can be any naturally occurring amino acid
  misc_feature (250)..(250): Xaa can be any naturally occurring amino acid
  misc_feature (297)..(297): Xaa can be any naturally occurring amino acid
  unsure (1)..(326): unsure at all Xaa locations
FKTVASPGRGVLAMDESNATCGKRLASIXNRQAYRTLLVTAPGLGQYISGAILFEETLYQSTVDGRRIVDVLAEQGIVPGIKVDKGLVPLAGSDPESXWCQGLDGLATREAAYYQQGARFAEWRTVVSIPNAGPSALAVKEAAXGLARYAAISQEDGLVPIVEPEILLDGEHRVERTFEVAQKVWADTFFHMSENNVMLEGILLKPSMVTPGAESKDGAATPEQVXRRVPPAVPGVMFLSGGQSEVEATXNLNAMNQAAPSANPWRWRVSFSYARALQNTCLKTWGGRRENVAAAQXNSLAQLGKYTSDGEAAEASEGMFVKNYTY

SEQ ID NO: 9514 - protein, 247 aa, Zymomonas mobilis subsp. mobilis ZM4
MSETSKQKKIALVSGANRGIGLAIAIGLAQQGVTVLMGTRNLKNGEAVCAQHAQEGLDIRPVQLDTTDDASVRAVSSLIQREYGRLDILVNNAGIGLDFVPDLSVVEKMEQTLMLNVTGTIRLTDALLPLLEAAGHASIVNVSSELGSFGLRADKNWIYAELVMPTYQASKAAVNSLTVSYAKLLASKGIKVNSICPGYTATDATKGAAMPATRTPEQAARVAIKLALIGQDGPTGTFENEDGQLPW

SEQ ID NO: 9515 - protein, 528 aa, Zea mays
MSKPWGSVGAGAWALDAERAEEEEREQALTFPAPEPPLPAGGAASFPSLREAASAGGRGKSKKKNKGTTLSLSEFTTFGAAAAQRRAAPVEPKGLTHEEMMLLPTGPRERSAEELDRSRGFRSYGGGGGFGAGAGGERRGGFDDEGRRGPGRSSDLDMTSRADEADDWGATKKFTPAPADSGRRDRFGGPSPLGRADDIDDWSRDKKPLPSRYPSLGSAGGFRDSPGFRDSSASSDADRWVRGATPMPHNGQGAGERPRIVLNPPKRDPSAASTPSAEVARNRPSPFGAARPREDVLAEKGVDWKKFENEIEQKTSRPTSSHSSRPNSAHSSRPGSPGSQVSAVGSEGAPRARPKVNPFGDAKPREVVLQEKGKDWRKIDVELEHRAINRPESDEERNLKEEINLLKVDLKEIEGKMSNGSEQTSVDAKDLSEKISMLESQLEQLSRELDDKIRFGQRPRSGAGRVTTLAPTSLGEEPQATVVDRPRSRGGMEPPPRQEERWGFQGSRERGSFGGSRNSDRPMARQRW

SEQ ID NO: 9516 - protein, 374 aa, Ostreococcus tauri
MNRSRTSSFSTDRSASTVALAPDGDYERERVSALASWPEYAVDALRSEQDFIVHQSAALWTHRTPALHDPDSQETQLDVAKGLLARERETHGSFVFDARAAHHCAFRSQLVEWILDVCAGERFGPTTADVAIAYTDRVLSKTVVPKTSLHLVALCCLHIAVKYEEIEERVPTMSKLRSWTSNMYSPEIIRKMELAVLIELGWDLGVLTPAHFLESFLALTNGGISDGDDIEHGDAYKERYREELRYFVCQLYSLCVQDTSLLNQPPSQIASAVIATARVHLGVKPMCSPELRAAGNVTPQQIYPLVAHMLKLWDEACAEDEAMDEVETSAEFNSLTIQVPKPIGHDIVSKMGYEHRVTENASPTCPFDMQWDEE

SEQ ID NO: 9517 - protein, 413 aa, Sulfolobus solfataricus P2
MQILFFMKIIRDPIHGYIEVEDFVLQIISTEIFQRLRHITQTGLAYLVYPGMRHTRFEHSLGVMHLAKELTRYIKINSEQYTDLDFINEEYLKLVGLSGLLHDIGHLPFSHTFENALSLAKEVYGIDVEYYGKKTHVIFGNRVIDYYLGNYLDKLSKNYDVVNFVQRVISSTPRTKEESLASLIISSPLDADRGDYLLRDSYFAGVGYGNFDIERIKRSLIYVNGKLAVLKKAIPVVEQFLLARMYMYETIYFHSVVGLYNAVLSHAVVKLIQKNLIPNVAPENYLKLNDVVIMSKLNEAGREFFDAIVYRKGFKRYKKDLTGNCYETLEKKRKEINEIMRENNGLILYHDFYDVPYSEDEIFVYDDDELKPLSTESKIVSSLTIIKKGIVGYHESAEDKMKKIYEILQECPL

SEQ ID NO: 9518 - protein, 396 aa, Streptomyces coelicolor A3(2)
MTSMSSSARPLLNRRLAEFGTTIFAEMSALAVRTGAINLGQGFPDTDGPEEVREAAVRALRDGRGNQYPPGPGVPELRAAVAGHQQRRYGLSYDPDTEVLVTAGATEAIAAALLALLEPGDEVVALEPYYDSYAACIAMAGGTRVPVTLRPHEGTFRLDLDELRDAVTDRTRLLLLNTPHNPTGTVLTRDELAAIAELAVERDLLVVTDEVYEHLVFGTAEHIPLASFPGMRERTVTIGSAGKTFSFTGWKVGWVTAAPALLTAVRSAKQYLTYVASGPFQYAVAEALALPESYFAAYRQDMEAKRDLLAAGLAEAGFGVYRPAGTYFVTTDIRPLGERDGFAFCRSLPERAGVVAVPNAVFYNHREEGAPFVRFAFCKRLPVLEEAVGRLKTLSA

SEQ ID NO: 9519 - protein, 113 aa, Yarrowia lipolytica CLIB122
MLRQMMNSRLFAARPAFVRPFSTTQIARNASWRRPNELNDYEKQISQMLTDEFKPVSLDVRDISGGCGSMFAIQIVSDKFKGIPMVKQHRLVNALLADEIKQWHGLQLVTKAA

SEQ ID NO: 9520 - protein, 397 aa, Streptococcus agalactiae NEM316
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAATAYDLNYLKTKKEKMGHLLD

SEQ ID NO: 9521 - protein, 136 aa, Brassica napus
  misc_feature (133)..(134): Xaa can be any naturally occurring amino acid
  unsure (1)..(136): unsure at all Xaa locations
MKLLHASLCLISLLLILPSIFAASSSEDFDFFYFVQQWPGSYCDTQRSCCFPTSGKPAADFGIHGLWPNYKDGTYPSNCDNTKPFDSSSISDLISSMQKSWPTLACPSGSGETFWEHEWEKHGTCSESVIDQXXYF

SEQ ID NO: 9522 - protein, 523 aa, Methanosarcina acetivorans C2A
MKVLVSDSLSNEGLEILKEHFTVDVNTGLSEDELVEKIGEYDALVIRSGTQVTQRVIEAADNLKIVGRAGVGVDNVDVDAATKKGIIVANAPEGNMISAAEHTIGMMMAMSRNIPQANASLKGREWKRNKFMGVEVKGKTLGIIGLGRIGSEVAKRASGLEMNLMGYDPFISEKRAMELGVKLATVNEISKEADYITVHTPLIKETRNILDDEQFDLMKSGVRILNCARGGIINEAALVRALESGKVGGAALDVFVEEPPFGSPLLNFDNVIVTPHLGASTQEAQVNVAIDIAKEVVSVLTGGLAKNAINIPSVKPEAMAVLAPYIRLAELMGKIAGQLVDSNYEKVEIGYNGEISGKDTRPLTVSALKGLLEMALGAGVNYVNAPALAKSRQIAVVESKSESAEEYSSTVSIKLSSGETAKLVAGTVVGDEPKIVSIDEDRVDIFPAGRMIFAKHINKPNVIGPCCMVLGKNNINISGMQVGRSEVGGVTMMVLNVDTDVSDAILDEVRQVPGILNAKLVTL

SEQ ID NO: 9523 - protein, 48 aa, Triticum aestivum
MPSLQKALPPELADNALRLFRECLRRAKFIGNQVCIFSLELSCYLVTS

SEQ ID NO: 9524 - protein, 436 aa, Zea mays
  misc_feature (191)..(191): Xaa can be any naturally occurring amino acid
  misc_feature (198)..(198): Xaa can be any naturally occurring amino acid
  unsure (1)..(436): unsure at all Xaa locations
MDPCPFVRVLVGNLALRMPVAPPAAGAGAGVHPSTSPCYCKIRLGKMPVQSVPAPLVVSDGGEQTPASGALAAAFHLSKADLEWFNGKPSLFSSRGEASLKVSVYAGRKGSACGVSSGRLLGKATIALDLKGAEAKPAVLHSGWISIGKRSGKGSTAATELSLTVRAEPDPRFVFEFDGEPECSPQVLQVXGSMKQPXFTLQFGYAATTSDLRRPGMQPERDAASAKERKGWSVTVHDLKGSAVAMASMVTPFVPSPGTDRVSRSNPGAWLILRPAGDGSWEPWARLECWRERGGAGASDSLGYHFALLVPGADHAVALADSSIPSSNGGKFAIDLTAAQPLSRGGTPGCSPRGSGDLSNWPLGNYRGFVMSAAVQGEGRCSKPTVEVGVAHIGCAEDAAAFVALAAAVDLSMDACRLFSHRLRKELSHPQADLLR

SEQ ID NO: 9525 - protein, 371 aa, Zea mays
IAAAYRCTYSTVHNTRARADELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNAEGLARYALICQENGLVPIVEPEILTDGGHDIGTCAAATERVLAALYKSLSDHKVLLEATLLKTNMVTPGSDSPKVSAEVIAEYTVAALRRTVPPAVPGVVFLSGGQSEEEATQNLDAMNKLEVLKPWTLSFSFGRALQQSTLKKWVGKKENVAAAQATFVVRCKANSEAALGKYAGSGAGDAAASESLYVKGYKY

SEQ ID NO: 9526 - protein, 667 aa, Debaryomyces hansenii CBS767
MIINDNRLTFLAIHLFITFQITRAELLQTSQSSCLTKSVCNVDSCLLDAGNIFKPQTSLSKIDSLNYTTPSAPKSTQISTSTPPSTSISTSISTVLSTLTSIISTTSAEVISSLPENSVVSSSEDLFTEISKSDSGIITDDLNNAHFEVTSDVNSTNSTNTTEPFIPVQNYTNKNIQLNQSNETIDECHFLSFEEWKRQKAVDNKQINDSQPQAETIANELVPTTSGIDNSTQIPVSLDEDQGKIYKDRFNYASVGCAATIVKTNSHAKGASAILVENKDSYLLNQCSSSQKFVVIELCQDILVDTVVIGNFEFFSSNFRKIRISVSDRFPVGSSGMKVLGEFEAENIRDVQSFNIENPLIWARYLKLEILSHYGDEFYCPISLIRVYGKTMMEEFKMAEGHESFIGGEPEIKNEELVINNSMKDISNFTGINIQNEECRVALPHLGLTEFLKDINSTASDYCDAMYPLINEPETTQTIETKTTQESIYKNIMKRLSLLESNASLSLLYIEEQSKLLSQAFTNLEKRQSSNFESLINSFNDTMHNQISYFKNAYFSIQVEASKLFKAQENNHQSLLEESHHKMTILGNQLKFQKRLSILNTMIIICILSYVVLTRDVYIEDHMYDHFQQPLRTSQNTSGYSNLLDKYKRKNSKRNNRSKRRKPKSTN

SEQ ID NO: 9527 - protein, 404 aa, Lactococcus lactis subsp. lactis Il1403
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 9528 - protein, 921 aa, Sorghum bicolor
MTTTAARALVALLLVAVAVADDGATLVEIKKSFRNVGNVLYDWAGDDYCSWRGVLCDNVTFAVAALNLSGLNLEGEISPAVGSLKSLVSIDLKSNGLSGQIPDEIGDCSSLRTLDFSFNNLDGDIPFSISKLKHLENLILKNNQLIGAIPSTLSQLPNLKILDLAQNKLTGEIPRLIYWNEVLQYLDVKNNSLTGVIPDTIGNCTSFQVLDLSYNRFTGPIPFNIGFLQVATLSLQGNKFTGPIPSVIGLMQALAVLDLSYNQLSGPIPSILGNLTYTEKLYIQGNKLTGSIPPELGNMSTLHYLELNDNQLTGSIPPELGRLTGLFDLNLANNHLEGPIPDNLSSCVNLNSFNAYGNKLNGTIPRSLRKLESMTYLNLSSNFISGSIPIELSRINNLDTLDLSCNMMTGPIPSSIGSLEHLLRLNLSKNGLVGFIPAEFGNLRSVMEIDLSYNHLGGLIPQELEMLQNLMLLNVSYNNLAGVVPADNNFTRFSPDSFLGNPGLCGYWLGSSCRSTGHHEKPPISKAAIIGVAVGGLVILLMILVAVCRPHRPPAFKDVTVSKPVRNAPPKLVILHMNMALHVYDDIMRMTENLSEKYIIGYGASSTVYKCVLKNCKPVAIKKLYAHYPQSLKEFETELETVGSIKHRNLVSLQGYSLSPVGNLLFYDYMECGSLWDVLHEGSSKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYRLWHCSAGAADWQEASGQRILSKTASNEVMDTVDPDIGDTCKDLGEVKKLFQLALLCTKRQPSDRPTMHEVVRVLDCLVNPDPPPKPSAHQLPQPSPAVPSYINEYVSLRGTGALSCANSTSTSDAELFLKFGEAISQNME

SEQ ID NO: 9529 - protein, 337 aa, Volvariella volvacea
MVVNVGINGFGRIGRIVYRNAVENDQINVVAINDPFIDLAYMVYMFKYDSVHGRFKGTVESKDGKLVINGKSITVFSEKDPAAIPWGTAGADYIVESTGVFTTTEKASAHLKGGAKKVIISAPSADAPMFVVGVNLDAYDPKYTVISNASCTTNCLAPLAKVIHDEFGIVEGLMTTVHATTATQKTVDGPSHKDWRGGRSVANNIIPSSTGAAKAVGKVIPSLNGKLTGMSFRVPTLDVSVVDLVVRLEKPTEYSAIKAALKKAAEGEYKGIIDYTEDPVVSTDFIGNPASSIFDASAGIQLNPNFVKLISWYDNEWGYSKRVCDLVVYVAGKDGNL

SEQ ID NO: 9530 - protein, 281 aa, Ustilago maydis 521
MVTALVSGGNRGLGYGIVRRLANEFPTSPLSTSSSDKLTIYLGSRDIAKGEAAKNSITSELAQDTLDRVSIEVRQLDTTSHESIVKLGSELKEGVDILINNAGIAMDGFDANVATQTVATNYYAVQDMIQNINVKDGGRIVNIASLTGVLKGFGDNVRDRFRNSETIADTDALMKEFQQVVADGSWKENGWKGVAYATSKSGVIAYTRALAKQYQQEGKNVHVVSCCPGYVNTDMTKGKGYKTLDQGAETPVLLALNKLDAKPGEFWSDKKVYDWENRSDS

SEQ ID NO: 9531 - protein, 322 aa, Zea mays
  misc_feature (142)..(142): Xaa can be any naturally occurring amino acid
  unsure (1)..(322): unsure at all Xaa locations
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCXYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 9532 - protein, 505 aa, Emericella nidulans
MPSFSLLTGHFGALKQTIDGMPPNATLHSIMLKLSQKFRSGMFYINMWPFSGTWLVVATPSGAAQIQSLNLSKPNILRRPLETITGGPSLMSMHGETWKRWRALFNPGFNPNYLIGLAPLIADEVVVFCEQLRQKARTGTVFQLEPLTLRLTVDTICSVTLYVVTPVGRWPFLTPDLEIHSSTTKLRTTPLPQRCNGRSNGPRLELPSTPLRRYLTVRPLVMWYNNRLMNRFIDQEVDRAYREQSGRQSKSVISLALRDYMKEKDGSLEDFKRRVAPQLRVFLFAGRDTTSSTLLYAFYLLSRHPEALAKVRLEHDQVFGPYHQQVHEKIHQDAKLLNQLPYTTAVLKETLRLFPPSASMREGGPGVEITDDNGQVYPTAGCNVWTLTVALHHNSAHWAEAESFIPERWLVGSDHPLYPAKGAWRAFEFGPRSCIGQTLAMLELRVALAMTLREFDIAPAYDKWDHIYPNDAVKEFNGHRAYQAEKGGGGAHPADGMPCLVTFRV

SEQ ID NO: 9533 - protein, 189 aa, Triticum aestivum
MAPTVMASSVTSVVPFQGLKSTAGLPVSRRSNGASLGSVSNGGRIRCMQVWPIEGIKKFETLSYLPPLSTEALLKQVDYRIRSKWVPCLEFSKVGFIFREHNASPGYYDGRYWTMWKLPMSGCTDATQVINEVEEVKKEYPDAYVRIIGFDNMRQVQCVSFIDFKPPGCEESGKAYTDHSAWATYKVLL

SEQ ID NO: 9534 - protein, 96 aa, Brassica napus
  misc_feature (91)..(92): Xaa can be any naturally occurring amino acid
  unsure (1)..(96): unsure at all Xaa locations
MASSMLSSAAVVTSPAQAAMVAPFTGLKSSAAFPVTRKSNTDITSIASNGGRVSCMKVWPPVGKKKFETLSYLPDLTDVELAKEVDYLLRXXWIPC

SEQ ID NO: 9535 - protein, 1279 aa, Arabidopsis thaliana
MANFAKPENALKRADELINVGQKQDALQALHDLITSKRYRAWQKPLEKIMFKYLDLCVDLKRGRFAKDGLIQYRIVCQQVNVSSLEEVIKHFLHLATDKAEQARSQADALEEALDVDDLEADRKPEDLQLSIVSGEKGKDRSDRELVTPWFKFLWETYRTVLEILRNNSKLEALYAMTAHKAFQFCKQYKRTTEFRRLCEIIRNHLANLNKYRDQRDRPDLSAPESLQLYLDTRFDQLKVATELGLWQEAFRSVEDIYGLMCMVKKTPKSSLLMVYYSKLTEIFWISSSHLYHAYAWFKLFSLQKNFNKNLSQKDLQLIASSVVLAALSIPPFDRAQSASHMELENEKERNLRMANLIGFNLEPKFEGKDMLSRSALLSELVSKGVLSCASQEVKDLFHVLEHEFHPLDLGSKIQPLLEKISKSGGKLSSAPSLPEVQLSQYVPSLEKLATLRLLQQVSKIYQTIRIESLSQLVPFFQFSEVEKISVDAVKNNFVAMKVDHMKGVVIFGNLGIESDGLRDHLAVFAESLSKVRAMLYPVPSKASKLAGVIPNLADTVEKEHKRLLARKSIIEKRKEDQERQQLEMEREEEQKRLKLQKLTEEAEQKRLAAELAERRKQRILREIEEKELEEAQALLEETEKRMKKGKKKPLLDGEKVTKQSVKERALTEQLKERQEMEKKLQKLAKTMDYLERAKREEAAPLIEAAYQRRLVEEREFYEREQQREVELSKERHESDLKEKNRLSRMLGNKEIFQAQVISRRQAEFDRIRTEREERISKIIREKKQERDIKRKQIYYLKIEEERIRKLQEEEEARKQEEAERLKKVEAERKANLDKAFEKQRQREIELEEKSRREREELLRGTNAPPARLAEPTVTPVGTTAPAAAAAAAGAPAAPYVPKWKRQTTEVSGPSAPTSSETDRRSNRGPPPGDDHWGSNRGAAQNTDRWTSNRERSGPPAEGGDRWGSGPRGRASGFSARSTAEEVTHGIDGTGLTAIVTGASSGIGEETTRVLALRGVHVVMAVRNTDSGNQVRDKILKEIPQAKIDVMKLDLSSMASVRSFASEYQSLDLPLNLLINNAGIMACPFLLSSDNIELQFATNHLGHFLLTNLLLERMKKTASESNREGRIVIVSSEGHRFAYREGVQFDKINDEARYNTLQAYGQSKLGNILHATELARLFKEQGVNITANSLHPGSIMTNLLRYHSFINTIGNAVGKYVLKSIPQGAATTCYAALHPQAKGVSGEYLMDNNISDPNSQGKDKDLAKKLWEFSLRLTGEEES

SEQ ID NO: 9536 - protein, 949 aa, Deinococcus radiodurans
MTKSLSDLLQTNDFTRRHIGPSEAEQAEMLGVLGVSSLDELTQTTLPAAIQFDGELHTGPGMTEAQALAELKAVAQKNKVFRSYIGMGYAGTDVPPVILRNMLENPGWYTAYTPYQAEISQGRLEMLLNFQQTVQDMTGMPVSNASLLDEATAAAEAMTLAKRQSKNKGSNVFFVADNVHPQTMDVVKTRAEYFGFEVQTGSADAIPEGAFGALVQYPGTHGEVLNLAPIAEKAHTQGAALIVATDLLACALLTPPGEQGADIVVGSAQRFGVPMGFGGPHAAFLACQKGFERSMPGRVIGVSKDVRGNTALRMAMQTREQHIRREKATSNICTAQALLANMAAAYAVWHGPEGIKTIAERVHRLTGILAKALQDAGIKANETFFDTLTFEGQDDLGARAEAKGINFRLDGGKVGISLDETVTPQDLADIIEVVTGKGVDVQKLDAEAVDGIPAPLKRQSDFLTHPVFNTHHSEHGMLRYLKQLENKDYSLTHGMIPLGSCTMKLNATTEMIPVTWPEFGGLHPFAPESQTQGYAEMLAELERWLADITGYDAVSMQPNSGAQGEYAGLLVIRKYHEARGEAHRNICLIPASAHGTNPASAAMMGMQVVVVKTDEQGNIDFDDLKAQAEAHSDHLAALMITYPSTHGVYEENVRDVCDLIHQHGGQVYLDGANMNAMVGVAKPGLIGGDVSHLNLHKTFAIPHGGGGPGMGPIGVKAHLAPFLPNHAVAPTSDSHTGAVSAAPYGSASILPISYLYIKLLGAAGLRQSTQVALLNANYIAKRLSGAFPVLYSGKGGRVAHECILDIRPLKQESGVSEEDIAKRLMDYGFHAPTMSFPVPGTLMIEPTESEPKAELDRFVDAMLNIRREIQDVQDGTISAADSPLKHAPHTLKDLMDSEWTRAYSRETGAFPSAAQKAWKYWPAVNRVDNVYGDRNFVCSCPPIEDYIGA

SEQ ID NO: 9537 - protein, 359 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLKIGPNEPSLSILSIENAYGLARYAVICQENGLVPIVELEILVDGSHDIHKCAAITERVLAATYKALSDHHVLLEGTLLKPNMVTPGSDSPKVAPEVVAEHTVRALQRTVPAAVPAVVFLSGGQSEEEATVNLNAINQVKGKKPWTLSFSFGRALQQSTLKAWSGKEENVKNAQDALLTRAKANSEATLGTYKGNSQLGEGASESLHVKDYKY

SEQ ID NO: 9538 - protein, 431 aa, Zea mays
  misc_feature (259)..(259): Xaa can be any naturally occurring amino acid
  unsure (1)..(431): unsure at all Xaa locations
RSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAGSFFLSLLFNFILKASXQLSAPCHQAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 9539 - protein, 516 aa, Arabidopsis thaliana
MKQNETFDQEREDLYHTFDEEDEESQTESSVPSTPLSRNRSEDVPVPWPRSYRQSMDLLTGVTPPTSTSFVSSFRQRRQSSVFGSFTSSPSKQQLLIDKDEIQSSVVSSIKSFLASHLQLSVPGDLLTPQENRSCTFSQSVLNGINVLCGVALLTMPYAVKEGGWLGLFILFSFGIITFYTGILLKRCLENSPGIHTYPDIGQAAFGTTGRILVSASCVEYIIMMSDNLSRMFPNTSLYINGFSLDSTQVFAITTTLIVLPTVWLKDLSLLSYLSGVISSILLALCLFWAGSVDGVGFHISGQALDITNIPVAIGIYGFGFGSHSVFPNIYSSMKEPSKFPTVLLISFAFCTLFYIAVAVCGFTMFGDAIQSQFTLNMPPHFTSSKIAVWTAVVTPMTKYALTITPVMLSLEELIPSSSRKMRSKGVSMLFRTILVLSTLVVALTVPFFATVAALIGSFIAMLIALIFPCLCYISIMKGRLTNFQIGICILIVIIGIVSGCCGTYSAIARLIGEMT

SEQ ID NO: 9540 - protein, 543 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITDSSIRGVVPCVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVVSGCCGTYSAISRLANQMTD

SEQ ID NO: 9541 - protein, 428 aa, Legionella pneumophila str. Paris
MSRSSDLFHKAQTIIPGGVNSPVRAFKGVGGEPVFFKSGKGAYLTDVDDKQYIDYVGSWGPLILGHCHPKVIEAVDNVLHSGMSFGAPTELEIQLAEKIASLMPSIEKIRMVNSGTEATMTAIRLARGFTNKNKFIKFNGCYHGHSDSLLVKAGSGLLTLGIPSTPGIPKSITEHTLTADFNNLEQVAQLFEKYPNDIATVILEPVPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSNTTNKLTEALADAAENANIPFFAASLGGMFGFCFTDKNSVENYFDVASSDEVLFKKFFHAMLAQGVYFAPSMYEAGFVSSMHGDLEIQKTYDAAELVLNQLSA

SEQ ID NO: 9542 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 9543 - protein, 558 aa, Salmonella typhimurium LT2
MHHATPLITTIVGGLVLAFILGMIANKLRISPLVGYLLAGVLAGPFTPGFVADTKLAPELAELGVILLMFGVGLHFSLKDLMAVKSIAIPGAVAQIAVATLLGMALSAVLGWSLMTGIVFGLCLSTASTVVLLRALEERQLLDSQRGQIAIGWLIVEDLVMVLTLVLLPAVAGMVEKGDVGIASLTVDMGITIGKVVAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLVLIQQPLAVLATLAIIVFGKSIAAFFLVRLFGHSPRTALTIAASLAQIGEFAFILAGLGMALNLLPQAGQNLVLAGAILSIMLNPVLFTLLEKYLAKTETLEEQTLEEAIEEEKQIPVDICNHALLVGFGRVGSLLGEKLLAAGIPLVVIETSRTRVDELRERGIRAVLGNAANEEIMNLAHLDCARWLLLTIPNGYEAGEIVASARGKSPDIEIIARAHYDDEVKYITERGANQVVMGEREIARAMLELLETPPAGEVVAS

SEQ ID NO: 9544 - protein, 252 aa, Streptococcus agalactiae NEM316
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 9545 - protein, 367 aa, Glycine max
MQKKKKNRNEVVLCSAEGTGGCSRLAAMDLASNLGGKIDKAEVLSAVQKYEKYHVCYGGQEEERKANYTDMVNKYYDLVTSFYEFGWGESFHFAPRWKGESLRESIKRHEHFLPLQLGLKPGQKVLDVGCGIGGPLREISRFSSTSITGLNNNEYQITRGKELNRIAGVDKTCNFVKADFMKMPFPDNSFDAVYAIEATCHAPDAYGCYKEIFRVLKPGQYFAAYEWCMTDSFDPQNPEHQKIKAEIEIGDGLPDIRLTAKCLEALKQAGFEVIWEKDLAVDSPLPWYLPLDKSHFSLSSFRLTAVGRLFTKNMVKVLEYVGLAPKGSLRVQDFLEKAAEGLVEGGKREIFTPMYFFLARKPDLDRN

SEQ ID NO: 9546 - protein, 983 aa, Zea mays
GDDHLAAAAARHRLPPARLLLRRWRGSPPRAVPEVGSRRVGVGVEGRLQRRVSARSVASDRDVQGPVSPAEGLPNVLNSIGSSAIASNIKHHAEFAPLFSPDHFSPLKAYHATAKSVLDALLINWNATYDYYNKMNVKQAYYLSMEFLQGRALTNAIGNLEITGEYAEALKQLGQNLEDVASQEPDAALGNGGLGRLASCFLDSLATLNYPALGYGLRYEYGLFKQIITKDGQEEIAENWLEMGYPWEVVRNDVSYPVKFYGKVVEGTDGRKHWIGGENIKAVAHDVPIPGYKTRTTNNLRLWSTTVPAQDFDLAAFNSGDHTKAYEAHLNAKKICHILYPGDESLEGKVLRLKQQYTLCSASLQDIIARFESRAGESLNWEDFPSKVAVQMNDTHPTLCIPELMRILMDVKGLSWSEAWSITERTVAYTNHTVLPEALEKWSLDIMQKLLPRHVEIIETIDEELINNIVSKYGTTDTELLKKKLKEMRILDNVDLPASISQLFVKPKDKKESPAKSKQKLLVKSLETIVEVEEKTELEEEAEVLSEIEEEKLESEEVEAEEASSEDELDPFVKSDPKLPRVVRMANLCVVGGHSVNGVAEIHSEIVKQDVFNSFYEMWPTKFQNKTNGVTPRRWIRFCNPALSALISKWIGSDDWVLNTDKLAELKKFADNEDLHSEWRAAKKANKMKVISLIREKTGYIVSPDAMFDVQVKRIHEYKRQLLNILGIVYRYKKMKEMSTEERAKSFVPRVCIFGGKAFATYIQAKRIVKFITDVAATVNHDSDIGDLLKVVFVPDYNVSVAEALIPASELSQHISTAGMEASGTSNMKFAMNGCILIGTLDGANVEIREEVGEENFFLFGAEAHEIAGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 9547 - protein, 230 aa, Streptococcus agalactiae NEM316
MVKLVFARHGESEWNKANLFTGWADVDLSEKGTQQAIDAGKLIQAAGIEFDLAFTSVLKRAIKTTNLALEAADQLWVPVEKSWRLNERHYGGLTGKNKAEAAEQFGDEQVHIWRRSYDVLPPDMAKDDEHSAHTDRRYASLDDSVIPDAENLKVTLERALPFWEDKIAPALKDGKNVFVGAHGNSIRALVKHIKQLSDDEIMDVEIPNFPPLVFEFDEKLNLVSEYYLGK

SEQ ID NO: 9548 - protein, 159 aa, Triticum aestivum
MDASATGAGAKAKKGVSGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKESKEGKSPKKTAKSPKKAEKKA

SEQ ID NO: 9549 - protein, 398 aa, Bacillus amyloliquefaciens
MFHPIEEALEALKKGEVIIVVDDEDRENEGDFVALAEHATPEVVNFMATHGRGLICTPLSEDIAGRLDLHPMVDHNTDSHETAFTVSIDHKLTKTGISAQERSFTIQALLDEESVPGDFQRPGHIFPLIAKKGGVLKRAGHTEAAVDLAKACGSQGADVICEIMNEDGTMARVPEISEIAKSHQLKMITIKDLIEYRYNITTLVNREVDITLPTDFGTFRVYGYTNEVDGKEHLAFVMGDVPFNSGPVLVRVHSECLTGDVFASHRCDCGPQLHAALRQIAEEGRGVLLYLRQEGRGIGLINKLKAYRLQEQGYDTVEANEALGFLPDLRNYGIGAQILRDLGVQHMKLLTNNPRKIAGLEGYGLSISDRVPLQMEASEHNKQYLQTKMKKLGHLLHF

SEQ ID NO: 9550 - protein, 184 aa, Arabidopsis thaliana
  misc_feature (134)..(134): Xaa can be any naturally occurring amino acid
  misc_feature (149)..(149): Xaa can be any naturally occurring amino acid
  misc_feature (174)..(174): Xaa can be any naturally occurring amino acid
  unsure (1)..(184): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTXDSAQVLKEVEECKKXEYPGAFIRIIGFDNTRQVQCISFIXAYKPPSFTEA

SEQ ID NO: 9551 - protein, 230 aa, Lycopersicon esculentum
MASNSAFSLFLILLIITQCLSVLNAAKDFDFFYFVQQWPGSYCDTKQSCCYPTTGKPAADFGIHGLWPNNNDGTYPSNCDPNSPYDQSQISDLISSMQQNWPTLACPSGSGSTFWSHEWEKHGTCAESVLTNQHAYFKKALDLKNQIDLLSILQGADIHPDGESYDLVNIRNAIKSAIGYTPWIQCNVDQSGNSQLYQVYICVDGSGSSLIECPIFPGGKCGTSIEFPTF

SEQ ID NO: 9552 - protein, 350 aa, Bacillus thuringiensis serovar konkukian str. 97-27
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 9553 - protein, 402 aa, Arabidopsis thaliana
  misc_feature (108)..(108): Xaa can be any naturally occurring amino acid
  misc_feature (191)..(191): Xaa can be any naturally occurring amino acid
  misc_feature (201)..(201): Xaa can be any naturally occurring amino acid
  misc_feature (342)..(342): Xaa can be any naturally occurring amino acid
  unsure (1)..(402): unsure at all Xaa locations
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGXLGQYVSGAILFEETLYQSTTEGKKMVDVLVEQNIVPGIKVDKGLVPLVGSNNESWGQGLDGLSSRTAAYYQQGARFAKWAYCXVAFPNGPSAXLAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMFLSGGQSEVEATLNLNAMNQAPNPWHVSFSYAXRALQNTCLKTWGGRPENVNAAQTTLLARAKANSLAQLGKYTGEGESEEAKEGMFVKGYTY

SEQ ID NO: 9554 - protein, 469 aa, Pseudomonas fluorescens Pf-5
MSQIEDTTVPAQSTADAAQPQLKAARPLAANIKIKDGFPVMPGKIPLLGHVHKIGKDALGELRQAEAACGPMFWTYFGSQLPVLQIVDEAGLAILQNKYTDNSFLREQMPVITGEAMNAFDGPRHRNARKASTDAFTPKGLTRAKVGQFIMETIDQRLKHWSRENQLAIFPQTKDIALEVVFRILGIATHELELWRHQYEEFFLGMIPLKINLPGFPAWRCRKARGWLEQRVAQIVATTRANNDHDSLVGAMILGRDEQGNGLSEVELVHNILGLGFAGSETTAAVMAWSALMLSQHPDVWQQLCEQVAGLESLPVTHEELVRQVPLAEGIFRETMRLYPPAPFEMRKVHTEFELLGQRIPAGVMAGVSLLHVSRNPERYPDPDSWRPERWLGLDRALNQVETCQFGGGPHACLGRHVAALEITLFIAMLARELGPKGNVPRLVGKMPPPAYLPFLRPSNKAFLDFSGA

SEQ ID NO: 9555 - protein, 794 aa, Gibberella zeae PH-1
MTDRYVAVHEAANGPGDARPTADQIIKDENLEGKLKDHVIFLTGCSAGIGVDTAKALYLTGATLYLTARNLDKAKTALGDLVQDDRVHLLELDLESLDSVRSCAAKFLSESLKLNILICNAGVMCTPEGRTKEGFETQFATNHLAHFLLFNLLRPSLQKGVKPDRAARVVMLSSLGHRFGEPDFNNINMEGCYDPHKAYVKSKTANLWTANEIERRYGSEGIHAWSVHPGAVLTDLGRHLSEEQKNSLGGDPYLNSVWKFSSQGAATTVWAATAEALEGQGGRYLEDCQIIGKWDPSTSRYAPGYGDHAYDEGKAKAFHIFNSCISNATSPFIDFVFPSLAVTLVVYRVAKGVPIKNSKPCKLQASILVGVQKDTLLAKDIDCFTCPFLATSKRLPGVNPLDSIELFLRRRIGLADSPKAMRIVSCNHSYLCHFLEGCRQPWIGFLSPNFKNTAHFRQKVEAVASAQLTSVTFNYPIHIFHRFRLIFTKTLHKPTSTALPLNMESITTEPPQYDVLFKDQDFPGSLPTPNDTESGEPLPIDRTFCDKLVRIRNDFIMKYGPEVKPIEAHNMLYVAKNTSLVVPKVYAIYQGKETPQNFTYILMQHIQGKTLKELWPELDGTRKTSIAKTLRDSLQQLRRLQHPGYFGNIDGGPPLDDVFTGTQGGLKNVTSPFATEEELINSVIRIFSLETRSWSVNLVKYYQYVLPTVLHSNKAPVFTHNDLQRKNIMVQDDGTIVIIDWEYSSWYPVYWEYSTAMFANGGWRDDWGEYLRIILDEYLNEAVWICQMKTQMWS

SEQ ID NO: 9556 - protein, 394 aa, Synechocystis sp. PCC 6803
MTKIETRTEPMVLNMGPHHPSMHGVLRLIVTLDGEDVVDCEPVIGYLHRGMEKIAESRTNIMYVPYVSRWDYAAGMFNEAITVNAPEKLADIEVPKRAQYIRVIMLELNRIANHLLWLGPFMADVGAQTPFFYIFREREMIYDLWEAASGMRLINNNYFRVGGVAVDLPYGWNDKCEDFCDYFLPKVDEYEKLITNNPIFRRRVEGVGTVTREEAINWGLSGPMLRGSGVKWDLRKVDHYECYDELDWEVQYETAGDCFARYLVRIREMRESVKIIRQALKAMPGGPYENLEAKRLQEGKKSEWNDFQYQYIAKKVAPTFKIPAGEHYVRLESGKGELGIFIQGNDDVFPWRWKIRSADFNNLQILPHILKGVKVADIMAILGSIDIIMGSVDR

SEQ ID NO: 9557 - protein, 149 aa, Synechocystis sp. PCC 6803; identical to SEQ ID NO: 287

SEQ ID NO: 9558 - protein, 478 aa, Haemophilus influenzae
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAAPQSLKEKGYLSTGDLVLVTQGGQGATQTNVCRTLIVE

SEQ ID NO: 9559 - protein, 131 aa, Triticum aestivum
  misc_feature (79)..(79): Xaa can be any naturally occurring amino acid
  misc_feature (86)..(86): Xaa can be any naturally occurring amino acid
  unsure (1)..(131): unsure at all Xaa locations
MSGEDVRKVSRQDIQLVQNLIERCLQLYMNQKEVIDTLSLEAKIEPSFTELVWQKLEEENREFFKAYYLRLMLKNQITXFNNFLRXFQLMNKDYPQGSLLSSYQWPNSTTLNKTVLLQIWPFSIQMVIPTN

SEQ ID NO: 9560 - protein, 313 aa, Haloquadratum walsbyi
MASSIDSHMTESTADSESESFSLTDDEIINSILDILARTAPEIRNGLPGRRVKTNEENPSGESPMEADVFADELLRNRLGSLDGIGEYASEERSSADDTGSGLSVCIDPLDGSSNLKSNAAMGTIAAVYDAPLPARGSDLVAAAYVLYGATTTMIAAVEGNVADYVIYQDGSYEPIEQEVRVPSEPTVYGFGGRVPNWPRDFNSFVSDIESDTSMKLRYGGAMVGDVNQVLTYGGIFGYPALTNAPSGKLRVQFEGYPIGYIIECAGGASSDGSQSLLAVESNDIHDRTPVYVGTPSLVERLEGALAGKADSE

SEQ ID NO: 9561 - protein, 476 aa, Hordeum vulgare
MRTTTRRLPPAPAAAAVLLAALTCLLLRPAAVAAAGGHAADRIVRLPGQPEVDFDMYSGYITVDEAAGRSLFYLLQEAPEEAQPAPLVLWLNGGPGCSSVAYGASEELGAFRVMPRGAGLVLNEYRWNKVANVLFLDSPAGVGFSYTNTSSDIYTSGDNRTAHDSYAFLAAWFERFPHYKYREFYVAGESYAGHYVPELSQLVHRSGNPVINLKGFMVGNGLIDDYHDYVGTFEFWWNHGIVSDDTYRRLKDACLHDSFIHPSPACDAATDVATAEQGNIDMYSLYTPVCNISSSSSSSSLSRRRTRGRYPWLTGSYDPCTERYSTAYYNRRDVQTALHANVTGAMNYTWTNCSDTINTHWHDAPRSMLPIYRELIAAGLRIWVFSGDTDAVVPLTATRYSIGALGLATTTSWYPWYDDLQEVGGWSQVYKGLTLVSVRGAGHEVPLHRPRQALILFQQFLQGKPMPGRTTNVTVA

SEQ ID NO: 9562 - protein, 519 aa, Debaryomyces hansenii
MFDVDTVHNFFTSWYGILLAVLIGYHVFDYIRIQIVMKKLGCVSPPVELDGFFGFKLLYTSLKHKKEGTLVNFIKERFETVGKDTFSFRIAGTPVISTKNPENIKALLATQFSDFALGTRHAQFKPLLGDGIFTLDGSGWKHSRAMLRPQFAREQVAHVKSLEPHIQMLAKHVRRAKGGAFDVQSLFFRLTVDSATEFLFGESVESLQDESIGMAKDAVDFDGKAGFAEAFNTAQVYLSIRSLAQKAYFLVNNKEFRSSNEKVHKFADYYVQKALNSSPEELEKHSQDGYIFLYELVKQTRDPHVLRDQLLNILLAGRDTTAGLLSFTFYELARNPQVWLKLKEEIYEKFGKGDDARLEDITFESLKKCEYLKALLNEVLRLYPSVPQNFRVAQKDTSLPRGGGPNRDQPIFIAKGQTVTYTVYAMHRDEQFYGKDSEVFRPERWFEPETRKLGWAFLPFNGGPRICLGQQFALTEASYVIARLAQLFPNLASHDDEYPPRKASHLTMCHQSEVKISLA

SEQ ID NO: 9563 - protein, 519 aa, Debaryomyces hansenii
MSELLDSIQPYLTKWYVVISALLVSFFIAHKISVARFKATHNCAASPEYYKVNWFSLPLLYRLIQVKREGRLLDFAQKIYDDVKALTFVIKIVGVPVIITRDPENMKAVLATQFNDFALGTRHAHFKPLLGDGIFTLDGNGWKQSRSMLRPQFSREQVAHVQALEPHLQRLAKHIRLADGETINIQDLFFKLTVDTATEFLFGQSVYSLKDAAINDPPTEDFDGRSSFANSFNTAQTYLGTRAYLQMFYFIVNNSDFRKCCKQVHDFTRFYVQKGLDMTPEELEKKSENGYVFLYELVKQTRDPKVLQDQLLNILLAGRDTTAGLLSFTFFELARHPRVFNKLKEEIYEAFGKGDDARVSEITFESLKKCEYLKWVMNEMLRLYPSVPVNFRVATKRTTLPRGGGPDGNSPIYVGKGTTVAYSVYSTHRMEEYYGKDADEFKPERWAESRKLGWAYVPFNGGPRICLGQQFALTEASYIVTRLLQMFDKLELHDDRPYPPAKSVHLTMCHQDGVYVSLS

SEQ ID NO: 9564 - protein, 437 aa, Corynebacterium glutamicum ATCC 13032
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 9565 - protein, 361 aa, Triticum aestivum
  misc_feature (123)..(123): Xaa can be any naturally occurring amino acid
  misc_feature (180)..(180): Xaa can be any naturally occurring amino acid
  misc_feature (204)..(204): Xaa can be any naturally occurring amino acid
  misc_feature (237)..(237): Xaa can be any naturally occurring amino acid
  misc_feature (265)..(265): Xaa can be any naturally occurring amino acid
  unsure (1)..(361): unsure at all Xaa locations
AYLGDLSNKFVQKSRLAPVRNSRDIVDPRVRGERGEDAVVEVLSWKFSRKGATGFSWASTADEVTAGVTASGLTAIVTGASSGIGAETARVLAARGAHVVMAVRNLAAGDTVRQAVLAETPAXSVDLMELDVSSLASVRNFAADFAARGLPLNILVNNAGIMATPFTLSKDGIQMQFATXNHVGHFLLTHLVLDTMKKTSRESXVGGRIVIVASGGHRVTYKEGIRFAKINDEQGYXTLAAYGQSKLANILHAGELARRFKMTNXEEGVNITANSLHPGAIITNLPCHHSIIDVLHRTLGRLVLKNAKQGAATQCYVALHPDAKGVSGKYWSDSNLYEPSEKAKDAELGKKLWDYTLDLVA

SEQ ID NO: 9566 - protein, 208 aa, Prunus salicina
FCYVMSSGSYDYFQFVQQWPPTNCRVRVKRPCSNPRPLQYFTIHGLWPSNYSNPRMPSNCTGSQFKKQNLYPYMQSKLKISWPDVESGNDTKFWEGEWNKHGTCSERTLNLMQYFQRSHAMWKSHNITEILKNASIVPHPTQTWKYSDIESPIKRATKRTPVLRCKRDPVQANTQLLHEVVFCYEYDALKLIDCNRTDCWKNVDIKFQ

SEQ ID NO: 9567 - protein, 141 aa, Legionella pneumophila str. Paris
MAKELTLSIIKPDAVAKSVIGEIYTRFEKAGLDIVAAKMIQLSREQAESFYDIHRARPFFKDLVDFMISGPVMIQVLKGDNAVAKNREIMGATNPKEAAPGTIRADFADSIDANAVHGSDSLENAAREIAFFFEPHELCNR

SEQ ID NO: 9568 - protein, 203 aa, Prunus salicina
LCFIMSTGSHVYFQFVQQWPPTTCRLSSKPRYKHRPLQNFTIHGLWPSNYSNPTKPSNCNGSQFKILPPQLISKLKISWPDVESGNDTRFWEGEWNKHGTCSEQTLNQLQYFEQSYSMWKSYNITEILKNASIIPSATQTWKYSDIVSAIKTATKRTPLLRCKWDKNTQLLHEVVFCYGYNAIKQIDCNRTAGCKNNVGISFQ

SEQ ID NO: 9569 - protein, 392 aa, Streptococcus thermophilus LMG 18311
MVFSVKTYNNINQIGLKELGNHFQIDGDLAENPDAYIIRSQNLHDTVFPENLKAIARAGAGTNNIPVDKATEKGIVVFNTPGANANAVKEAVLASILLSARDYIAANTWVNKLSGDDVPKQIEAGKKQFAGSEIAGKTLGVIGLGAIGARIANDAYRLGMKVYGYDPYVSIEAAWNISHHVKRVSDLKEIFENCDYITVHVPLTPDTKGTFNADAFSLMQKGTTIINFARAELVENDALFDALETGVVKRYITDFGTEELLNKPNVTVFPHVGGSTGEAELNCAIMAAQTIRRFMETGEIVNSVNFPRVQQVLSAPYRITLINKNVPNIVASISTAVSDFNINIDNIINRSKGEYAYTLLDLDETDKSKIDELVAKFEASDNIVRVRLIKGK

SEQ ID NO: 9570 - protein, 470 aa, Solibacter usitatus Ellin6076
MPNTKIVATLGPATDAPGVLRQLLAAGVDVFRLNASHGAQDAHAARIDAVRAAAREAHVHAGILLDLQGPKIRLGRFENGGVTLVTDAIFTITTEQVMGTSERASTGYSRFAKDVKAGDRILLADGIIELIALESDGVSVQTRIVNGGPIGDHKGINLPGVQVSIPSLTEKDLADLHFGLNAGVDIVALSFVRTADDVRQLRDRLGGRPVSIVAKIEKPEGYENIEPILDVTDGVMVARGDLGVEISLERVPRIQKSIIRRARRKGRFVITATQMLESMIENPRPTRAEVSDVANAIYDGTDAVMLSAETSVGKYPVEAVRYMAKIAAESEDSIRKKGYIDPPHQPQPSNAEILADAAHHAARDSGAAAIVVFSSRGSSARLVSRYRPPVGVFAITPHDTTARQLSVSYGVTPLLAPDVSSTDEMLSQMDRVLIEGGYLQKGQLVVFVAGQPVGRPGTTNLMKLHRVGLG

SEQ ID NO: 9571 - protein, 338 aa, Xanthophyllomyces dendrorhous
MAVKVGINGFGRIGRIVLRNAIIHGDIDVVAINDPFIDLEYMVYMFKYDSTHGVFKGSVEIKDGKLVIEGKPIVVYGERDPANIQWGAAGADYVVESTGVFTTQEKAELHLKGGAKKVVISAPSADAPMFVCGVNLDKYDPKYTVVSNASCTTNCLAPLGKVIHDNYTIVEGLMTTVHATTATQKTVDGPSNKDWRGGRGAGANIIPSSTGAAKAVGKVIPSLNGKLTGMAFRVPTPDVSVVDLVVRIEKGASYEEIKETIKKASQTPELKGILNYTDDQVVSTDFTGDSASSTFDAQGGISLNGNFVKLVSWYDNEWGYSARVCDLVSYIAAQDAKA

SEQ ID NO: 9572 - protein, 440 aa, Alkaliphilus metalliredigenes QYMF
MDKRSIMKYERSQKLFEASQEVIPGGVNSPVRAFSSVGMNPPFIKRGKGAYIYDEDGNKYIDYVGSWGPLILGHCHPEVVENLKAVLETGTSFGAPTEIELKIAELITGAIPSVEMIRMVNSGTEATMTALRLARGYTGRNKIVKFNGNYHGHSDGLLIKAGSGALTHGVPNSPGVTPDVAKNTITAKYNDIEGIMEIFKQQGEEIAAVIIEPIAGNMGVVPMTNKFAHALRKITEDYGALLIFDEVMTGFRVSFGGAQSLYQIKPDLTCFGKIIGGGLPVGAFGGKREIMEHLSPVGPVYQAGTLSGNPLAMTAGYTTLSILHNNSGIYEELEKKAQKLEKGFKKIVKELQIDASFNRVGSMLCMFFTKEKVSDLETASTSNTEIYSQYFRAMLSRGVYLAPTQFETMFISDAHGDVEINRTIEAAYEGLKEIRNNPSI

SEQ ID NO: 9573 - protein, 113 aa, Synechococcus sp. WH 8102
MRVERPWGWYEDLLAAPGYKVKRLLIRRGRQLSLQRHRHRSESWTVVAGDGALLCGECWLEANAGVMLTIPCGALHRARSDQSDLVILEVQHGNDLREDDIERLQDDYGRVIS

SEQ ID NO: 9574 - protein, 515 aa, Thermus thermophilus HB8
MEALWVTAAFALGLLASRLALPPLVGYLVAGFLLAGTGIRGTAFLHQIAEIGVLLLLFSVGLKLRLKDLLDPRVLLSGGLHLGLFATLAFLYTKNLPLAIALGFSSTVLVAKVLEDKKELTSYHGRIALGILVFQDLVAVGLLTLYGGEGVSPWAALVLLFPLLRQGVAWLLEKSGHEELLVLFGLGMALGSGELFQHVGLSPELGALFTGALLSGHAKSAELTKGLWSLKEAFLVAFFLDIGLREGLQGLDLGLAAGLTLLSLLKAPLFFLVLLLVGYRARTAFVAGMYLGNHSEFALIVGVALERAGLFTDLSALALAVALSMALSAPLARYSHTLYKRLEPFLLRLERPGSHPDAEPERLEGTVLVVGMGRTGDAVYRVLEAQGESPVGLDADPAKVERHREKGRRVLYGDAEDPELWERLDLRGLKAVVLALPDLEAKALAARWLKERGFQGLVAATSYFPEEDPVLAQEGAHLIFHPFQEAGERLGERVLESLAIMGKVNYGRSQQMGSD

SEQ ID NO: 9575 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 9576 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 9577 - protein, 184 aa, Glycine max
  misc_feature (93)..(93): Xaa can be any naturally occurring amino acid
  misc_feature (171)..(171): Xaa can be any naturally occurring amino acid
  unsure (1)..(184): unsure at all Xaa locations
CVYHISSIIRPARLRILVIELAALGKRIKYLMRAPDSLHHEERSLSTAKKFLFNVESLEKESDQLEEDVMLLREMYSHWEKAATTWPLTDVGXLAKFSLCILRIIADEAWVAHIMIYLLMEPPLSPFLNEVIITLDDMWSLLGTAACALICYYPLLAVIVGAMMLVLKLLXITIHSMKWGATLM

SEQ ID NO: 9578 - protein, 344 aa, Arabidopsis thaliana
MDHAADAHRTDLMTITRFVLNEQSKYPESRGDFTILLSHIVLGCKFVCSAVNKAGLAKLIGLAGETNIQASFGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 9579 - protein, 464 aa, Ostreococcus tauri
YATFLAGEKSKGQSCAFGGANVDGGGDGVDSTQTPSIGARKIGPDPSAGTNVELESLNEWLQAQDASGSKDGFLTFLHGIVCRESGQHGHAKALLAEACRKYPLNWSAWQALIPLLTSEGEEQALDLPREHWVYRWFIGVFQLEMQKNKESLETFVAMGREFPQSKLLLGHMAEAHYNLREFDEAQEIYKDIRDIDPYRIDGMDNYSNVLYVKDSFAELSHLAHHMVGTDKYTPETCCVIGNYYSLKSMHAKAVVYFKRALKLNPRYLSAWTLMGHEYVEMKNPAAAIDAYRHAVDINPRDYRAWYGLGQTYEILQMPYYALYYYQQAVKLRPSDPRMWCAMGQCYESDQLRMFTSAIRCYQRAVANDEREGIALSKLATLHREKNEKAAAHYYLLNLKRLDEESSGSVDSNEKIDALEFLAQFYKKEGRYDEAEQACVRLLDAPGAAKHAAKALLREIHSQRF

SEQ ID NO: 9580 - protein, 540 aa, Uromyces viciae-fabae
MDGNIREADAEKVSTSVLESALPAADAGNKPAPHQLQRQLQNRHVAMISIGGAIGTGLFIGTGTALSNGGPFSLVVGYCLMALMVWALMCSLGEMIAHLPIAGGHLALADRFFSPSLSFTLGWSYWYLWSIVLPTELSASALFISFWTVKVHLGIWIFIFLAIVALINLGGVRFYGEMEFWFSSLKIITIVGVLILGFVLDLGAVTGDTIGFRYWKNPGLFVQYEGVPGAAGRFLGFFSVLVTAAFSFIGVEMPAIAAAEAKNPRRNLPRAIKRVAARVVGFYILSTIVVSMLVPSNEPRLRLSSSTGAKSPFVIAIHNAGIKGMSSVINGCLLSFTLSAASSDLYISSRSLYGLSITGNAPRFLSKTTSNGLPIYCYLIGVMMGTLAFMATGDGQAGKLFGYLANLTSVTGLLSWSGIFITYIRFRGGMKLQNFDRQQLPYRSPVGVTGAWFGLVSCNIIIIFNGFSVFLKGKWNSATFFTCYFPVAAFVFLFCAHAWWTKAGLVQKKHMDFATGSDCPDEDEESPPKSWVQKVWRAIM

SEQ ID NO: 9581 - protein, 70 aa, Glycine max
ATYSYYFWDYCHMTPPGSYLTYKDTYISPTGGSGVSTVAYEQVKMRKIVSHGVLFSTFHVDVIKDLPEDL

SEQ ID NO: 9582 - protein, 556 aa, Oryza sativa
MAWFVAAWSCLLVVVMVSSMRLSRSASSSCGSSCGHGGWGPRSYPVIGCLVAFYRNRRRLLDWYTEMLAASPSQTIVVDRLGARRTVVTANPANVEHILRARFANYPKGKPFTDVLGDLLGMGIFNVDGELWHAQRKLVSHEFSARALRDLEVTVLEAEARDRLVPALAAASRGGGVVDMQDVLRRFAFDVICRVSLGVDPGCLDPALPAPRLAAAFDTAAGIIARRGAAPVAAVWKVKRALDAGSERRLREEVGVIHEAVMGLIRSRRKERALLLVNGNGVGGGGGARSDLLSRMIECGYPDEAIRDMVISFIMAGRDTTSSALTWFFWLLMRHRGVEAQVLDEIAATRRARGAGEEGGDDGEGEGLDLDDYRRMRVLHAALCETMRLYPPVAWDSKHAAADDVLPDGTAVGRGDRVTYFQYGMGRMEAIWGADAADFSLDRWLSLPRGGGDGAAAASPAAAAFAGVSPFKYPVFQGGPRTCLGKEMAFVQMKFVASAVLRRFELRPVDEGRTPAFVPLMTAHMAGGLNVTVRRRTPAPATSTAANGTGGELTSS

SEQ ID NO: 9583 - protein, 489 aa, Triticum aestivum
  misc_feature (213)..(213): Xaa can be any naturally occurring amino acid
  misc_feature (229)..(229): Xaa can be any naturally occurring amino acid
  unsure (1)..(489): unsure at all Xaa locations
MTEVALVRGPTNLASPASRGSSSSSSSSTSLRYLADSDVLQRGTTGSAQSPAGSAERQAGGSEEEEEEEERWSFLALLLELLRKSLLRCRAEDGGQGQGGMEIGLPTDVQHVAHVTFDRFHGFLGLPVEFEPEVPRRAPSASASVFGVSTQSMQCSYDTRGNSVPTILLMMQRRLYEQGGLRAEGIFRINAENSQEEFVRDHLNSGTVPDGIXMVPGLAGPNQRLGLRXLPRGGLDSIPPEQVMQCQSEEDCARVAKCLPPTEAALLDWAVNLMADVVQEEQINKMSDRNVAMVFAPNMTQMADPLTALMYAVQVMNFLKMLIQKTLEDREESNLEDASLPQKDPSDENGHQNPSLPVNPQPEETSGRPSFVSEEPIVYSPTHSAEDKPPVEGDSIASVVHTSDVRSSVEGSASCSQPALVASSAIADASCATAANLLPSRGSRGLNSRRTRKGKRQCGTPAAPPAEKSRGASIVSRINSKVERIEAWR

SEQ ID NO: 9584 - protein, 372 aa, Arabidopsis thaliana
MGKREKKPNRRRHKGEYSNDAEDFYDQHPPAVASVDEEDEENSDEEEEENDGNESSDLPSKFLLYQQSVQSPKGDISYLQKFFLMYVGGRQPFHFQEDFCGTALLSAEWLKTDTRRTAIGLDFDLEALEWCMDNNISKLGSDVYSRMSLFHGNVLTPLEAKQVKSKSHELIQNISLDDGDDNEDLADPSVVESLEKDGPDSLPKRDIVCAFNFSCCCLHKRSELVSYFKNARDALSKKGGIFVMDLYGGASAEGQLKLQRKFPNFTYTWEQAEFDILSRKTRISLHYHLQKQNRKIRHAFSYSWRLWSLPEIKDCMEEAGFSSVHFWLREMPDASEMRRTDGFGAGRDIKYEQVKSFQQCDSWNAYIVAVSL

SEQ ID NO: 9585 - protein, 337 aa, Crocosphaera watsonii WH 8501
MIRVAINGFGRIGRNFLRCWLGRENTGLEVVGINDTSDPRTNAHLLRYDSMLGILDADIEADENSITVNGKTIKCVSDRNPLNLPWTEWNVDLVIESTGVFVTEEGASKHIVAGAKKVLITAPGKGGNVGTYVVGVNAQDYEHDKHNVISNASCTTNCLAPVVKVLNDNFGIIKGTMTTTHSYTGDQRILDASHRDLRRARAAAVNIVPTSTGAAKAVALVIPEMKGKLNGIAMRVPTPNVSVVDLVAQVEKSTIAEQVNDIFKTASEGSMKGVLGYNDLPLVSCDYRGTDVSSIVDASLTMVMGGDMVKIVAWYDNEWGYSQRVVDLAEVVANKWK

SEQ ID NO: 9586 - protein, 147 aa, Glycine max
  misc_feature (18)..(18): Xaa can be any naturally occurring amino acid
  unsure (1)..(147): unsure at all Xaa locations
ANVVHVAANVVHVAAIAXVKDMLDNYKKVTAQDIVCSQKSGGVTLKEEDVAVCNVKIDLTRGKHNPLESLHFFKDYESDEKFTIPDDRVSHLLPTSYQDMIVKVYSKKPELVEAISEAFENFQLKTYGIKAQAHSTPQKKRRYNPFI

SEQ ID NO: 9587 - protein, 142 aa, Cicer arietinum
FDEILQEADGIILSRGNLGIDLPPEKVFLFQKSALYKCNMAGKPAVLTRVVDSMTDNLRPTRAEATDVANAVLDGSDAILLGAETLRGLYPVETISTVGRICSEAEKVFNQDLYFKKTVKYVGEPMTHLESIASSAVRAAIK

SEQ ID NO: 9588 - protein, 341 aa, Bradyrhizobium japonicum USDA 110
MDLTELNRIATAMVAPGKGILAADESSGTIKKRFDAIGVESTESNRRDYREMLFRSREAMSQYISGVILYDETIWQDAKDGTPLVKLIESSGAIPGIKVDEGTQGLPMCPGELVTVGLDKLAERLKKYYERGARFAKWRAVIDIGSGIPSMTAISVNAHALARYAALCQAAQIVPIVEPEVLMDGDHDIDRCYEVTQRVLNKTFQELRVQRVALEGMVLKPNMAISGKKCAKQAPVEEVAEKTIRLLKACVPAAVPGIAFLSGGQSDEEATAHLNAMHKLGPLPWGLTFSYGRALQAAPQKAWSGKAENVAAGQRAFSHRARMNGLASKGEWQSSLEKKAA

SEQ ID NO: 9589 - protein, 228 aa, Staphylococcus epidermidis ATCC 12228
MPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 9590 - protein, 522 aa, Erythrobacter sp. NAP1
MNAPNKSGWKPEMTVAEDGLHNGPETTTGNRALMLEEPLIFEIGHTETTGVDLPEIDPEAPSRLGSLTRSEPIGLVGLTEPETVRHYTRLSRQNYGIDLGFFPLGSCTMKHNPRLNEKMARLPGYADIHPLAPQNSVQGALEVIYELGDWLKTLTGMPAVAMSPKAGAHGELCGILAIRAAHEARGDAREVVLVPESAHGTNPATAAFAGYRVEDIPATEEGRVDVAKLKERLGPDVAAVMITNPNTCGLFEKDFREIADAVHEAGGYVYCDGANFNAIVGRVRPGDLGVDAMHINLHKTFSTPHGGGGPGSGPVVFSEALEPFAPLPFVRKHEDGTYELVEEEAREESRGQTFGRMTAFHGQMGMFTRALTYMLSHGADGLKQVAEDAVLNANYILRNLEGSLYAPFADSGPCMHEALFGDKGFENGLTTLDLAKGLIDEGYHPMTVYFPLVVHGAMLIEPTETESKAAIDQFITAIRSVAERAKAGDETLKQAPYYAPRRRLDETAAARKPKLSWQEPEG

SEQ ID NO: 9591 - protein, 458 aa, Erythrobacter sp. NAP1
MRYLPLTDTDRTEMLAKIGADSIDDLFVDVPEVARLDGPIRDLPMHASEMAVERHMKARAAKNLAAGDAPFFLGAGAYRHHIPASVDHIIQRGEFLTAYTPYQPEIAQGTLQMLFEFQSQVARLYGCAVANASLYDGSTACWEAVAMATRVTRKKRAVLSGALHPHYSEVVRTMAHFTGDVIADSAPAIQPEPDLDGLTARIDEDTACVVVQYPDILGRISDLTPVAEAAHAVGALLVVVNTEPVALGAIKAPGEMGADIVVGEGQSIGVGLQFGGPYLGLFAVRDPNHVRQMPGRLCGETTDAEGKRGFVLTLSTREQHIRREKATSNICTNSGLCALAFSVHMTLLGEKGLRELAAENHRLACLAADRLEKVPGVKLLNNAFFNEFTLMLDGKPAREIVRDLADRGVLGGVSLGRLYPGVEALEHALLVAVTETTTEEDIETLARELEASVKEVAQ

SEQ ID NO: 9592 - protein, 487 aa, Nocardia farcinica IFM 10152
MTDREGALLATAPHQLFIGGEWVDATGGATFAVHDPATGEIVREVADATAEDAVRALDAAVAAQESWAATAPRTRGEILRRAWELVQERAEDLALLMTLEMGKPLAEARGEVTYGGEFLRWFSEEAVRIHGRYGLNPEGTGQMIVSQRPVGPCYFITPWNFPFAMATRKIAPALAAGCTVVVKPPQLTPLTTLFFTGLLAEAGLPAGVVNVVTSTSSRRVSAPIIADSRLRKLSFTGSTEVGRQLIAQAADNVLRVSMELGGNAPFVVFEDADLDKAVEGALAAKFRNIGQACTAANRFIVHEQVAEEFAARVTERVAAMKIGRGTEDGVTIGPLIDDDAVAKAHELVTDATARGAVVRTGGERIDGPGSFYRPTVLTGVTEGSAILREEIFGPVLAIATFTTEDEAVRLANNTEYGLVSYVYTRDLARGHRMIDKLETGMMGLNAGVVSNAAAPFGGVKQSGVGREGGFEGIHEFLSTKYTLIPTS

SEQ ID NO: 9593 - protein, 279 aa, Bacillus cereus ATCC 14579
MKNLQSKTVLSNGVEMPWFGLGVFKVEEGPELVEAIKSAIKAGYRSIDTAAIYGNEAAVGEGIRAGIETTGISREELFITSKVWNADQGYEETIAAYEESLKKLKLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 9594 - protein, 476 aa, Nostoc sp. PCC 7120
MRRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 9595 - protein, 343 aa, Nostoc sp. PCC 7120
MAKLKVGINGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMVQKEQLAAV

SEQ ID NO: 9596 - protein, 157 aa, Zea mays
MAKLYVQAFPPADLNKNTEWFMYPGVWTTYILIVFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAEN

SEQ ID NO: 9597 - protein, 528 aa, Prochlorococcus marinus subsp. marinus str. CCMP1375
MTKVLVSDPIDHAGIDILSQVSQVDQRLGLSSNQLKEIIGDYEALMIRSGTQVNSEIIEAGVNLKIIGRAGVGVDNVDVPAATKRGVIVVNSPGGNTIAAAEHALALLLSLSRNIPQAHLSTISGKWDRKKFVGNELYKKILGVVGLGKIGSHVAKVANAMGMDVMAFDPFVSAERALQMQVRLSSIDDLFKEADFITLHLPRTSETENLVDAKLLSSMKQNARLVNCARGGIIDETALAEALNSNVIGGAALDVYSQEPLKNDSPLLNVKNNLILTPHLGASTAEAQQNVAIDVAEQIRDVLLGLPARSAVNIPGLSAEIMDSLKPHLQLAESLGLLASQVSGGQIQKIEVKLQGEFSQHPSQPLVIATLKGLLSSALGNRINYVNASLEAQGRGISVEEVKDEASPDFPGGSLQLRTFADKGTNSVTGTVLADGELRISSIDEFPINVSPSRYMLFTRHRDMPGIIGKLGSLLGTHNVNIAAMQVGRRIVRGEAVMVLSIDDPIPSELLTSILAVEGINQAHAVTF

SEQ ID NO: 9598 - protein, 136 aa, Ustilago maydis 521
MSSGGKSGGKAGDASSKAQSRSAKAGLQFPVGRIHRLLRKGNYAQRVGAGAPVYLAAVLEYLAAEILELAGNAARDNKKSRIIPRHLQLAIRNDEELNKLLGGVTISQGGVLPFIQSELLPAKSGKPKKAGGSQDI

SEQ ID NO: 9599 - protein, 428 aa, Staphylococcus aureus
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFETANKSDLKLFAEMYREMAKEGVFLPPSQFEGTFLSTAHTKEDIEKTIQAFDTALSRIVK

SEQ ID NO: 9600 - protein, 547 aa, Shewanella oneidensis MR-1
MEPAILIITLICGMLVSRIGLPPLIGYLVAGFVLFVMGIEKESMPLLQELANLGVTLLLFAIGLKLDIRSLFKAEVWAGSSVHLILSILVFVPILKILGLLGLSQLTSLGIEQLTLLAFALSFSSTVFAVKVLEDKGDMQSLYGRVAIGILIMQDIFAVLFLTISKGDVPSVWAFALLLLPLAKPLIYKAFDRVGHGELLVLFGLVMALVVGAWLFESLGLKPDLGALVIGILLAGHKKASELAKSLFYFKELFLVAFFLTIGLNGLPTVSDIVLAALLVLLVPLKILLFVYILTRFKLRSRTSMLGSFNLGNFSEFGLIVAAVATSKGWLPSHWLVIIAVALSFSFLLAAPLNATVGSIYQRFQLRLVRLEKRPLHPEDRPIAIGNPRFLILGMGRIGSGAYDELRARFDGEILGIEHKQDLVDLHRAKGRNVVQGDASDTDFWEKLDKAPNLELVLLAMPHHAGNLFAVEQLNKLNYQGKISAIVQYGEDAASLRNSGVHSVYNLYEAAGAGFVDHVVHELLPDSETKAGTEAQEGTQKQTSSLV

SEQ ID NO: 9601 - protein, 396 aa, Bacillus thuringiensis serovar konkukian str. 97-27
MKQFELSRAAESLQPSGIRKFFDLAANMKGVISLGVGEPDFVTPWNVRQACIRSIEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVYFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKHNTFCP

SEQ ID NO: 9602 - protein, 135 aa, Thermobifida fusca YX
MERTLVLIKPDGVRRNIIGEVISRIERKGLKIVAMELRTLDEETAKAHYEEHVEKPFFSSLVEFITGGPLVAMVVEGNRAIEAFRSLAGATDPVLAAPGTIRGDYGLDVQANIVHGSDSTYSAEREIKLFFPDLA

SEQ ID NO: 9603 - protein, 138 aa, Glycine max
  misc_feature (122)..(122): Xaa can be any naturally occurring amino acid
  unsure (1)..(138): unsure at all Xaa locations
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 9604 - protein, 381 aa, Yarrowia lipolytica CLIB122
MSSNIKLAQKDYKGDKEFAAALHGKEGHKKHGLGAVMSKNKDAQAAAVEGFFRNWGDKDRSKIEDADEQGRIEDYAGLTKHYYNLVTDFYEYGWGSSFHFSRYYKGEAFRQATARHEHYLAYKMGIQPGMKVLDVGCGVGGPAREIARFTGANIVGLNNNDYQVERGTHYSEVQGFGDQVTYVKGDFMQMDFPDNSFDAVYAIEATVHAPVLEGVYSEIFRVLKPGGVFGVYEWVMTDEYDESNPEHRDICYGIEKGDGIPKMYKREVAVKALENVGFDIEYQEDLAADDAEVPWYYPLAGEWKYVQSLNDIVTIGRTSRLGRMVTMNVIGALEKIGLAPQGSRQVTEALEDAAVNLVAGGKKKLFTPMMLFVSRKPEDKN

SEQ ID NO: 9605 - protein, 389 aa, Streptococcus pneumoniae TIGR4
MDLTKRFNKQLDKIQVSLIRQFDQAISEIPGVLRLTLGEPDFTTPDHVKEAGKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 9606 - protein, 310 aa, Yarrowia lipolytica CLIB122
MSLTTSTITLNDGRAMPALGLGTFQNDACEQVVYDAIKAGYRHIDTAFIYRTEEAVGNAVERAISDGIVARSDLWITTKVWPTYHDRVPQSVDKSLALLKTDYIDLLLVHWPVALNGDPNDDYSFLPKREDGEIDITEGDDWISFYKQLETEQKTGRVKSIGVSNVSSVYLERLLEHASVIPAVNQFENHPLLPQKDQIEANLKQGIQITAYSPLGSGQGVINLHENPTIVELAEKYNTSTASILINWHICQGRSVIPKTANSLRVVSNAVKVEISAQDLAKIDAISAEHGTHRTVPFHLFKKDCLGYPV

SEQ ID NO: 9607 - protein, 458 aa, Staphylococcus epidermidis ATCC 12228
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 9608 - protein, 587 aa, Pseudomonas syringae pv. phaseolicola 1448A
MHAINFIQDLAVIMLVAGVVTILFHRLRQPVVLGYIVAGFIIGPHTPPVSLIHDEDTIKILAELGVIFLMFCLGLEFSLRKLFKVGATAFIAAFLEIALMIWIGYEIGQFFGWKTMDSLFLGAILAISSTTIIVKALNDLKMKNQHFAQLIFGVLIVEDILGIGIIALLSGIAVSGSVSSGEVFSTVGKLSLFMIVALVIGILLVPRLLSYVARFESNEMLLITVLGLCFGFCLLVVKLEYSMVLGAFLIGAIMAESRELLKIERLIEPVRDMFSAIFFVAIGLMIDPKILLEYAWPIAVITVAVVLGKMLSCGLGAFIAGNDGRTSLRVGMGLSQIGEFSFIIAALGMTLQVTSDFLYPVAVAVSAITTLLTPYLIRGADPLSLKLASIMPRRVARVFGMYGEWLRSIQPQGQSAVLAGMIRRILLQVGVNLALVMAIFFSGGYFAERLGGYMDEWVADVSHQKAWICGAALLLSLPFLIAAYRKLKALSMLLAEMGVKPEMAGRHTVRVRKVVAEVIPLLSLVVIFVMLAALSASILPANELLLVIALIAALVAALLWRWLIRVHTRMQIALLETLGNNQESSGH

SEQ ID NO: 9609 - protein, 438 aa, Thermus thermophilus HB27
MDYTPHTEEEIREMLRRVGAASLEDLFAHLPKEILSPPIDLPEPLPEWKVLEELRRLAAQNLPAHKAFLGGGVRSHHVPPVVQALAARGEFLTAYTPYQPEVSQGVLQATFEYQTMIAELAGLEIANASMYDGATALAEGVLLALRETGRMGVLVSQGVHPEYRAVLRAYLEAVGAKLLTLPLEGGRTPLPEVGEEVGAVVVQNPNFLGALEDLGPFAEAAHGAGALFVAVADPLSLGVLKPPGAYGADIAVGDGQSLGLPMGFGGPHFGFLATKKAFVRQLPGRLVSETVDVEGRRGFILTLQAREQYIRRAKAKSNITTNAQLTALMGAMYLAALGPEGLREVALKSVEMAHKLHALLLEVPGVRPFTPKPFFNEFALALPKDPEAVRRALAERGFHGATPVPREYGENLALFAATELHEEEDLLALREALKEVLA

SEQ ID NO: 9610 - protein, 473 aa, Thermus thermophilus HB27
MSFPLIFERSRKGRRGLKLVKAVPKAEDLIPKEHLREVPPRLPEVDELTLVRHYTGLSRRQVGVDTTFYPLGSCTMKYNPKLHEEAARLFADLHPYQDPRTAQGALRLMWELGEYLKALTGMDAITLEPAAGAHGELTGILIIRAYHEDRGEGRTRRVVLVPDSAHGSNPATASMAGYQVREIPSGPEGEVDLEALKRELGPHVAALMLTNPNTLGLFERRILEISRLCKEAGVQLYYDGANLNAIMGWARPGDMGFDVVHLNLHKTFTVPHGGGGPGSGPVGVKAHLAPYLPVPLVERGEEGFYLDFDRPKSIGRVRSFYGNFLALVRAWAYIRTLGLEGLKKAAALAVLNARYLKELLKEKGYRVPYDGPSMHEFVAQPPQGFRALDLAKGLLELGFHPPTVYFPLIVKEALMVEPTETEAKETLEAFAEAMGALLKKPKEWLENAPYSTPVRRLDELRANRSPKLTYFDE

SEQ ID NO: 9611 - protein, 248 aa, Debaryomyces hansenii CBS767
MVKLILVRHGQSTWNEKNLFTGWVDCRLSDIGEKEAARAGELLKEANLKGDVLYTSKLSRAIQTANIALNTADQLYIPVKRSWRLNERHYGALQGKDKAATLEEYGQEKFQTWRRSFDVPPPVIADDSEFSQAGDERYRDVDPSVLPKTESLKLVIDRLLPYWQDEISKDLLEGKTVIVAAHGNSLRALVKHLDNISDDDIAGLNIPTGIPLVYELDEKLQPTKPAYYLDPEAAAAGAAAVAAQGSKK

SEQ ID NO: 9612 - protein, 333 aa, Ascophyllum nodosum
MVNVAINGFGRIGRLVLRAAKHNKHINVVAVNDPFVPPDYMNYMFKYDTVHGVYDGTVENDDSSIIVDGKKIKVFGEMDAANVKFGDVGADYVVESTGLFTTTESAAVHLKGGAKKVVISAPSQDAPMFVMGVNQDKYTPDMDVVSNASCTTNCLAPIAKVINDSFGLKEGLMTTVHAVTATQKTVDGPSKKDWRGGRAAGFNIIPSSTGAAKAVGKVIPELNGKLTGMSFRIPTANVSVVDLTCRLEKPASYEEIKAAMKAASEGPMHGILGYTEDSVVSSDFIGDSRSSILDANAGIALSDTFVKLVSWYDNEWGYSCRVLDLITHMDKSS

SEQ ID NO: 9613 - protein, 231 aa, Zea mays
MQWPGSFCDTRQGCCFPDGAGKPEAAFGIHGLWPNYAKCRGRHHREGGGLARAVLGADDAFLAAVGRRGKCWPEYCGGGGDGDGGHQLSPWDVRDLVASLGRSWPTLSCKNRRSFEFWSYEWKKHGTCSNLDPHDYFARALQLRERHDLAAVLADAGIVPSDTDTYPVDRVRDAIAQGTGFVANLECNRDADGEAQLFQVYQCVDREAKDLIDCPLPMPTKCTDRVKLPVF

SEQ ID NO: 9614 - protein, 461 aa, Solibacter usitatus Ellin6076
MQKSPRTELKRDLGPWAAASIVVGTVIGSGIFLVPKTMIQKVGTVEAVFAVWVVGGLLSLAGALSYAELAAALPEAGGEYAFLREAYGPMWGFLYSWTQMWVAKSGSIATLATGFFLYLTTFFEPLKGVFYTIPLPIGPNGGPLEIQYGQIFAIFLILALGWLNYFGVRIGGNVQVAVTVIKVGLIAAIIFAGLVFGHAHETAAGPVAPITFSGFIAALVAALWAYDGWNNVSMVSSEIKDPQKNLPRALIGGTLCVIAIYMAANAAYFHVMSPAEVAGSTRVAAEMMRKIFSAPGAAAVSIAAMISIFAALNGSILSGARVPYAAARDGYFFHAIGRVHPKYHTPGVSIIVLNLWACLLVLSGKYDDLFNLVIFASWILYGMTAAAVVVLRIKQPELQRPYRTMGYPVVPVLFIIGAVILLVSTAWERPRESMMGIALILLGLPFYYYWKKRIPATIREV

SEQ ID NO: 9615 - protein, 234 aa, Wigglesworthia glossinidia endosymbiont of Glossina brevipalpis
MSIIKLVLMRHGSSIWNDQDRFTGWTDIDLSEKGKNEVKYAGKMLKSFGYSFNFAYTSLLKRAIHSLWVILKEINQSWIPVEKSWRLNERHYGALQGFSKYEIEKKYGKNQLNEWRRGFSISPPKINEKDNYFILNDKRYLNLKTKKLLPFSESLKSTIDRIMPYWDGNIFPRLQNKEKIIIVAHGNSIRAIIKILCNLNEKEIIKINIPTGIPLIYEFDYNMVFKKKYFLFDR

SEQ ID NO: 9616 - protein, 218 aa, Arabidopsis thaliana
MSSINITNVTVLDNPAPFVNPFQFEISYECLTSLKDDLEWKLIYVGSAEDETYDQVLESVLVGPVNVGNYRFVLQADSPDPLKIREEDIIGVTVLLLTCSYMDQEFIRVGYYVNNDYDDEQLREEPPTKVLIDKVQRNILTDKPRVTKFPINFHPENEQTLGDGPAPTEPFADSVVNGEAPVFLEQPQKLQEIEQFDDSDVNGEAIALLDQPQNLQET

SEQ ID NO: 9617 - protein, 74 aa, Brassica napus
  misc_feature (2)..(2): Xaa can be any naturally occurring amino acid
  misc_feature (5)..(5): Xaa can be any naturally occurring amino acid
  misc_feature (16)..(16): Xaa can be any naturally occurring amino acid
  misc_feature (29)..(29): Xaa can be any naturally occurring amino acid
  misc_feature (64)..(64): Xaa can be any naturally occurring amino acid
  misc_feature (71)..(71): Xaa can be any naturally occurring amino acid
  unsure (1)..(74): unsure at all Xaa locations
MXSGXRMPTWRERENXKRRERRRRAIAAXIFTGLRMYGNYELPKHCDNNEVLKALCNEAGWIVXQDGTTYXKGS

SEQ ID NO: 9618 - protein, 388 aa, Rhodococcus sp. RHA1
MRPESQRSNIQTFHVMDVWKAATERQRTHGDVLTLAAGQPSTPAPQPVLRATREVLDGHLLGYTETFGILPLREAIAGYHSAKSGIDVDAEDVVVTTGSSGAFTLLFLAAFDVGDTVVVARPGYPAYRNTLAALGCTVIEIDCGADTRFQPTVAMLEALPEPPAGLIVASPANPTGTVIDPDELAALARWCDDHGTLLISDEIYHGIGYGEQAMTSSWETSRESVVVGSVSKYFSMTGWRLGWMLVPEGLRRPLQRLASNMTVCPPAISQYAAIAAFTEESRVELDGHVQRYAVNRELLLTGLPELGITDLAPADGAFYVYADIGHLLGGSHGATSTEWCSRLLQDTGLALAPGIDFDTVHGDRTVRLSFAGSTAEVRESLVRLGRWL

SEQ ID NO: 9619 - protein, 393 aa, Cytophaga hutchinsonii ATCC 33406
MDNDHLTTLNLGPTHPATHGVFQNILKMDGERIVDAVPTVGYIHRAFEKIAERRAFYQITTLTDRMNYCSAPLNNMGWHMTVEKLAGIELPKRVEYMRVVIMELSRIADHLICNSILGVDAGAFTGFLYIMQSREQIYEIFEEICGARLTTNMGRIGGFERDFNDIAMRKIDKFLADYPAVLTEFENLFNRNRIFMDRTIGTGGITAERALNYGFTGPNLRAAGVDYDVRVTSPYSSYQDFDFTIPIGINGDTYDRFMVRNKEMWESLSIIRQAMEKIKALPKGVFHAEVPDFYLPPKEDVYSQMEALIYHFKIVMGETEIPKGEVYHSIEGANGELGYYLVSDGGRTPYRLHFRRPCFIYYQAYPEMIKGQLISDAVVTMSSLNLIAGEMDA

SEQ ID NO: 9620 - protein, 831 aa, Candidatus Kuenenia stuttgartiensis
MVQNNTLKKLIDTISATDIKSIQKSFANHLTCSLSKDTYSATKLDIYKSIAYTVRDRLVERWIATQRSYFDNDVKRVYYLSLEFLMGRALGNNLINLDFLDECHKALHELGYELEEICEKEWDAGLGNGGLGRLAACFLDSMATLELPTYGYGMRYEYGIFFQSILNGYQVELPDNWLRYGNPWEFERPEHLYPVMFYGHVREYTDEKGISRSEWIDTQTIMAMAYDTPIPGYRTNTVNNLRLWSARASREFDLDSFNEGNYFKAVEEKQRSETISKILYPVDKIHTGKKLRLKQQYFFVSATLQDIICRYKKTHTSFDLFPDKVAIQLNDTHPAIAIPELMRILIDIEGISWEKAWDITVSTFAYTNHTILPEALEKWSVPLIGELLPRHLQIIYEINSRFLESVKTKYPDDADRLRRMSLIEEGNEKQVRMSHLAIVGSHSTNGVAALHTQILKTTVFRDFFELYPDRFNNKTNGITQRRWLKKCNPALSQLISDTIGEGWLKNLADLKKLMPFTGNKAFCETWQHIKKENKIRLAEYIKQTTSIVVNTDSLFCCHIKRIHEYKRQLMNIMHVIFLYNSLKNNSIENFVPRTILFGGKSAPGYFIAKLIIKLINSVAEVVNNDPDIGDKLKVVFLPNYQVSLAERIIPAADLSEQISTSGMEASGTGNMKFALNGSLTIGTLDGANIEIMNEVGSDNIFIFGLTEKEVDHIKRVGYNPYEYYRNNTALKTAIDMIANGYFSSSDISLFMPITNSLLKSDQYMVLADFASYVNCQGLVSKLYRDQDEWTKKSIINVARIGKFSSDRTIHEYAEDIWNVKSVPIRLNGKQT

SEQ ID NO: 9621 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 9622 - protein, 109 aa, Medicago truncatula
MKNFSGTPGTVLGLILRMSQFIFATGSIASIATTPSFFYYTSFCFLIASMALQIIWSFVLALLDAYALLKKKVLLNPVLISLFVVGDWVSLWIKFYTFPNWFDRCNRTC

SEQ ID NO: 9623 - protein, 261 aa, Thermus thermophilus HB8
MRLAFVGLGKMGRSILKGALERGFLRPEEVGVLGRTPERSRELAEPFGVRPLTRADLGMAERVLIAVQPRDFPALAPEIAHHRLGYISIMAGISTSVLARRLDNRRVVRAMPNLAVAIGESSTALTALKEAREAEDLAFARALFATVGDVYEIPEHLFDAFTGMSASAPAYLAVVAEALADAGVKMGMPRALALRLAADALAATGELLKGRHPAQVKDEVASPGGTTIHGLHALEARAVRAAFYEAVEAATQRGHELGESE

SEQ ID NO: 9624 - protein, 350 aa, Staphylococcus epidermidis ATCC 12228
MKAAVWYGQKDVRVEDREPKAIKDNEVQVKVSWAGICGTDLHEYLEGPIFISTDQPDPLLGQTAPVTLGHEFSGVIENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELENIVESGFNQLVNDKSQAKILVRLNGDQK

SEQ ID NO: 9625 - protein, 352 aa, Thermoanaerobacter brockii
MKGFAMLSIGKVGWIEKEKPAPGPFDAIVRPLAVAPCTSDIHTVFEGAIGERHNMILGHEAVGEVVEVGSEVKDFKPGDRVVVPAITPDWRTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLPVPRLEWGCGMAHKTIKGGLCPGGRLRMERLIDLVFYKRVDPSKLVTHVFRGFDNIEKAFMLMKDKPKDLIKPVVILA

SEQ ID NO: 9626 - protein, 249 aa, Xanthomonas axonopodis pv. citri str. 306
MTRKLVLLRHGQSQWNLDNRFTGWVDVELTDQGRQEAVAAGRLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDSLQVRSFRYLGDPEAAKRAAEAVANQGKAK

SEQ ID NO: 9627 - protein, 503 aa, Arabidopsis thaliana
MEMLLGGRATNGALRSKTKIVCTLGPVSRSVEMIEKLLKAGMNVARFNFSHETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 9628 - protein, 948 aa, Mycobacterium sp. MCS
MLDSHQPRFADRHIGPDSDAVAVMLDTIGVATLDDLAAKALPANILDALSADGVAPGLECLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRHGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVKVPGRAAEIRDAAKSHGINIWLVDADHVSVSCDEATTADHVAAVLSAFGATRGGKPFAGPEIATRTSAFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 9629 - protein, 435 aa, Mycobacterium leprae
MGPFDSKVAKMTRLDSVERAVADIAAGKAVVVIDDEDRENEGDLIFAAEKATLEMVAFMVRYTSGYLCAPLDGAICDRLGLLPMFAVNQDKHGTAYTVTVDARNGVGTGISASDRATTMRLLADPASVADDFTRPGHVVPLRAKDGGVLRRPGHTEAAVDLARLAGLQPAGAICEIVSQKDEGSMAQTDELRVFADEHDLALITIADLIAWRRKHEKHIERVAEARIPTRHGEFRAIGYTSIYDDVKHVALVRGEIAGSSGDGDDILVRVHSECLTGDVFGSRRCDCGTQLDAAMAMVAREGRGVVLYMRGHEGRGIGLMHKLQAYQLQDAGADTVDANIKLGFPSDARDYGIGAQILVDLGVRSMRLLTNNPAKRVGLDGYGLQIIERVPLPVRANADNIRYLMTKRDKMGHDLGGLDDFHESNYFPGEFGGAL

SEQ ID NO: 9630 - protein, 314 aa, Zea mays
MMEGDLPTPANARVVAVVTGGNKGIGLEVCRQLACSGVTVVLTARDDARGAAAVENLRGLGLSDVLFHRLDVTDAPSIARLAGFLETRFGKLDILVNNAAIGGVEYVHDQDCGSVTSEEKAKLSGMDMDQRLGWLWENCRETYDDAKTGLRTNYYGTKQVIETLLPLLQASSDGRIVNVSSHFGQLRLFRNEELKRELNDIDNLTPERLDGLLDMFLNDLEAGEVESSNGWPMYFSAYKVAKAAMNAYSRILARRHPELRVNCVHPGYVRTDMTIHSGLLTPEEGGSRVAMVALLPGGGPTGAFFEDFQQSSFV

SEQ ID NO: 9631 - protein, 350 aa, Bacillus cereus ATCC 10987
MKALLWHNQRDVRVEEVPEPTVKPGAVKIKVKWCGICGTDLHEYLAGPIFIPKEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 9632 - protein, 923 aa, Gibberella zeae PH-1
MGSISWDEHHQYAGTHPWWKAASFYQVYPASFKDSNSDGWGDLPGLISKLDYLSDLGIDVVWVSPIFESPQKDMGYDVSDYQKIYEPYGSVEDVDTLIDQCHARGLKIILDLVVNHTSVEHEWFKESRSSKDNPKRDWYIWQPARYDTNGVRQPPTNWRGYFACSTWTWDEHTQEYYLHLYAPDQPDLNWDNEECREAIYDNTMRFWLDRGVDGFRIDTVNKYSKRKDFVDAAVTDPSSPHQPAPEMWCNGPRIHEFIHEMNEKVLRPYNAVSVGELSNTPHPSQVIPYVSAAAKELDMVFEFSMIRLGNGNGFGDKYIYQDFPLSKLKSFVERWQRFIEGTDAWTTVFCENHDNGRAVDRFGDTSSSEWWLKSAKTIAMWQATLTGTLFLYQGQEIGMTNMPRSWGIEEYKDIESSNFFAEAVESGNEKRVKDTMHGLQIMARDHSRIPFQWDDSPNAGFTNAQAKPWMKVHDEYRDINVARQLKDPDSILSFYKEVLRLRKRYQDLFVFGSFKLVDPDDEFLFVYLKESVLPIKGSQGQKRKVLVVLNMSQEERPCPDAYTYLKCSANEAKVLLSTTDRFTDIQKTTLAGWEGRLYTLLTLNLIHLSIPAIMSPFISLDELPQGSSVTFYDSSFFKRGSETITLPTPSEVLARPNFIQHPRAENMKLRIPAVFQELGLAVKHSDSTNTIISEGQCLWAVRRFLPKVPVPEVYGWTQENGIAFLYMEYIDGATLKDRWDSLTVTEKEGVCQELKTNITEISRLRQAPDDEFIGNISRRPLSDMVFTGTNFPPVGPFSSATELHDCMSNMFKWPAKVRQPDIDLADVLDPYRDMLPDDCAIHFTHADLNPVNIMVSKDSPCRVIAIIDWEQSGWYPAYWDFFKVEMTTKPGSEWQTEYLPKLLKEPDPDCCEAFYSYVNSYAP

SEQ ID NO: 9633 - protein, 454 aa, Oryza sativa
  misc_feature (88)..(88): Xaa can be any naturally occurring amino acid
  misc_feature (96)..(96): Xaa can be any naturally occurring amino acid
  misc_feature (164)..(164): Xaa can be any naturally occurring amino acid
  misc_feature (241)..(241): Xaa can be any naturally occurring amino acid
  misc_feature (330)..(330): Xaa can be any naturally occurring amino acid
  unsure (1)..(454): unsure at all Xaa locations
MSAYCGKYKDELIKNAAYIGTPGKGILAADESTGTIGKRFASINVENVEENRRSLRELLFTTPGALQHLSGVILFEETLYQKTKDGKXFVDVLKEXGVLPGIKVDKGTVEVAGTNKETTTQGHDDLGKRCAKYYEAGARFAKWRAVLKIGPNEPSQLSIDLNAXGLARYAIICQENGLVPIVEPEILVDGSHDIERCAYVTEKVLAACYKALNEHHVLLEGSLLKPNMVTPGSESKKVSPXLIAEYTVRALQRTVPAAVPAIVFLSGGQSEEEATVNLNAMNKLSTKKPWALSFSFGRALQQSTLKAWGGKTENVVKAQKAFITRCKANXEATLGTYQGDAVLGEGASESLHVKDVQVLSLLLVVAEDPRGPRQYEHVGWYCIPRGPSARSAAALCFRASPVLVHLVFSSPWPARPPGISSCTTASRRRCSGRGPGGPRSNSAARPRAQAASSE

SEQ ID NO: 9634 - protein, 499 aa, Propionibacterium acnes KPA171202
MSHMDSATQATTPTEGPTEEPQLQRGLKNRHLQLIAIGGAIGTGLFLGSGKTISLAGPSILLVYLIIGAVLFFVMRAMGELLLSNLAYKSFADFATDLVGPGAGFYMGWTYWMCWVVIGNADTIAMCGYLAAWFPHLDKWIPATCIVLLLTCLNMVAVKLFGEMEFWFAMIKIVTIIALILVGGYLAITGFQPPRSGVPAASFSHLWDRGGFFPTGFMGFIAGFQIAIFSFQGIEMAGTAAAETADPEHNLPKAINSIPARVLIFYVLALGVIMAVQPWDLINPQASPFVEMFSFIGILIAFHIVNFVVLTSAASSANSGVFSTSRILYGLAREKDAPPVFAKLSSRHIPRNALILTAMCIAPAIVLVTLEDSVMDAFSLVAGVSSVLYLSVWGLILVCYLKYLGKHPQRHAESAFKMPAGRVMSWVGILFFITILIMLGFSADSRQALIAAPVWVIFMMVLYRLLASTRADHTRIDFDAERIRALEELHRTQEDEHQA

SEQ ID NO: 9635 - protein, 270 aa, Clostridium acetobutylicum ATCC 824
MERGNFSLNINKINSLLTTKYIGRNLILLDSIDSTNLEAKRLIMRAVAEGSLIISEEQTLGKCRFSDRTWSSPKYKGLWMSLILKPNVKKTLFPLITQLAAASLTNSFNKMNINCLIKWPNDILLNNKKLVGILAEVSEDINNTSNIILGIGINVNQDYNDFSPEISKKATSLRIELNEPISRETILSNILNDFEIIYENFLETQDPNSFLDICKKNSALIGKEIAITKKDHTEAAKVIDISRKGELVVTFNDGHTENLISGEVTLNKFY

SEQ ID NO: 9636 - protein, 197 aa, Zea mays
  misc_feature (62)..(62): Xaa can be any naturally occurring amino acid
  misc_feature (114)..(114): Xaa can be any naturally occurring amino acid
  misc_feature (128)..(128): Xaa can be any naturally occurring amino acid
  misc_feature (136)..(136): Xaa can be any naturally occurring amino acid
  misc_feature (161)..(161): Xaa can be any naturally occurring amino acid
  unsure (1)..(197): unsure at all Xaa locations
MFGTTRGTCTNELINMGIYIGTRGKPIVGANDSTGTIGKRICRINGSNSTETRRALRELLFXAVAALQNMSGAILCWETIYHKTRDGRAFCRILMDARTLLAMKADTDKIVAVXTDDDTTIHSHDNHXKRWTEYYXATHHYAKQRAGQQRPPRAPSQIDIXLIAHGLARYAIICQENGLVPIVEPEILVDGPHDIDR

SEQ ID NO: 9637 - protein, 235 aa, Brassica napus
  misc_feature (190)..(190): Xaa can be any naturally occurring amino acid
  misc_feature (200)..(200): Xaa can be any naturally occurring amino acid
  unsure (1)..(235): unsure at all Xaa locations
MALLSGTLQLTSNYIPGYGVSDSRSFSNSVVSRRTLAVSPFSSCLVHIQNGRYAPKMISFVCRASSSGHRRNNPDFSRNNRNGFRGNRNRRNEDRDGLDGGGGLEDSEMLSSKNVPVFSLSSSPKFQATSSPGPREKEIVDLFRKVQAQLRARAAAKIEDKKTEEASKGQGGKETETVDSLLKLLRKHSXEQSKKNVSNXDSEKQLPGDDDDDAERQVHSSNNFDLRTGDHMQHV

SEQ ID NO: 9638 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNTGLAAYIFTKSIPRSWRVSESLEYGLVGVNEGIISTEVAPFGGVKQSGLGREGSKYGIDEYLELKYICMGNLG

SEQ ID NO: 9639 - protein, 413 aa, Gibberella zeae PH-1
MSNQAVGGVYKAIIDEVVNSSRVDFEESGVEESVLEELRQGWQQKLTQLDVAGFPWDPKPDPPPAQAPPPAMAAAQTHAQAQFSPHPGNPTGLSLPGMAQPQAQNGVKPEGSYVKTESPVPIKQEPGLQGNPMAYQQYANPNINMNDKNNVAANRAAQQLQAQYGQRAAGSINALHQQQQPHPQQGQQQQQQQPALPQQQQTHHQQQQQQPGQQQNLTQQQQQQQQMYRQQMAAATAHQQQQHPSNGQPHIQNGQTDGAGDVDDYEGVLMQRAASGDFCELGRVEIDRMLHEQILAKAKSMEGGGLMVPLKEATRHSSASTSRKAKGKQPAAFDGGDDDEEDDDDAINSDLDDPEDEHDDDDVDDDGLGNIMLCMYDKVQRVKNKWKCTLKDGVLTVNGKEYVFHKATGEYEW

SEQ ID NO: 9640 - protein, 746 aa, Oryza sativa
MSGAALVAIAASIGNLLQGWDNATIAGAVLYIKKEFKLESEPTVEGLIVAMSLIGATIITTFSGPVSDWIGRRPMLILSSILYFLSSLIMLWSPNVYVLLLARLIDGFGIGLAVTLVPLYISETAPSEIRGLLNTLPQFSGSGGMFLSYCMVFGMSLLPSPDWRIMLGVLAIPSLFFFGLTIFYLPESPRWLVSKGRMAEAKKVLQKLRGREDVSGEMALLVEGLEVGADTSIEEYIIGPAIEPADEHVVDGDKDQITLYGPEEGQSWIARPSKGPSILGSVLSLTSRHGSMVNQSVPLMDPIVTLFGSVHENMPHAGGSMRSTLFPNFGSMFSVTDQHPKVDQWDEENLHRDDEEYASDGAGGDYEDNVHSPLLSRQTTSAEGKDIAHHAHRGSALSMRRRSLLEEGGEAVSSTGIGGGWQLAWKWSEREGEDGKKEGGFKRIYLHQEEVPGSRRGSVISLPGGGDAPEGSEFIHAAALVSQPALYSKDIIEQRMSGPAMIHPSEAAAKGSSWKDLFEPGVRRALLVGVGIQILQQFAGINGVLYYTPQILEQAGVAVLLSNLGLSSASASILISSLTTLLMLPSIGLAMRLMDISGRRFLLLGTIPVLIASLVVLVVSNVIDLGTVAHAALSTISVIIYFCCFVMGFGPIPNILCAEIFPTRVRGICIAICALTFWIGDIIVTYSLPVMLNAIGLAGVFGIYAVVCSIAFVFVFLKVPETKGMPLEVITEFFAVGAKQMQATKA

SEQ ID NO: 9641 - protein, 181 aa, Medicago sativa
VPQLAQLIVQTKSNFNLKGIAIGNPLLEFNTDFNSRAEYLWSHGLISDSTYDSFTKICNFSQIRRQYASGALTTVCARVNRLVSMEISGYIDSYDVTLDVCLSTVEQQAYVLTQLQEGEKIDVCVEDETFTYLNRKEVQEALHAKLVGITTWTTCSGVLKYDMQNLEIPPYLFWENLLSQV

SEQ ID NO: 9642 - protein, 514 aa, Shewanella oneidensis MR-1
MTTTKRPIALLILDGWGYRENTHMNAVYHANTPVLDRLNAQYAHGLISGSGLDVGLPDGQMGNSEVGHINLGSGRIVYQELTRISKAIADHEFEQNPALCDAVDAAVKTGGAVHIMGLLSPGGVHSHEEHIEAMCRMAVARGATKVYLHAFLDGRDTPPRSAKSSLSHFDDLFTTLGHGRIASIIGRYFAMDRDNRWDRVSQAYDLITQGKSKFQYDNAVTALEAAYSRDENDEFVSSSAITDANGQVATLQDGDALIFMNFRADRARQITRSFINPEFDGFARAVTPKVNFVTLTEYAADIKAPIAYPSDNLVNTLGEVLQNRGRTQLRISETEKYAHVTFFFNGGKEEPFNGEDRILINSPKVATYDLQPEMSSTELTDKLVAAIESTKYDVIICNYPNGDMVGHTGNFDAAVKACEAVDACIGRVVEALAKVGGECIITADHGNAEQMTDETTGQAHTAHTSELVPFVFVGRDATIDKGGKLSDVAPTILHLMGESIPAEMTGKPLIHVKE

SEQ ID NO: 9643 - protein, 618 aa, Gossypium hirsutum
MEQHIMWVFWFFLHWFCSVHSASDGDSLLSPKGVNYEVAALMSVKRELRDDKQVMDGWDINSVDPCTWNMVACSAEGFVISLEMASTGLSGMLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVHWYRSRIMLPSYVQQDYDFEIGHLKRFSYRELQIATGNFNPKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTDEPQGGTNHCETSAYSFSRNYSDVHEESSFIIEAMELSGPR

SEQ ID NO: 9644 - protein, 90 aa, Medicago sativa
YYEAGARFAKWRAVLKIGPNEPSPLSIHENAYGLARYAVICQENGLVPIVEPEILVDGSHDIAKCADVTERVLAACYKALSDHHVLLEGT

SEQ ID NO: 9645 - protein, 153 aa, Arabidopsis thaliana
GSGFPGRTTRVQEEVRASFMFSFAVGVTSPVKATMVVQLTGWKQSVFFRVTRKANNTFTSITGIGGGVSCLKVGPPIGRKKLGTLFYLPDLTDVEWAKEVDYLLRTKGIPGVEFEWEHGFGSREPGTTPGSYIGRSWPMGKLPLFGCTDSVQG

SEQ ID NO: 9646 - protein, 381 aa, Thermoplasma volcanium GSS1
MLSQRLQYVNESATVSASNYVEKLKKQGIKVYNFGIGEPDFTTPQHIIEYAFEMAKEGKTHYTPSNGIHELREKVSEKLKNRNNINASPDEVLITPTKFGINLAMMVILNPGDEVLIPEPYYVSYPDIVRLAGGKPVTVSTLEDYSLDFDLMRKYVTPKTKAIIFNNPTNPTGKVYDEKEIKSLVDFALEYGLYIVSDEIYEDLIYNGKLISPASYSEMWGKSITLNGFSKGYAMTGWRIGYMAAPREIVEAANVIQQQTITCVSSISQYAALRALDDTESPKKMKDEFKRRRDLILSILDSSDKLNVTEPDGAFYVFPEYNSDISSNKVSEDLLEKYQVVVTPGSAFGRQGEHHFRISFATSEDIIKEGAERIIKFFASV

SEQ ID NO: 9647 - protein, 240 aa, Cryptococcus neoformans var. neoformans JEC21
MSRPSQVSNPPTAPPTPFQFDPVPDAIEAIRRGEFVVVMDDESRENEGDVVCAASAVTTEGMAWMIKWTSGYICLSLPPSRLKALQLPPSLPPSGVSQDPKGTAYHLTVDSAPGRHPVSTGISAHDRAYTARLLADPKSDESDFTRPGHMVTLRYAVGGVRKRRGHTECATDLCYLAGLPPAGLLCELVNPYDPAGSMARRDDCWRFAKEWGLKIISVEGLAEYVLKEGKQLVPEEEAKA

SEQ ID NO: 9648 - protein, 452 aa, Staphylococcus epidermidis ATCC 12228
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 9649 - protein, 385 aa, Oryza sativa
MAKIKIGINGFGRIGRLVARVALQSDDVELVAVNDPFITTDYMICEFGIWISVCRPVDQIVIDMSSDAFAHAKSQIVPVALKFRTAICFAVTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 9650 - protein, 377 aa, Ricinus communis
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYAALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 9651 - protein, 401 aa, Clostridium acetobutylicum ATCC 824
MNFKFNTVEEAILDIRQGKMVIVVDDEDRENEGDLVAAGATITGETINYMARYARGLICTPMDSDSMERLGINTMVEKNTEYFGTDFGVSVDAARTRTGISAYERAETIKKLSDKDAKEEDFVKPGHTFPLRAKKNGVLDRNGHTEATVDLVRLAGFYPSVGVCCEIMNEDGTMARLPKLMEFSRKNDIKIITVEKLIEYRKKNEALIKREAEAKLPTKYGEFKIVGYKSLIDNKENLAIVKGELKAEEEVLVRVHSKCLTGDVFGSLRCDCGNQLSYALSAIEKQGAGVVLYMDQEGRDIGLLNKLKAYMLQEKGLDTVEANLKLGFEADLREYWAAAEMLKDLGVKKVKLMTNNPEKINELNKYGIDVVSRVPINTEHVKENEFYLRTKKQKMGHLIEI

SEQ ID NO: 9652 - protein, 541 aa, Streptococcus agalactiae NEM316
MTIDKRKVVYQIYPKSYKDTTGNGVGDLRGIIEKLPYLAELGIDMVWLNPFYPSPQRDNGYDISDYTAINPDFGKMDDFEEMIEVGRQYRIDFMLDMVLNHCSIEHEWFKKALAGDRYYQDFFILRDNPTDWVSKFGGNAWSPFGDTGKYYLHLFDITQADLNWRNADVRKELFKVVNFWRDKGVKGFRFDVINLIGKDEILENCPINDGKPAYTDRPITHDYLKMLNNASFGQADSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKQKLLVLNNFFAEKVKIKLPENYLQGQVLLSNYKDVTLDETVTLQPYQTLAILVS

SEQ ID NO: 9653 - protein, 441 aa, Triticum aestivum
  misc_feature (170)..(170): Xaa can be any naturally occurring amino acid
  misc_feature (199)..(199): Xaa can be any naturally occurring amino acid
  misc_feature (361)..(361): Xaa can be any naturally occurring amino acid
  unsure (1)..(441): unsure at all Xaa locations
PRVRPRVRPRAPKHMTVVVMLKSMEFLVDLMRFPGQLIPFSSKAIITSHISAAGESDSADYDSCDSPLEPNSPLCSQRQEQDENNRSFKVTSLRDIMRRTSNSMEGKLRCSSHSEPNVANALCGRRGRKANEHQRTASSSPDHPLSRAHGRSNLGDRQYGDGVAVSRYLXSDGASTSSARRGRPKSMSTSPEIGDDFAXAVKEMSESMRKNRHSRAHNDGSPGHSNDSQRKEEAVGDLNDDEVSVREPNVQEGSRRHIITQKALSLPSSPHRLGNHGSNLREPADFLTAEDLMSTWNKALQSSPFLNKPLLPFEEWHIGFSEIAVGTRVGIGFFGEVFRGIWNGTDVVFSPPQEEELILDXMEDFLHRYIQRQNAVSGHRNGFAVPLDEGTKGYASRPLDLCNISLLTIPNQYNCKEDYRAQRIDIIPMHHERVVKIFHRK

SEQ ID NO: 9654 - protein, 344 aa, Triticum aestivum
MAASNLEGVLLGMGNPLLDISAVVDEAFLAKYDVKPNNAILAEDKHLPMYDELSSKDNVEYIAGGATQNSIRVAQWMLQTPGATSYMGCIGKDKYGEEMKSAAKAAGVTAHYYEDEAAPTGTCAVCVVGGERSLIANLSAANCYKSEHLKRPENWALVEKAKYIYIAGFFLTVSPESIQLVAEHAAANNKVFLMNLSAPFICEFFRDAQEKVLPYSDYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 9655 - protein, 399 aa, Rickettsia typhi str. Wilmington
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPIFVNCGIENNFKLTVEALERSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTVIQSQSTSNPCSISQMAAIEALNGTQDYIKPNALNFQKKRDLALSILEKVIYFECYKPEGAFYLFVKCDKIFGTKTKSGKIIANSNHFSEYLLEEAKVAVVPGVAFGLDGYFRISYATSMQELKEACIRIKQACNTL

SEQ ID NO: 9656 - protein, 434 aa, Prochlorococcus marinus str. MIT 9312
MTDILNCTKSEEIFSAAQELMPGGVSSPVRAFKSVGGQPIVFDRVKGPFAWDIDGNRYIDYIGSWGPAICGHAHPEVTTALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQEGTYEKLDAITSRLIEGIIQSAENNGIAIYGGSVSAMFGFFLCDGPVRNFDEAKTNDAKLFGKLHREMLRRGVYLAPSPFEAGFTSLAHNEEEIDKTIEVFDQCFNTIKNQ

SEQ ID NO: 9657 - protein, 213 aa, Wigglesworthia glossinidia endosymbiont of Glossina brevipalpis
MNKKLLSEFGDPVQRVKNALQSLKRGNGILVLDDENRENEGDMIFAAENMTVNQMALAIRFGSGIVCICLTKEKCKILNLPMMVKKNNSKYKTAFTVSIESAYGITTGVSAYDRIITIKTAIKDNAKPDDLNRPGHVFPLQAHPGGILSRAGHTEAAVDLTKLAGLKPAGVICEVMNDDGSMARMPEIINFSKKYNMPVLIIKDIIEYYNFIN

SEQ ID NO: 9658 - protein, 388 aa, Solibacter usitatus Ellin6076
MTTAPPVTLSKDEILRYSRHLIIPEVGIEGQQKLKAAKVLLVGTGGLGAPLGLYLAAAGIGKIGLVDFDVVDFTNLQRQVIHFTQDVGRNKIDSASEKMLALNPHVEIVKHEVALSSENALDILKDYDLVVDGTDNFPTRYLVNDACVLLGKPNVYGSIFRFEGQATVFAYEGGPCYRCLYPEPPPPGLVPSCAEGGVLGILPGTIGLIQATETVKLILGIGEPLVGRLLLYDALGMRFRELRLRKNPECPVCGDHRTITKLIDYQQFCGIPQQAPKQEEKVAEGEIEVTEVKKMLDRGDNFVLIDVREPHEYQICSIPGSKLIPLGEVGKRLDELDPNADIVVHCKSGMRSARACGVLRANGFQHVRNMKGGILAWSDQVDPSVPKY

SEQ ID NO: 9659 - protein, 456 aa, Bacillus licheniformis ATCC 14580
MANKELKRGLGARHIQMIALGGTIGVGLFMGSSSTIKWTGPSVLLAYAICGIFIFFIMRAMGEMLYVEPSTGSFATFGHQYIHPLAGYMTAWSNWFQWVIVGMSEIIAVGEYMKYWFPDLPAWIPGIIAMAILGGANLVSVKSFGEFEFWFAMIKIVTIVLMIAAGFGIIFFGFGNGGQAIGFSNLWSHGGFFTGGFSGFFFALSLVIAAYQGVELIGITAGEAKDPQNTLRHAIQSIIWRILIFYIGAIFVIVTVYPWDELNAIGSPFVSTFAKVGITAAAGIINFVVMTAAMSGCNSGIFSAGRMLYTLGVNGQAPKFFTKISRNGVPLYGTIAVLIGLAIGVVLNYIAPPNIFVYVYSASVLPGMIPWFVILLSHIGFRKAKGAEIDKHPFKMPFAPVTNYLTIGFLLMVLVGMWFNNDTRVSLIVGVIFLAVVAASYYVFGIGKRASADGNK

SEQ ID NO: 9660 - protein, 136 aa, Tropheryma whipplei TW08/27
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLDVIQNIVHASDSVKSAKRELDIWFP

SEQ ID NO: 9661 - protein, 253 aa, Dehalococcoides sp. BAV1
MRQIIIAGNWKMNTTLSEACTLVQSMKCELERIEGIEKIICPPFISLYPIKTMLENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 9662 - protein, 385 aa, Zea mays
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 9663 - protein, 90 aa, Triticum aestivum
MAGAAKASWMVAMSVGAVEALKDQAGLCRWNYALRSIHRAAKAKSNIHAGVSQGKKQLPASAAAVPERRRAEKAEEGLRTVMYLSCWGPN

SEQ ID NO: 9664 - protein, 313 aa, Frankia sp. EAN1pec
MTSSIGKPRSSSGPATPGTEPAATLYGAPTTPRTGGQAPATPTTIRPASHSRTTVRDIRAAKDRGQRWAMLTAYDVITAGIFDEAGIPVLLVGDSAANTVYGYETTVPITVDELVPLVRAVVRGAPHAMVVADLPFGSYQASPEQALTTATRFLKEGGAHAVKLEGGARVLPQVGALVAAGIPVMGHLGLTPQSVHAFGGYRVQGRDGAGEVLLADALGLQEAGAFAVVLEVVPADLAARVTKELLISTVGIGAGADCDAQVLVWQDMAGLTGGQAPRFVKRFADLRTALTDAAAAFRDEVSGGLYPTVEHSY

SEQ ID NO: 9665 - protein, 97 aa, Zea mays
  misc_feature (39)..(39): Xaa can be any naturally occurring amino acid
  unsure (1)..(97): unsure at all Xaa locations
MATAQLGIKWKRNPPIPSLPLAVRQWPTWWCKKDNFPWXTYSAKQTCYLLQRKVKVYPKSHTQEFVEIRAGDLAPLPQGMSCTCDIRDAVDKHYNFK

SEQ ID NO: 9666 - protein, 530 aa, Leifsonia xyli subsp. xyli str. CTCB07
MTKPVVLIAEELSPATVDALGPDFEIRDVDGTDRSALLSAVVDADAILVRSATKVDAEVIGAAPKLRVIARAGVGLDNVDIKTATSAGVMVVNAPTSNIISAAELTVGHILSLARHIPAAHSALAQGQWKRSKYTGVELYEKTVGIIGLGRIGSLITARLQAFGVKVIAFDPYVTSARAQQLGVQLVSLDELLAESDFVTIHMPKTPETTGMISDDQLAQMKPTAFLVNVARGGLIDEDALHRALASQSIAGAGLDVFVSEPPTDSPLLGLENVIVTPHLGASTGEAQEKAGVSVAKSVRLALSGELVPDAVNVAGGIIDPYVRPGIPLVEKLGQVFSGLAHSPVTSVDVEVRGEIVEFDVSVLKLAALKGIFTNVVSETVSYVNAPLLADQRGIEVRLLTDSVSEEYRNLITIRGALSDGTQLSVSGTLTGTKQIEKVVEINGYDVEVPIAEHLIVMVYDDRPGIVAVYGREFGEAKINIAGMQIARTSAGGKALSVLTVDSSVPEGLLEKVRVAIDADLLQEIDITES

SEQ ID NO: 9667 - protein, 336 aa, Pseudomonas syringae pv. syringae B728a
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 9668 - protein, 541 aa, Thermoplasma volcanium GSS1
MKTKIVATVGPASEDPSILKQMVKNGLSLIRINSAHAEISYVAKIVKEMRDINPDVGVMVDLKGPELRTGTFPGGSLRISKGNKYTIGKEITLNNEKAIGNIQTGDKVLMSDGEVEFTVDSTSPIVLIAENDGVLRDRSRVNVPGRYVEIGSITERDKSFVIEGIKQGVDFFALSFVQNAENVNSLRDFIIENGGNQYIIAKIETKSGLDNIESIVQASDGIMVARGDLGVELPLKEVVMAQKKIIKISHEDGDFTIVATQVLESMVNNAFPTRAEISDITNAIIDNADALMLSEESAIGKYPALAVQTLRDVSDYVENLVDFQSSYTFKGNKIAYSVAKAAKVLSDDINSNGIVALTHTGSTVKMISSLRPKALVYAGTVDDSLSRKLNIYFGVVPLHLKRDSESLSFADLTEYILKSAFFKSGDKIVVTSGDPYFTFGGTNDVRVMAIGEFLGRGYPQGKDAFGTATYGKNGNILISNSKDVPDGNFDAYIFTADVKPSEVKKINGKTAVFKTRLARTINEGERIYIDGNTGIILKYEK

SEQ ID NO: 9669 - protein, 493 aa, Thermoplasma volcanium GSS1
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 9670 - protein, 463 aa, Chlamydomonas reinhardtii
MQMQLNAKTVQGAFKAQRPRSVRGNVAVRAVAAPPKLVTKRSEEIFKEAQELLPGGVNSPVRAFRSVGGGPIVFDRVKGAYCWDVDGNKYIDYVGSWGPAICGHGNDEVNNALKAQIDKGTSFGAPCELENVLAKMVIDRVPSVEMVRFVSSGTEACLSVLRLMRAYTGREKVLKFTGCYHGHADSFLVKAGSGVITLGLPDSPGVPKSTAAATLTATYNNLDSVRELFAANKGEIAGVILEPVVGNSGFIVPTKEFLQGLREICTAEGAVLCFDEVMTGFRIAKGCAQEHFGITPDLTTMGKVIGGGMPVGAYGGKKEIMKMVAPAGPMYQAGTLSGNPMAMTAGIKTLEILGRPGAYEHLEKVTKRLIDGIMAAAKEHSHEITGGNISGMFGFFFCKGPVTCFEDALAADTAKFARFHRGMLEEGVYLAPSQFEAGFTSLAHSEADVDATIAAARRVFARI

SEQ ID NO: 9671 - protein, 816 aa, Pseudomonas syringae pv. syringae B728a
MSQEPLVRDADVAAFRAAVLAKLTYSVGKDPDHAFEHDWFEAVALAARDHMVEHWMDHTRQIYRKVQKRVYYLSLEFLIGRLLYDSLSNLGLLEVAREALTELGVDIERIRLLEPDAALGNGGLGRLAACFMESMSTLGIAGHGYGIRYEHGLFRQGIVDGWQQEQTENWLDFGNPWEFERPEVVYSIGFGGSVDTVPTEAGDSRQVWRPGETVRAIAYDTPVVGWRGKSVNTLRLWRARAVEDLHLERFNAGDHFGAVAEVVRAESISRVLYPNDATEAGQELRLRQEYFFVSASLQDLLRRHLNQHATLTDLSEHAAIQMNDTHPSIAVAELMRQLIDNHNIPWDTAWKITVGTLGYTNHTLLPEALETWSVGLMERMLPRHMQIIYLINAQHIDTLRAKGVDDVNVLRAVSLIEEDNGRRVRMGNLAFLGSHSVNGVSALHTQLMRKTVFAELHKIYPERINNKTNGITFRRWLFQANPKLTEMLVESLGEDVLDNAETRLKELEPFAEKSSFRKQMADQRLHSKRALAAIIHERLGIAVNPAAMFDVQVKRIHEYKRQLLNLFHTVALYQAIRAEPGTDWVPRVKIFAGKAAASYHSAKLIIKLTNDIARTVNNDPTVRGLLKVVFMPNYNVSLAESIIPAADLSEQISTAGLEASGTSNMKFGLNGALTIGTLDGANVEMSEQVGLEHMFIFGMSSQQVEARKQAGEFSAHDDVAASGRLNDVLQAIRGGVFSPDDPNRYVGLIDQLLAYDRFLVCADFDSYWAAQAKVEERWHDSKEWWRSAVLNTARMGWFSSDRTIREYAGDIWKALE

SEQ ID NO: 9672 - protein, 452 aa, Frankia sp. EAN1pec
MDKQQEFVLRTLEERDIRFVRLWFTDVLGVLKSVEIAPAELEGALAEGIGFDGSAIEGFARVHEADMLARPDPSTFQVLPWRGEHPMTARMFCDLVMPDGTPAVADSRWVLRRTLARAADAGFTFYTHPEIEFFLLKHPPTRGGPMPPPVDESGYFDLTPNDISHDFRQQAIGVLERLGISVEFSHHEVAPGQQEIDLRYADALTIADNIMTFRQVVKEVALRQGIYATFMPKPFSDQAGSGMHTHMSLFEGDRNAFHDPTDEYQLSKVAKAFIAGLLVHSAEITAVTNQWVNSYKRLVGDQRAGELMEAPAYVCWGHNNRSALVRVPLYKLNKSNAARVEFRSPDSACNPYLTFALMLAAGLRGVQGGYDLPAPAADDVWTLTDAQRRERGITALPGSLAEAIATMETSSLVRETLGDELFDFFLRNKRSEWIEYRRQVTPFEIDRYLPTL

SEQ ID NO: 9673 - protein, 481 aa, Lycopersicon esculentum
MAAVNGVGLSWPSKLTKNQTPKWGFSPSHRRCNPSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 9674 - protein, 261 aa, Mycobacterium leprae
MSRKSLIAGNWKMNLNHFEAIALVQKIAFSLPDKYYDKVDVTVLPPFTDLRSVQTLVDGDKLRLTYGAQDLSQHDLGAYTGDISGAFLAKLGCSFVLVGHSERRTYHDEGDALVAAKTAAALKNSLTPIVCIGEYLEIREVGEHVSHCQNQLRGSLAGLSPEQIGNVVIVYEPVWAIGTGRVASAADAQEVCEAIRKELGALASPQVAETVRVLYGGSLNAKNIGDIVAQQDVDGGLVGGASLDGAQFATLAVIAAGGPLP

SEQ ID NO: 9675 - protein, 616 aa, Xanthomonas axonopodis pv. citri str. 306
MSQPAESSELINVVVLLGAAVVAIPVFRRLGLGSVLGYLAAGLAIGPFGLGLFNAPQAILHVAELGVVMFLFVIGLEMRPSHLWSLRKEIFGLGALQIAVCALALTGVGMLLGFALPVAFVAASGFVLTSTAVVMQLLAERGDVALPPGQKIVAILLFEDLLIVPLLAIVAWMGASGDPQAASQRWQGIGIGLACIVGLLVAGRWLLNPLFRILAASKAREVMTAAALLVVLGAALLMQVGGLSMAMGAFLAGVLLSESTFRHQIEADIEPFRGILLGLFFLGVGMSLDLRVVAADWRLIASGVLALMVGKGACIYGVARLMRSDHRQALDRGVLMAQGGEFAFVLFAAASASGVINAQVNASLTAIVVLSMALTPLFVLLQRRLTPAAAVSLDGVEAASGQTGSVLIIGFGRFGQVASQSLLARDVDVTIIDNDIEMIQSAEEFGFKIYYGDGTRLDVLHASGAHSARAIAVCVDNQEAANRIVELATREFPHAKLLVRSYDRQHSLQLVAAGVDYQIRETFESAVIFGKVALVELGVDEDEAGMISREIRRRDAERFELEIAAGDARAGARLMYGNTVPTAPRPTPFTRPRRGSRTLNPDAVPQAGQVETQTRD

SEQ ID NO: 9676 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 9677 - protein, 474 aa, Frankia sp. EAN1pec
MFTNADDVLRYIRDEGVQFIDVRFCDLPGVMQHFTIPTEVFSESVFSDGLMFDGSSIRGFQAIHESDMLLLPDPRTAFVDPFREHPTLAMTFFIHDPITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTVTFMPKPLFEDNGSGMHTHQSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGVKNKIDPPDPIDKDLYELPPDELAAVPQVPGSLEKVLDALEADNEFLREGNVFTPDLIETWIDYKRVNEVDAIRLRPHPYEFSLYYDI

SEQ ID NO: 9678 - protein, 598 aa, Leptospira interrogans serovar Lai str. 56601
MLDHNLLINLIVFLSAAVISVPLFKRIGLGSVVGYLVGGTIIGPWGIGLITDVDSILHLSEFGVVLLLFLIGLELKPQRLWILRRPVFGLGGLQVILTSLTFFILLSLLGLEKRQAIVISISISLSSTAFALQVLGEKNELNTTHGRSAFAILLFQDLAIIPIMATLSFLTESSSNPGSHGSIKEILFPIGTIIAVILAGRFLARPLFKLVASSANHEIFTALSLLIVIGVSILMNQVGLSMALGSFLGGVILADSEYRHELESNLEPFKGLFLGLFFLAVGMSINLGEVLKDPILVILLAFILILVKTIILYFIGIITKHSKEVSLNLSTIISQGGEFAFVILGVGVSLSILPKERADLVIAVVTLSMGLTPILGILKDKTSKWILKEDQNIKEDTIEEQNRVIVAGFGRFGQIIARMLFVHKIGFTALEHNPDQVNLARKFGYKIYYGDASKLSLLRSAGAEHADLFILAIQDIDVSVKIAELIKKNFPNLTIIARARNREHVFKLMELGIQIIRRDTFASALELAGETLSQLGFIDSEVEKKVKKFRAHDELTLKGQFQIRGDEKEFIQFSKNSMRQLEDAFEADRQEKEGKIAG

SEQ ID NO: 9679 - protein, 370 aa, Oryza sativa (japonica cultivar-group)
THRALNSSQISLARRSPPPPRSTERRVEGMASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 9680 - protein, 467 aa, Actinobacillus actinomycetemcomitans
MFISVIMAGGSGSRLWPLSRSMFPKQFLALDKKNNLTMLQATIDRINQMSTSEPIIITNEQHRFIVAEQLREYGVKSRIILEPVGKNTAPAIALAAFEAIKHGEDPILLVLAADHVVLNKEAFQTSVRNALVQAQTGYLVTFGIVPTAPETGYGYIQRGEKITEEAYKVERFVEKPNFETAEKYVASGNCYWNSGCFMFKASCYLHELRKFALEIYEACEKATSNRLKNNDFIRVDVDEFLKCPDDSVDYAVIEKTDKAIVVPMDAGWSDVGSWSALWEVSDKDENQNSYHGDVIMKNTSGCYIYAPNKLVAAVGLENIVIVDTKDAVLVADRSKVQEVKQIVEQLKKEDRREYKEHREIYRPWGRSDAIAQGERYKVNRITVNPGESEETQVHYHRAEHWIVVSGMAKVTKGEQESLITENQSIYIPVGVPHQIANLGKIPLELIEVQSGGYLDDDDVSVLRKYYK

SEQ ID NO: 9681 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEGEAPK

SEQ ID NO: 9682 - protein, 311 aa, Streptococcus agalactiae NEM316
MKTYEKIYQILSKNNNFISGETMANQLNISRTAIWKGIKTLEELGLEIESVTNKGYRLVSGDILLPEQLEQEIGIKVSLNNNSASTQLDAKMGIESKLKTPHLFLAPNQKKAKGRFDRPFFTSNQGGIYMSLLLQPNVPIEDIKPYTVMVASSAVKAISRLTGITPEIKWVNDIYLDNKKIAGILTEAIASVESGLVTNVIIGLGINFYIKEFPRALTKRAGSLFTEQPTITRNQLITEIWNLFFNIPLEDHLKVYREKSLVLDKTVSFMDGQTMYSGKAIDITDKGYLVVELDDGQLKTLRSGEISLSSW

SEQ ID NO: 9683 - protein, 384 aa, Mycobacterium sp. MCS
MEVSATLLLELGVILAALTVLGTIARRFALSPIPLYLLAGLAVGEGGLAPVPAAGDFVETGATIGVVLLLLTLGLEFSIGEFATSLRRHLPSAGVDLVLNAAPGAIAGWLIGLDGVGILALAGVTWISSSGVIARLLSDLRRLGNRETPAVLSILVLEDFAMAAYLPLLAVLATGGTFLQALLGMAIAVSALGFAFVVSYRWGHHVGRLVVHPDNEQLLLRILGLTLIVAALAEFIHASAAVGAFLVGLTLTGEAAERARTVLTPLRDLFAAIFFLAIGVSVDPAALIPMLPVATALAVATAATKVLTGQFAARRDGVGRPGQLRAGTALIARGEFSLVIIGLVGASVEALEAVATPYVFILAMVGPVLARFTGGRAPARRRPG

SEQ ID NO: 9684 - protein, 722 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGNVALCYQEFPESMRSTATSITSVVIGICFYTSTALIDLIQRTTAWLPDDINHGRVDNVYWILVIGGVLNLGYFLVCSWLYRYRNLKDDDHKQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 9685 - protein, 491 aa, Propionibacterium acnes KPA171202
MSARETQSVDTPRRSALARPVKKPPATLDLESPTEERELQRGLTNRHLQLIALGGAIGTGMFMGSSSTIHLAGPSSALVYALIGFFLYFMMRALGEMLLSNLNYKSFRDIAEDLLGPAGGFIAGWTYWFSWIVAAMGDMAAITAYFQYWWPNIPKWLPATALAAVLLALNIIAVQFFGEAEFWFALIKLIAVGALVIVAIALLASRFVSPDGDPATIANLWNDGGFFPNGLMGFLGGFQIAFFAFVGIELVGTAAAETKDPCTTLPKAINAIPVRLALFYVFALLAITAVIPWRKVVPGVSPFVSLFGLAGFGAAASVMNFVLLTAAASSDNSGLYSTSRMMYGLALDGQAPSRFRKLSSNNVPRNALVASCLLLLSGITFLYTSDSIMQAFALVTTVAALLFLFTWSLIVVCYIVYRRKRPQLHEESIYKMPGGVPMCWVVLAFFTISLVILTLDPTTRIAVLITPIWFAFIGSMYFVHHRHEQRKEALR

SEQ ID NO: 9686 - protein, 463 aa, Bacillus cereus ATCC 10987
  misc_feature (244)..(244): Xaa can be any naturally occurring amino acid
  misc_feature (260)..(260): Xaa can be any naturally occurring amino acid
  misc_feature (276)..(276): Xaa can be any naturally occurring amino acid
  unsure (1)..(463): unsure at all Xaa locations
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 9687 - protein, 979 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTFNLPPSPARPLPFIGHLHLLKQPLHRTFLSFSQSLGDAPIFSLRLGNHLTVVVSSYSIAEECFTKNDIVLANRPKFILGKHIEYNFTTMTSAPYGDHWRNLRRIGTLEIFSSHKLNGFLSVRKDEIRHLLLRLSKNSQHGFAKVEMRQLFYDLTINNILRMVAGKRFYGEGTEQDEVARRVTQLIDEIVYRAGVGNAADYIPILRWITDFEKGVKELASRVDEFLQSLVDERRVHKQKGNTMMDHLLSLQETQPDYYTDVTLKGIIIVMILAGTETLAGTLEWAMLNLLNHPEVLEKARTEIDTEVGFDRLMDEADTKNLPYLQWIVLETLRLYPVAPTNIPHMTSDDCILAGYDVPRGSMLLVNVWSMHRDPSIWEAPEMFKPERFKNEKLNQKLLSFGFGRRACPGVGLAHRLMSLALGSMVQCFEWQRIGEEYVDTREEPMAMMRPATPLLAMCKARPIVHKFLDAFA

SEQ ID NO: 9688 - protein, 504 aa, Propionibacterium acnes KPA171202
MTGFNQIPDRERYPHALASNEHRGLTAQEPESSPSSPHPEAHLHRNLNNRHIQLIAIGGAIGTGLFLGSGKAIRAAGPSIIVSYLIIGTMLYFVVRAMGELLMYNLDYKSFQDFAADLIGPWAGFFLGWTYWLCWIVTGMAELIGITTYWDFWVKNRGTAALLAAATLFLLLCLNLLTVRMFGELEFWFALIKIIAIISLIVLAIVLAVMKFQFPSGSMASVANLWNRGGFMPNGWSGFFAGFQMAAFAFVGIELIGTTAAETRDPEKTLPRAISAVPARILIFYVGALLAIMTAVPWDEVRADSSPFVQVLGLVGFAGAASVMNFVVLTSAASSSNSGIYSISRMLFGLAHKRMAPKVFGGLSKNGVPRWGLVITVLVLSTALLLAASESFVEAFTLVTTISSVLFIFVWSMIVISYMKYRRVAPAAHAASKYPMPGGRGMCWAVLVFFVFVLVLLAQEADTARALALTPIWFVILGVGWFFDRHHATHDDVGTDEAHPKGDS

SEQ ID NO: 9689 - protein, 215 aa, Petunia inflata
MFNSTFSSVLFILLFSLSPIYGAYYEYMQLVLQWPTAFCHASPTCKVTPNNFTIHGLWPDNVSTTLNYCKSKTGKYNNIKDPTIKNELYKRWPDLTTSETDCLGNQNFWKREYNKHGTCCSGRYNLQQYFHLAMALKDKFNLLTSLTNHGIIPGSNYNVQKINSTIKTITRGYPNLSCTEEMELWEIGICFDSTVKNVIDCPHPKTCNPTIIKFP

SEQ ID NO: 9690 - protein, 481 aa, Bradyrhizobium sp. BTAi1
MEMFIDGRWVGALGGATFDVLDPATGETIDSVPEAGPADVDAAIRSAEMAFQAWKATPVAERARLQKAAARLMRENAEQLGRLLTRELGRPLAGAITEIQRSAELLDVYAEEGLRLHAEMPLTGVAGEKIIITREPAGVVIAITPFNYPVTLLCFKLGAALMAGCTVVAKPAEDTPLSTLRLAELFRKAGYPTGCFNVVTGRGPDVGMQMIAHPTPRKIAFTGGTQAGKAIAAAAAGTMKRVTLELGGQCPAIVCADADIGAASAAIARHAFANSGQFCYRVNRVYVERPVYTRFLDALADRVLQLDVGNGLTSTCALGPLVNEKIYRNSDRQIADARASGATILTGGARLTGGLYDKGWFLPPTVIADAGPSSLIMTEETFGPVLGVAPFDHHSEALRLANATIYGLAAFVFSRNLATGLTLAERLEAGSVWINDIQRSNQRAPFGGMKQSGIGREKGRYGVEDYLEYKTIYLTYDAELR

SEQ ID NO: 9691 - protein, 233 aa, Crocosphaera watsonii WH 8501
MSDPVVMMKQEVGKAAAARVKSDSIVGLGTGSTTAYAIQYIGERLQSGDLKNIIGVTTSFQAEVLARKYNIPLSTLDVVDRIDIAIDGADEVDPQKNLIKGGGAAHTQEKIVDSLAEQFIVVVDGGKLVDKLGSTFLLPVEVIPKAVVPVMRKLEQLGGKPDLRMGVKKAGPVVTDQGNLVVDVKFDSIDDPATLEKTINNIPGVLENGLFVGVTDVVLVGEIIDNKPVVREI

SEQ ID NO: 9692 - protein, 464 aa, Salmonella typhimurium LT2
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLILSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 9693 - protein, 618 aa, Gossypium hirsutum
MEQHIMWVFWFFLHWFCSVHSVSDGDSLLSPKGVNYEVAALMSVKRELRDYKQVMDGWDINSVDPCTWNMVACSAEGFVISLEMASTGLSGLLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVRWYRSQIMLPSYVQQDYDFEIGHLKRFSYRELQIATSNFNSKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTEEPQGGTNHCETSAYSFSRNYSDVHEESSFIIEAMELSGPR

SEQ ID NO: 9694 - protein, 478 aa, Solibacter usitatus Ellin6076
MLHYDNFINGKFTPSTGTERITCLNPSTGEPICTVPESTAADMDAAIAAAATAQKAWGKRPAIQRAQALRAIAAKIREQVEPLARLITEEQGKTLGLARVEVAFTADYMDYMAEWARRIEGEILESDRPGETILLFRQPIGVIGGILPWNFPFFLIARKAAPALVTGNTIVIKPSEETPHNAVKFCELLAQTDLPPGVINIVHGRGAGAGKTLCASPKIGMISFTGSVETGSAIMAAAAPNITKLNLELGGKAPAIVMADADLDLAVNAVTSSRVINSGQVCNCAERIYVQSKVAAEFTDKLAAAMKSSVCGNPLGEAEVAYGPLINQAGYKKVDALVRGAVAAGATLVTGGNRLPLEGGYYYEPTVLSGCTQGMEIVRREIFGPVVPIVQFDDLDQAIDFANDSDYGLTSSIYTRDLNTALRACQEIHFGETYINRENFEAMQGFHAGWRKSGVGGADGKHGLYEFTQTHVVYMQRA

SEQ ID NO: 9695 - protein, 478 aa, Gossypium hirsutum
MDSTSKSNAATSSKKDANNGQTLLLGRYEVGKLLGHGTFAKVYHARNVKSGDNVAIKVIDKEKILKSGLIAHIKREISILRRVRHPNIVQLFEVMATKSKIYFVMEYVRGGELFNKVAKGRLKEDVARKYFQQLISAVHFCHARGVYHRDLKPENLLLDENGDLKVSDFGLSAVSDQIRQDGLFHTFCGTPAFVAPEVLARKGYDAAKVDIWSCGVILFVLMAGYLPFQDQNIMAMYKKIYKGEFRCPRWFSPELIRLLTKLLDTNPETRITIPEIMEKRWFKKGFKHIKFYIEDDKLCSVEDDDNDVGSCSDQSSMSESETELETRKRVGTLPRPASLNAFDLISFSPGFNLSGLFEEGEEGSRFVSGAPVSTIISKLEEIAKVVSFTVRKKDCRVSLEGSREGAKGPLSIAAEIFELTPSLVVVEVKKKGGERGEYEDFCNRELKPGLKELMVEESQSSAAASLATSSSYLPSDTE

SEQ ID NO: 9696 - protein, 323 aa, Heterocapsa triquetra
MAPAKTSSAAMLGLGAAGWLSSGSLFVSPTPPRAAELSRYAPQATAAPAAGASQGFAPGVRCSILGVAAVTVAAGARRVARRATQDELKKQVGYKAVDDYVKSGTVIGLGTGSTAAFAVERVGQLLKSGELKDIIAIPTSIRTKEQAESLGIPLATLDTHSDLDVAIDGADEVDPNLNLVKGGGGALFREKIVEMCAKKFIVIVDESKMCGGLGPGFPIPVEIVPFCHEHTMREIAKLPALAGCKPVLRLGDVANNKPDGDKPAVTDNSNYIVDLVFETPIKDAVAAGEQLKNTVGVVDHGLFTGMTTACIIAGSDGISVKEA

SEQ ID NO: 9697 - protein, 169 aa, Isochrysis galbana
SLSTLASHPNIDVCIDGADAVDANLNIIKGGGGAHLREKMVAEAAARLVVIVDESKMCESLGPSFPLPVEVTPFGHLHTLRRIGQLHSLSGSAAAPYLRQLKAGGLYTTDNGNYIVDVACGKPIADTVAVAAELSRLTGVVAHGLFNQMASEVIVAGKDGVSVIKSGRQ

SEQ ID NO: 9698 - protein, 492 aa, Campylobacter lari RM2100
MSQKCILIITDGIGHNENKEFNAFFHAKKPTYDELFKNTPNVLIKTSGLAVGLPEGQMGNSEVGHMCIGSGRIIYQNLVKINKAIENNTLKDNKALKELLQKCNRVHIIGLYSDGGVHSMHTHFNALLKICKEENKEVFAHAISDGRDCSPISGLNFIKSLQEFCEKEKINLASLSGRFYAMDRDKRYDRIKLYYDALFAKAPKSDDFITYIQKSYDENITDEFLTPVINPSFDGIKAEDGVVFINFRNDRMRQLVASLTQENFDEFPRELLVKNAITMSLYDEKFNLSIMFEKEELNNTLASVIANANLSQLHTAETEKYAHVTFFFNGGKEELEVNETRVLIPSSKVKTYDEKPCMSAKEVANEVIKGIKGGIDFIVVNFANGDMVGHTGDFEAAIRAVESVDECLGEVIKVARENDYAFIITSDHGNCEAMKDENNNSLTNHTTFDVFAFVEAKGVEKLKEGMGLSNIAPSVLKILNLPIPKEMDEALF

SEQ ID NO: 9699 - protein, 91 aa, Glycine max
RMSSTSRAWTWSVAASVGVVEALKDQGICRWNSVMRSAQQHAKHNMRSLSQTKKFSFQSSAMASAKLKDEKAKQSEESLRTVMYLSCWGPN

SEQ ID NO: 9700 - protein, 159 aa, Arabidopsis thaliana
MGKARTVGVGMDYSPTSKLALRWAAENLLEDGDTVILIHVQPQNAYHTRKILFEETGSPLIPLEEFREVNLSKQYGLAYDPEVLDVLDTLSRAKKVKVVAKVYWGDPREKLCDAVENLKLDSIVLGSRGLGSLKRILLGSVSNHVVTNATCPVTVVKAN

SEQ ID NO: 9701 - protein, 476 aa, Yarrowia lipolytica CLIB122
RMDPCVYHAAILTTAGLNIVRMNFSHGSYEYHQSVIENARESEQQFQGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLGHTNTLRVLECV

SEQ ID NO: 9702 - protein, 294 aa, Thermus thermophilus HB8
MPGLLDLLTESWQSGEALAERLGVSRAAVSKEARRLRAEGYPVEVSRRGYRILPGTPLPHLFHPRGRLGRPYRYLGRVGSTQDVLRAWAEEGAPEGALVLAEVQERGRGRRGRPWESRPGGSLTFSLLLRPGLPLSALGLLPLLAGLALREAVGVGGLKWPNDLLAPDGGKLAGVLLEARAEGEEVSYALLGVGVNVAWAPEGAAFLQAYAPLSRREVLEGFLLKLEALLPLLQTPEALLERYRQASLTLGRKVRVHTGKGVVEGLAEDVLPDGSLLVGGVRVGAGEVELLPLL

SEQ ID NO: 9703 - protein, 181 aa, Ashbya gossypii ATCC 10895
MRQLTEEETKVVFEKLAGYIGRNISYLVDNKEQPHVFRLQKDRVYYMPEHIAKLATCVARPNLMSLGICLGKFTKTGKFRLHITALTVLAQHAKYKVWIKPNGEMPFLYGNHVLKAHVGKMSDDIPEHSGVIVFSMHDVPLGFGVSAKSTSEARDLQPMGIVAFRQADIGEYLRDEDTLFT

SEQ ID NO: 9704 - protein, 409 aa, Bacteroides fragilis NCTC 9343
MPHERKIINDPVFGFINIPKGLLYDIVRHPLLQRLNRIKQVGLSSVVYPGAQHTRFQHSLGAFYLMSEAITQLASKGNFIFDSEAEAVQAAILLHDIGHGPFSHVLEDTIVKGVSHEEISLMLMERMNREMNGQLSLAIQIFKDEYPKRFLHQLVSGQLDMDRLDYLRRDSFYTGVSEGNIGSARIIKMLDVADDHLVVESKGIYSIENFLTARRLMYWQVYLHKTSVAYERMLISALLRAKELASKGVELFASPALKFFLYNHIDPEVFYNNPDCLENFIQLDDNDIWTALKVWSTHTDKVLSTLSLGMINRNIFKVEICSEPISEERKKELTLLISRQLGITLSEADYFVSTPSIEKNMYDSADDSIDIIYKDGTIKNIAEASDMLNISLLSKKVKKYYICYLRWDR

SEQ ID NO: 9705 - protein, 152 aa, Yarrowia lipolytica CLIB122
MSNTEQTFIAIKPDGVQRGLISPILHRFEQRGFKLVAIKLTNPDEKLLREHYEDLQEKPFFPSLLKYMQSGPVLATVWEGKDVVKQGRNILGATNPLQSAPGTIRFDYAIDIGRNVCHGSDSVESAKKEIGIWFKPEELASYTPANIGWIYE

SEQ ID NO: 9706 - protein, 399 aa, Glycine max
NHIHISIASTHTLLEKKRVRSRKMGAEPLSKNEVALAQTQAPFVLGLQPSALVDHVARVDWSLLDQIPGEHGGSIPVELGELEHILREVKIHIVSCHDNDDDDYPSSHIKTLAGGSVANTIRGLSNGFGISSGIIGACGDDEQGKLFDHNMSSNGVDLSRLRKKKGHTAQCVCLVDDLGNRTMRPCLSNAVKVQAEELAKEDFKGSKWLVLRYAILNLEVIQAAILLAKQEGLLVSLDLASFEMVRNFKQPLLKLLESGNIDLCFANEDEATELLRGEQNADPATAVEFLAKYCQWAVVTLGPNGCIAKHGNEIARVPAICEAKAIDATGAGDLFASGFLYGVIKGLSLEECCKVGACSGGSVIRSLGGQVTLENRHWMYKQMQIKDLPTPDTIQITNE

SEQ ID NO: 9707 - protein, 285 aa, Burkholderia sp. 383
MSAHTRTTRKTVTAIRSTKGIGSLVSLTAYSAPMAKLVDEVADVIIVGDSVGMVLYGMPDTLRVTLDMMIAHGAAVVRGAAQACVVVDLPFSTYQESPAQAYRSAARLLAETGAQGVKLEGGTEMADAIRFLTERGIPVMAHVGLMPQQANATGGFRAQGMDPRSAAQVFDAACSAEQAGAFSVVIEGTAEALARHITETLTIPTIGIGASPACDGQVLVTEDMIGAFDAYTPRFVKRYADANAVMRDAIRQYAHDVRQGVFPEPAHCFGYGKPLQLVGAADAAA

SEQ ID NO: 9708 - protein, 317 aa, Pichia guilliermondii
MSITLNSGYEMPSVGFGCWKVDKATCADTIYNAIKVGYRLFDGAEDYGNEREVGEGINRALDEGLVARDELFVVPKLWNSFHDPKNVEKALDRTLSDLKVDYLDLFLIHFPIAFKFVPFEEKYPPGFYCGDGDKFTYEDVPIIDTWRALEKMVEKGKIRSIGISNFPGALIQDLLRGAKIKPAVLQIEHHPYLQQPRLIEYVQSQGIAITAYSSFGPQSFVELNHPRVKDVKPLFEHDVIKSVAEKANKTPAQVLLRWATQRGLAVIPKSNNPDRLLSNLKVNDFDLSQEDFKEISKLDIELRFNNPWDWDKIPTFV

SEQ ID NO: 9709 - protein, 540 aa, Rhodopirellula baltica SH 1
MDWGDWAAVEPEDGVAEVADIVEISRQTSNKRFGRFATRYRSSRSPFFPSVTKMNGYATPWASGRTIANTMRPTPMAASWSAPTQGQLTSEQRSSAARKRLMAANSLSTGPQSNHDNPKRVAGSDDMATAEIDLSQTDNLVDGRESSSSDAGESFDPEDRAAARARIEAVLLIAKSPLNYRRLAALADVEDATSARTLVGELNELYERLGRGIRIEQVAGGQRMMTRSVVAPWLRRLGFLAPAIRLSWPMMETLAVVAYRQDVTRADVEAVRGVACGEILRQLMQLDLVRISGRSEELGRPYLYGTTKRFLKICGLASIKSLPPIDWHASCDDVSQSADGEVENIADELTADELKSRDHSQLESHPRRESSDAETSDTNPSETEHLHPTKESDVSVAAIETLATEFTVSLDADQSGAVAVLDAPASDADAASSNDPSAVIEDEEDDLYENGYELDDEEDDDFDDDDWDDDDEDSDDDDDEDEDDEDEDEDDEDSDDSDDDDDDLDGTDDWEEVDDDEADEDWDDEDEEDDLDEEEEEWED

SEQ ID NO: 9710 - protein, 804 aa, Arabidopsis thaliana
MMTRFACLHLFTMFLFTLLSGSSSAVITTESPLSMGQTLSSANEVYELGFFSPNNTQDQYVGIWFKDTIPRVVVWVANREKPVTDSTAYLAISSSGSLLLLNGKHGTVWSSGVTFSSSGCRAELSDSGNLKVIDNVSERALWQSFDHLGDTLLHTSSLTYNLATAEKRVLTSWKSYTDPSPGDFVGQITPQVPSQGFVMRGSTPYWRSGPWAKTRFTGIPFMDESYTGPFTLHQDVNGSGYLTYFQRDYKLSRITLTSEGSIKMFRDNGMGWELYYEAPKKLCDFYGACGPFGLCVMSPSPMCKCFRGFVPKSVEEWKRGNWTGGCVRHTELDCLGNSTGEDADDFHQIANIKPPDFYEFASSVNAEECHQRCVHNCSCLAFAYIKGIGCLVWNQDLMDAVQFSATGELLSIRLARSELDGNKRKKTIVASIVSLTLFMILGFTAFGVWRCRVEHIAHISKDAWKNDLKPQDVPGLDFFDMHTIQNATNNFSLSNKLGQGGFGSVYKGKLQDGKEIAVKRLSSSSGQGKEEFMNEIVLISKLQHRNLVRVLGCCIEEEEKLLIYEFMVNKSLDTFLFDSRKRLEIDWPKRFDIIQGIARGLLYLHHDSRLRVIHRDLKVSNILLDEKMNPKISDFGLARMYQGTEYQDNTRRVVGTLGYMSPEYAWTGMFSEKSDIYSFGVLMLEIISGEKISRFSYGVEGKTLIAYAWESWSEYRGIDLLDQDLADSCHPLEVGRCIQIGLLCVQHQPADRPNTLELLAMLTTTSDLPSPKQPTFAFHTRDDESLSNDLITVNGMTQSVILGR

SEQ ID NO: 9711 - protein, 387 aa, Archaeoglobus fulgidus DSM 4304
MEKSIQDTIHGVIKLEDWMVEIVDTPQFQRLRRINQLGFANLVYPGANHTRFEHSLGVMHVTRILQERMGFDDVVVAAALLHDVGHAPFSHGSERLLEKYASYNHETISKVVRGELKDVLKNLGFRISEIEAIVTGKRRSVVNGEIDADRMDYLVRDSHYTGVAYGVFDIYRLIDKIKFDGAVVIEQGGVKAAESLLISRFLMYPTVYFHHVCRIARKMYERAMERIIEAGFEAENLLEMDDVDAMMLLKEKERETYDRLNNRRLFKRAIYVSRRSLDFREVMRTSERRAEREVAEMAGVDERYVIVDIPPVEEMRESGVMVDTESGLKPLEEVSPLVKALKDAAVENWRLGVYTDRRFVDKVGKAAADYFGIEKVVQKSLDEIFPQ

SEQ ID NO: 9712 - protein, 471 aa, Bacillus cereus ATCC 10987
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 9713 - protein, 127 aa, Zea mays
  misc_feature (55)..(55): Xaa can be any naturally occurring amino acid
  misc_feature (64)..(64): Xaa can be any naturally occurring amino acid
  unsure (1)..(127): unsure at all Xaa locations
AAARGRPRRRWRSDKMRIKVKYNPPESSLSKLRIRQRPKWGSKKSKVPCTYSAEXTCYLLHGQXKVYPQRHGEELAEIGAGDLGVFPKDMSCTCHVVEADDKHYNFEDSATPSMPALVDVYLLCSCI

SEQ ID NO: 9714 - protein, 160 aa, Glycine max
  misc_feature (99)..(99): Xaa can be any naturally occurring amino acid
  misc_feature (152)..(152): Xaa can be any naturally occurring amino acid
  unsure (1)..(160): unsure at all Xaa locations
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 9715 - protein, 534 aa, Zea mays
WSFLTSVRIGAQAKKSDVVENKRFVCSREGFTKRCAQLNKQKKHSETRCGCNARIYVRLNQDSKYYIASFVEEHNHGLVSPNKIPFLRSNRTISQRAKTTLFTCHKASIGTSQAYRLLQVSDGFDNIGCMKRDLQNYYRGLREKIKNADAQLFVAQMERKKEANAAFFYDFVVDDNEKLLYIFWADATSRKNYSHFGDLVSFDATYSTNQYNMIFAPFTGVNHHMQSVLFGAAFLANEKIESYEWLFRTFLLAMGEKAPRLIITDEDASMKSAIRTILPDTIHRFCMWHIMEKVPEKVGPPINHDKEFWAALNTCVWGSETREEFEMRWNVIIAAYDLYSNEWLANRYQIRESWIPAFFMDIPLAGVLRTTSRSESSNSFFNRFIHRKLCFVEFWLRFDTALECQRHEELKADHISIHTTPILHTPWAVEKQASILYTHNVFNIFQKEVIAARDHCSVLGTTQQEAIKLVLINDGSIRDRVVEWCASNNFGRCSCKLFEKMGIPCRHIILTLRGEKLYELPTSYILKRWETRCK

SEQ ID NO: 9716 - protein, 250 aa, Kineococcus radiotolerans SRS30216
MTEAAHTLVLLRHGESEWNALNLFTGWVDVALSEKGRAEAAAGGRMLVENGVLPDVVHTSVLRRAITTAFLALDAADRHWIDVKRSWRLNERHYGALQGKDKKQTLAEFGEEQFMLWRRSYDTPPPAIEAGSEFSQDGDPRYAGLGDDMPATECLADVVARMLPYWTESVVPDLRAGRTVLLAAHGNSLRALVKHLDGVSDADIAGLNIPTGIPLVYRLDADLKPLVPGGEYLDPAAAAAAAAAVANQGR

SEQ ID NO: 9717 - protein, 160 aa, Glycine max
EWAGNDRFIRVMPNTPAAVGEAASVMSLGGSATEEDGNIIAKLLGSIGKIWKAEEKYFDAITGLSGSGPAYVYLAIEALADGGVAAGLPRDLSLSLASQTVLGAASMVIQTGKHPGQLKDDVTSPGGTTITGIHELENGGFRGTLMNAVVAATKRSRELS

SEQ ID NO: 9718 - protein, 329 aa, Kluyveromyces lactis
MVKVAINGFGRIGRLVLRIALQRKALEVVAVNDPFISVDYAAYMFKYDSTHGRYKGEVTTSGNDLVIDGHKIAVFQEKDPANLPWGKLGVDIVIDSTGVFKELDSAQKHLDAGAKKVVITAPSKTAPMFVVGVNEDKYNGETIVSNASCTTNCLAPIAKIINDEFGIDEALMTTVHSITATQKTVDGPSHKDWRGGRTASGNIIPSSTGAAKAVGKVLPELQGKLTGMAFRVPTVDVSVVDLTVKLAKEATYDEIKAAVKKASQGKLKNVVGYTEDSVVSSDFLGDTHSTIFDASAGIQLSPKFVKVVAWYDNEYGYSERVVDLVEHVA

SEQ ID NO: 9719 - protein, 137 aa, Campylobacter lari RM2100
MEKTLSIIKPDAVKKGVIGQILTRFESNGLRIAATKKIQLSEKEAQEFYAVHKDRPFFKDLVEFMISGPVVVSVLEGKNAVLKNRELMGATNPKEAAAGTIRADFADSIDANAVHGSDSLENAKIEIEFFFSKTEIL

SEQ ID NO: 9720 - protein, 647 aa, Oryza sativa
MHGGGARALAAAFVLALLAAAPAASEVVCSGRRYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHHEVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYPRGDILKCINIGLLCVQQNPVDRPPMSAIILMLSSGTVTLQAPYRPAYIFGRNRSYTETMDVPLPSGPHSSITELEPR

SEQ ID NO: 9721 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVLVY

SEQ ID NO: 9722 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVQVY

SEQ ID NO: 9723 - protein, 79 aa, Glycine max
ASLMISSPAVTTVNRAGAGMVAPFTDLKFMAGFPTGKTDHDVTSIASNGGIVQCMHVSPPIGLIKHGTLYYLPDLDDAQ

SEQ ID NO: 9724 - protein, 270 aa, Methanosarcina acetivorans
MENQKIGFIGAGKMGSALMQGTIKAGIVTPENIGASDVYEPFLKDLQAKLGIRVSTDNAVIVRESDILILAVKPQTLSSVLSNLKNEITSEKLVISIAAGVPLSTYEDALLEGTRVVRVMPNIAATVSEAASGIAPGKNATPEDLKAALEIFSAVGTAVQVPESLMDAVTGLSGSGPAFIFPVIEAMADGAVLEGMDRKSALTLAAQTVLGAAKMALETGMHPGELKDMVTSPAGTTIQGIHSLEEAGIRAAFMNAVIRASERSKELGKK

SEQ ID NO: 9725 - protein, 305 aa, Clostridium acetobutylicum ATCC 824
MIRILANDGMNKNAVNGLIDLGYEVVEDHYDKDELLVKIKEFDVLVVRSATKVTKEVIDAATVKGAKLKLIIRAGVGVDNIDVTYARDKGLTVNNTPNASSASVAELAIGHMFAVSRFINTANVTMRQGKWEKKAYTGTEIFGKTLGLIGFGRIAREVAKRAEALGMKVIYNDICGKVVGYDSYEFYDDINGLLREADFVSLHIPYDKKKGYVIGDNEFNAMKDGAFLINCARGGVVSEQALLNAINNGKIRGAALDVFENEPKPCAEILDNPRVSVTPHIGASTKEAQARIGEEIVNIVENTFK

SEQ ID NO: 9726 - protein, 334 aa, Prochlorococcus marinus str. MIT 9312
MRTSFRHFEQNKIVDLVGLGNAIVDIIVNTEDEFLEINNLEKGSMNLINSDQSQTLLNNCKVIKQISGGSSANTVVCLAELGNDVQFIGRVKNDQFGNFFSSDIKKSKTTFNTPPTEEGAATAHSIILITPDAQRTMCTYLGASIEFEPKDIDFSVLKESKYLYLEGYLWDSELAKNAFLKAAQIAKLSNTKIILSLSDSFCVDRHRESFLELIDNYVDIVFCNESEVLSLFKKDKLANCQGDLSSLCELVVVTLGRNGSLIINKNDVEVIKSITTEKIIDTTGAGDIYAGGFIHGLINNYSLKKCGEIGSICAGQIITQLGSRSNIDLKKLIS

SEQ ID NO: 9727 - protein, 314 aa, Leptospira interrogans serovar Lai str. 56601
MHSLMKPTREPQINLFKKSNPYKAKVISNVLLTPETGTGKRPKKEGEALVHRIVLAIDHSAYPYVIGQSGGVIPPGEDPEKKAKGLADVGYTVRLYSIASPSYSFGMKEDNIEFIIKRDNIYDENGNIQFKGVCSNYMCDLKPGDEVTMTGPSGKKFLLPNTDFSGDIMFLATGTGIAPFIGMSEELLEHKLIKFTGNITLVYGAPYSDELVMMDYLKGLESKHKNFKLITAISREEKNSFDGGRMYISHRVREQAEAVKKILNGGGRFYICGGPKGMEKGVIEEIQKISGNTGTYEEFKHHLEGAHQLFVETY

SEQ ID NO: 9728 - protein, 465 aa, Ralstonia eutropha JMP134
MSLFRTKDIDAMLVNSHVGGLKKVLGPVDLVLMGIGAIIGTGIFVLTGTGALTAGPALTISFVIAAMACGFAALCYAEFASAIPVSGSIYTYSYATLGEIIAWMIGWDLLLEYGLATSAVSVGWSGYFQSLAAGFGLHLPAALTAAPGAVPGVQTLFNLPAFLIMLITTWVVSCGVRESARLNNVMVAIKVAVVVLFIAVGVWHVKPANWQPFAPFGVSGIFNAAALVFFAFIGFDAVTSAAEEVRNPHRDLPVGIIGSLAVCTVLYVIVAAIMTGVVPFAKFAGIDHPVSLVLQYAGQNWVAGFVDLGAILGMTTVILVMTFGQTRVIFAMSRDGLLPARLSSVHPVHATPFFATWTVGIVFAMIAAFVPLNVLAELINIGTLSAFTLISIAVLVLRRTRPELHRAFRCPGVPVVPLLSVGFCLFLMAHLQALTWIAFLTWLAIGLSVYFLYARRNAVLHEGSR

SEQ ID NO: 9729 - protein, 540 aa, Symbiobacterium thermophilum IAM 14863
MKILVTEAISETGISLLRDEHEVDVRKVTSEELLEIIPEYDALITRSETKVTAEVLARGTRLKVVGRAGVGVDNIDVAAATERGVVVVNVPGANTYSTAEHAFGLLIAVARNIPQAHHALAREGRWDRMSFVGTELHGKTLGIIGLGRIGSEVAVRARAFGMRVLAYDPYVPHSRAEHLGVTLVPSLRGLLPEVDFLTIHAAKTPESARLIGAAELALMKPTARIVNCARGGMVDEEALYRALKEGRLAGAALDVFAAEPCTDSPLFGLPNVVVTPHLSASTAEAQDANGRYIAQYVLRALRGELVPEAVNLPQIPRDGVQVVTDHLPLAETLGSFLAQAFPGHADRITVAYSGELAKHPTALLTNTVLKGYLATQLGEHVNYINAPALARRRGIAVNESKSLTHAPLGENGTLSPASSLITVRSEGPQGAHEVTGMLRRDGGMRFVAVDGLHIDMAPSRHMLVSQHRDQPGMVGRFGMALAARDINIAGLHLGRHQPRGMALMLLQIDEPAPPDLVAELREAMAVDTVQAVTLPLGRQP

SEQ ID NO: 9730 - protein, 202 aa, Magnetospirillum magnetotacticum MS-1
MASAADHASFLPPVLTFLSAAVIGVPLVRLLGQSAVLGYLVAGVVIGPAGFSLIAEPETAASVAEIGVVLLLFIVGLELEISRLVSMRRDIFGLGTAQLALCALVIAGAAFAYGLTPAAAGVVGIAIALSATAVALQLLEERGDLGSAYGGRSFAVLLFQDISVVAILAAVALLASGGATRKKGGRRRPPSPARAGWRDPRG

SEQ ID NO: 9731 - protein, 289 aa, Zea mays
MAAPPVQPVPTAAAAAVNGDAFRLGFVGAGNLAESIARGVAASGVLPASAIRTAPHRRPERGEAFASFGACLLQTNAHVVDDSDVIVISVKPQIVKQVLLQLRPRLSEKKLLVSIAAGIKMQDLQDWSGQRRIIRVMPNTPSAVGQAASVMCLGEMATQDDENRVRKLFSAIGKVWTAEEKYFDAVTGLSGSGPAYIFLAIEAMADGGVAAGLPRDLALGLASQTVLGAATMQNGKKKKKKKHPGQLKDQVTSPAGTTIAGIQELEKGAFRGTLISAVVAAANRCRELS

SEQ ID NO: 9732 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 9733 - protein, 468 aa, Parvularcula bermudensis HTCC2503
MAVKDVLKKIKDEDIQYVDLRFTDPKGKWQHVTFDKSMVDEELFEDGTMFDGSSIAGWKAINESDMILMPDAETAIVDPFFAQPTLSIICDILEPSTGQPYSRDPRTTAKAAEAYLKSSGIGDTAYFGPEAEFFIFEDVRISTEQNNMGFSLDSTEGPYNMAREYEGGNLGHRPRAKGGYFPVPPVDSEQDLRSEMLSYMSQMGLEPEKHHHEVAPSQHELGMKFSTLLKMADNMQIYKYVVHQVAHAFGKTATFMPKPVFGDNGSGMHVHQSIWNAGKPVFAGDRYADLSETCLHYIGGIIKHARAINAFSNASTNSYKRLVPGFEAPIMLAYSARNRSASVRIPWVSSPKGKRIETRFPDAAGNPYLTFAALLMAGLDGIENRIDPGDAMDKDLYDLSPEEQQGIPTVCASLEEAMAALDADRDFLRKGNVFSDDQIDAYIELKMEEIVRYNTTPHPVEFDMYYSV

SEQ ID NO: 9734 - protein, 309 aa, Cryptococcus neoformans var. neoformans JEC21
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRSVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 9735 - protein, 964 aa, Yarrowia lipolytica CLIB122
MAYRRKKFFGKRTEAGHVARTPSQLQEVYSDDDDGEGEDVEMWDQPEVKDTHNADSGSPASPAAAMPPRMSDSLYQETKAEAEASAGPQGAPGDLYSLIRTFPLFKMAPNAFVIAVSAKLRIQQVSPQEYIVTQGDEAKAMYWILKGQVNVTSRDGESVYAELEAGSFFGEIGILFDRPRTATVLASTKCVLAVLKGDSLNDILPKFPAMERAIRDEAQERLAIIEKTKINQRKSLLTGMVSPTTSIRNLLHEMPLFRHIPETIVHKLALAVEPRTYEPFQYIIKQDTIGQEIYFLTSGIVEVIDEREIGTAAHIIARLTKGSYFGEMAFLSSNPVRTASIRSISMVECLVLTTDTLESLCSQYPDIQQHIEQTASARIEQYHRDPKTHDIINNTTTDTQSAGAGPALPVDMTRRRSVADFGGKKNYSLFTVSRGGATFFSEPKDYHISLPGAENTTVSPMTSNHSHTRRYSTGTVFEPVISRDGRVVFSNSWESNSGVSEEAPLSLGNYQMAQPRKCLSAGSSGATSPSKRPAFDNRDDEPLGKDKREMSPRDSSPSSPGAAPLARSSSTGASVKTISPQRYSSFLLHPRLKKQKTFQRRKSSLFNVGPFSDAIQVKIFAYLDLPDLMVLQRVCQHWRQLLLTCPLPELDLKPYNRSIDDTSIVSIVNFVGARPKLVDISSCFHLTDDGFSYLVNGIGLAKIRVFKMTSVWEVSGMAIMDLTVPSIGADLEEVDLSNCRKVGDSTLARLVGWVQEEGGENSGDRETSPSSSVVGCPKLKRITISYCKHITDRSMHHMAVYAADRLEMLNLTRCTTITDHGFGYWNIRPFTRLRELVLADCTFLSDKAIISIVGAAKNLEFLDLSFCCALSDVSVEVLSLGCPSLKSLNLSFCGSAVSDANLRAVAMHLLDLEHLSVRGCVRVTAVGVDTILAGCLKLKTLDITQCKNAGGWNQGDSKVVVKTT

SEQ ID NO: 9736 - protein, 318 aa, Apodachlya brachynema
SKVGINGFGRIGRLVLRAAENNPLINVVAVNDPFIPTNYMEYMLKHDTVHGMFNGTVSHEGDHIIVNGRKVRVFGERDPQNIKWSDCDIEYVVESTGAFTTLEKASAHLKNGPKKVVISAPSADAPMFVMGVNHQLYTNNMNVVSNASCTTNCLAPLAKVVNDSFGIKEGLMTTVHAVTASQLSVDGPSKKDWRGGRAACFNIIPSSTGAAKAVGKVIPELNGKLTGMSFRVPTADVSVVDLTCRLNNKASYDEIKAAIKYASENELKGILGYTDAAVVSSDFITDSRSSIFDASAGIALTDDFVKLVSWYDNEWGYS

SEQ ID NO: 9737 - protein, 321 aa, Isochrysis galbana
SKVGINGFGRIGRQVVRIAMDRDAFVLKHINSPMTPEYMKYLLEHDTVHGRFPGTCEVNKDGLVINGLPVSLSSTRDPTEIPWGKVGVEYVCESTGAFLSTPDCLKHIAGGAKKVIISAPAKDAETPTIVVGVNTDTYDPETMNVVSCASCTTNGLAPLVKTINDKFGIKQGLMTTVHAATASQVVVDSSMKGADWRAGRAASANIIPSSTGAAKAVAKCYPVMKGKLTGMAFRVPTVDVSVVDLTCELETPCTYDEIKAEVKLASETYAKGIVGYTEDQVVSSDFVGETCSTVFDAGAGIQLTPTFVKLVSWYDNEWGYS

SEQ ID NO: 9738 - protein, 509 aa, Magnaporthe grisea 70-15
MSLSTIIAQVALALIASVWIWRSITLYYRRRKLKLLHGCMPVTKIPDWDPIFGLGFTYTLIKSDINNHRLINNTVERLQTYGYTHMANVMRHRMFFTCEPENLKAIMHGQFDHFDNELRSVPAGHFMGMGIFLADGEKWQRSRALVRPNFARDQVADLGSLERHFQILLSIIPKDGSAVDLAPLFFAFTMDSITDFLFGESVKALQAHASGAHASSSPWSQKGIEQFAEAWEYAQNDMLFRFILGPARYVYQDKKANQCVKMIHAHVDRYVEQAVRFRNEELARGGDEKEPKSEGRYIFLQALAKQTQDRKVLRDELMNLLMAGRDTTAALLSNLFHTFARRPDVWAKLKNEVMFLEGRLPTYEDIRNMKYVRWCINEFGILGKQASFDTTLPRGGGPNGRSPIFLPKGSIVLYSMLAQHRRKDLFGEDALEFRPERWETLRPGWNYVPFNGGPRICVGQQYALTEASYLVVRFVQTFATVESRDPEPWSIGKRLLTCPMNGTIVSLSR

SEQ ID NO: 9739 - protein, 194 aa, Synechococcus sp. WH 5701
VGISISPAQVARATDLTTQGLSCRFEVMDALDLQMADHSFDAVWSVEAGPHMPDKQRYADELLRVLKPGGLLAVADWNRRDPSDGAMTKTERRVMRQLLNQWAHPEFASIAGFQQNLETSHYSQGGISTDDWSQATLPSWIDSILEGVRRPRAVLGLGPKAVVQGLRETPTLLLMHWAFATGLMQFGVFKLKRH

SEQ ID NO: 9740 - protein, 321 aa, Isochrysis galbana
SKVGINGFGRIGRLVCKAACMKDGATVTAVNDPFCDVEYAAYLFKYDSTHGRYKGTVTFDTASSTLIVDGQKIKFYACRNPNEVPWGEAGADIVCESTGIFTVIEKASMHLQGGAKKVIISAPSADAPMFVMGVNHTSYTKDINILSNASCTTNCLAPLAKIINDEYGIVKGLMTTVHATTATQKTVDGPSGKDWRGGRGAGQNIIPSSTGAAKAVGKVIPALNGKLTGMAFRVPTPDVSVVDLTCVLGKPASYAEICEFIKKSCEKPEYKGIMAYTDEEVVSNDFISDPASSTFDAKAGIGLDDTFVKLVSWYDNEWGYS

SEQ ID NO: 9741 - protein, 319 aa, Mallomonas rasilis
SKVGINGFGRIGRLSLRAVKGHPNVKVVAINDPFIPLDYMKYMFYYDSVHGKYDGTVTIDNGKLIVDGTPITVSNEREPEKIKWGDAGAEIVLESTGKFLEEAGAAKHFVGGAKKVVMSAPSKDATPMFVMGVNHFEYKGQKIVSNASCTTNCLGPLAKVINDNFGIQEGLMTTVHAATATQPTVDGPSVKDWRGGRGAVGGNIIPSSTGAAKAVGAVIPALKGKLTGMAFRVPTANVSVVDLTCVLTKGAKYSDIKAAIKAASEGPMKGILGYTEDSVVSTDFISDPRSSIFDAGAGIALNDKFVKLVSWYDNEWGYS

SEQ ID NO: 9742 - protein, 242 aa, Zea mays
VLIGSNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 9743 - protein, 382 aa, Xanthomonas axonopodis pv. citri str. 306
MPLTTKLPKVGTTIFTVMSQLAAEHGAVNLGQGFPDFAVPQRLVDELSKAMAAGHNQYPPMTGVATLRQAIAGKAQRCYGAQVDADTEITVTSGATEAIFNAIHAVVRAGEEVIVLDPAYDCYEPAIDLAGARAVHVALHPQTFAVDWDALRAAITPKTRLLMINSPHNPSGAMLSAEDMQTLTELLRGTEIFLLSDEVYEHIVFDGRRHESVLRWPALRERAFVISSFGKTYHCTGWKIGYAIAPPALTAEFRKVHQYNTFTSFGPAQHAFAAMIRDEPEHDEQLGAFYQAKRDRFREQLLATRLKPLPVPGGYFQLVDYSAISDLPDTEFVKWLTIENGVAAIPLSPFYENAPAGQRLARLCFAKNDATLDAAIERLRRL

SEQ ID NO: 9744 - protein, 234 aa, Glycine max
  misc_feature (218)..(218): Xaa can be any naturally occurring amino acid
  misc_feature (227)..(227): Xaa can be any naturally occurring amino acid
  unsure (1)..(234): unsure at all Xaa locations
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGSKKGVNLPGAAVDXPAVSEKDIXDLKLGWS

SEQ ID NO: 9745 - protein, 238 aa, Glycine max
  misc_feature (112)..(112): Xaa can be any naturally occurring amino acid
  unsure (1)..(238): unsure at all Xaa locations
CKVSSFKCSSAFTNVFLQGFLRAGAMSSPYLPATTDSLALATEAKDPSEAISILYRVLDDPSSSPDALRMKEQAITNLTKLLTDENRGEDLRSLLTQLRPFFSLIPKAKTFXRQRVEARLAALLMESKEYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPRGGGLRS

SEQ ID NO: 9746 - protein, 264 aa, Synechococcus elongatus PCC 7942
MISSLGIIGGGVMGEALLARLLAQGQVAATAVTVSEPFAARCEFLNDRYGVRCVDDNAEAAQADWVLLAIKPQVFDPAVAGLADLRSDRLILSILAGVPLAKLEAAFPHEAVIRAMPNTPATVGAGVTAIAAGQQVTADQLSQAQEFFAAVGRVVTVPESQLDAVTGLSGSGPGYVALIVEALSDGGVAAGLPRAIATELAIQTVRGTAELLQETGWHPGELKDRVCSPGGTTIAGVATLEQNGLRSALIEAVKAAALRSQQLG

SEQ ID NO: 9747 - protein, 326 aa, Blastopirellula marina DSM 3645
MSDTLTLAGGGKLPMVGLGTWKIDTAILPDLIVAAVAAGYRHFDCACDYGNEKEVGAGIRQAIDQGLCRREDLWITSKLWNTYHRPEHIRAAAERSLKDLQLDYFDLYHIHFPIALEFVPFEKRYPPEWFFDPDAAEPKMHPIAVSQAETWGALQALKTAGMARHLGVCNFNVALIREITAATSQRPDVLQVELHPYLSQERLLRFCKQAGIAVTAYSPLGAPSYVPLGMAAEDEDLLAEQTIRTIAEAHGKSPGQISLRWNVQRGAAVIPKTSRVERLAENIALFDFELSESEMTSIGQLNRDRRFNDPAQFGEAAFNTFFPIYD

SEQ ID NO: 9748 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDESLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 9749 - protein, 289 aa, Coccidioides immitis RS
MASALAGPRFPPLPKTLLIISLKMYFTPSRTIDYIQGLLEPRNDIIRQENRSRLLLALIPDFLTIYPCSEAIKEFESNLAAPQDADTPPPLLLGAQDCFWDSLGPYTGEISPVCLRDMNVSIVELGHAERRAIFGETDQQVARKAAAAADQGLIPLVCIGEVSTLGPIVSEAIGRAVGECEAQIRPVLEALPRDAPVIFAYEPVWAIGKPQPARVDHVGAVVSGIRSVIERIDRHRKGEVRILYGGSAGPGLWGPGGLGKEVDGMFLGRFAHDIEGVRKVVREVEESLR

SEQ ID NO: 9750 - protein, 278 aa, Triticum aestivum
  misc_feature (189)..(189): Xaa can be any naturally occurring amino acid
  misc_feature (251)..(251): Xaa can be any naturally occurring amino acid
  misc_feature (263)..(263): Xaa can be any naturally occurring amino acid
  unsure (1)..(278): unsure at all Xaa locations
NKFVQKSRLVPVRNSRDIVDPRVRVLLSSHLSSHATVNARLQQCSVSLNSIGFAVIRKGCLRLRCYAIGDAGRRNDPLNENKNGPISQELNGSSASFTTVGAEITQETGDFFSSDAEGDPDKPTEGFSSIEDAINSLREGKFVIAVDDEKGDNEGDLIMAADQASPESIAFMIRNGSGIISVGMKEEDXLERLMLPMMSPVTEIGDISAAASTATVDARVGITTGVSAADRAKTILALASPDSKPSDLRRXGHIFPLKYRNGXLLKRAGHTEHRWICP

SEQ ID NO: 9751 - protein, 488 aa, Kineococcus radiotolerans SRS30216
MSTTQHEQDLVRAVPTGLFVGGGWREAEGGRTVDVEDPATGQVLVAVSDASVADGTAALDAAVAAAPAWARTPTRQRAEVLRRAFELITARADDFALLMTLEMGKPLAEARGEVAYGAEFFRWFSEEAPRIAGRYAQNPAGGSRLLTLKQPVGPVLAILPWNFPLAMGTRKIAPALAAGCTIVVKPATQTPLTTLLLAQVLAEAGVPDGVVNVVTTTSTAEVVEPLVRDPRLRKLTFTGSTPVGKKLVAQSAERLLRVSMELGGNAPFLVFDDADLDAAVEGAVAAKMRNTGEACTAANRFYVQRPVAEEFSRRLGERLGAMVVGRGTEDGVQVGPLIDARARDGVARRVSEAVDAGAQVLVGGSPVGERGYFYAPTVLTGVPAGSRLLTEETFGPVAPVVVFDEEAEGVALANDTEYGLVGYAFTRGLDRGFRVAEALETGMVGLNAGVISNAAAPFGGVKASGFGREGGAEGIEEYLETKYVGFPL

SEQ ID NO: 9752 - protein, 497 aa, Oryza sativa (japonica cultivar-group)
MKANYQGIWTTHETLFLEGEAKKPGADSKDARKDGSADRGVSRVGSDKSRSHGGLDSKKDVVIQRDGNNQNIAAQTFTFRELAAATKNFRQDCLLGEGGFGRVYKGRLETGQAVAVKQLDRNGLQGNREFLVEVLMLSLLHHTNLVNLIGYCADGDQRLLVYEFMPLGSLEDHLHDLPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPVQHSRSNSSTPRARNLAGWNEDRRSVRSPNHHSPDLRREAARSSRAEVSRTSSTGDSGRRSGLDDLDMTGSQMGSPAQTGRKRETPRTADRQRAIAEAKTWGENSRERKHPNGHGSFDSTNE

SEQ ID NO: 9753 - protein, 314 aa, Geobacter metallireducens GS-15
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 9754 - protein, 239 aa, Brassica napus
  misc_feature (11)..(11): Xaa can be any naturally occurring amino acid
  misc_feature (177)..(177): Xaa can be any naturally occurring amino acid
  unsure (1)..(239): unsure at all Xaa locations
MSSQICRSASXKAARSLLSSAKNARFFSEGRAIGAAGAVTASGKLPLYASNFARSSGSSKSWITGLLALPAAAFMVQDQEVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATXDPQKSEPGTIRGRSCLLLLGRDIIHGSDGPQDCQRMEINLWFKPQELVSYTNNAEKWIYGDN

SEQ ID NO: 9755 - protein, 383 aa, Oryza sativa
  misc_feature (103)..(103): Xaa can be any naturally occurring amino acid
  misc_feature (114)..(114): Xaa can be any naturally occurring amino acid
  misc_feature (169)..(169): Xaa can be any naturally occurring amino acid
  misc_feature (311)..(311): Xaa can be any naturally occurring amino acid
  misc_feature (369)..(369): Xaa can be any naturally occurring amino acid
  unsure (1)..(383): unsure at all Xaa locations
MASATLLKSSFLPKKSEWGATRQAAVPKPVSVSMVVRAGAYDDELVKTAKTIASPGRGILAMDESNATCGKRLASIGLENTEANRQAYRTLLVTAPGLGQYIXGAILFEETTVXSTVDSKKIVDILTEQKIVPGIKVDQGLVPLAGSNNESWCQGLDGLASREGAYYQXGRTVVSIPNGPSELAVKEAAWGLARYAAISQDNGLVPIVEPEILRDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQXPNPWHVSFSYARALQNTCLKTWGGQPENVKAAQDALLLRAKANSLAQLGKYTSDGRGXAEAKEGMFVKNYVY

SEQ ID NO: 9756 - protein, 147 aa, Thermoplasma volcanium GSS1
MDRTLVLLKPDAVKRRLVGKIIERFEEKGLKIVAMKFMQMTKDQAKTHYSVHQNKPFFNDLVNYITSGPIVAMILEGAHAIEIVRLMSGATDGSKAQPGTIRGDYSMGIEKNIIHASDSLEAYNHEMPIFFSDNEIIEWAYGDEVIY

SEQ ID NO: 9757 - protein, 122 aa, Triticum aestivum
  misc_feature (40)..(40): Xaa can be any naturally occurring amino acid
  misc_feature (117)..(117): Xaa can be any naturally occurring amino acid
  unsure (1)..(122): unsure at all Xaa locations
MAPTVMASSATSVAPFQGLKSTAGLPVSRRSNGASSAASXNGGRIRCMQVWPIEGIKKFETLSYLPPLSTEALLKQVDYLIRSKWVPCLEFSKVGFIFREHNASPGYYDGRYWTMWXLPMFG

SEQ ID NO: 9758 - protein, 431 aa, Thermus thermophilus HB8
MRIVPFGAAREVTGSAHLLLAGGRRVLLDCGMFQGKEEARNHAPFGFDPKEVDAVLLTHAHLDHVGRLPKLFREGYRGPVYATRATVLLMEIVLEDALKVMDEPFFGPEDVEEALGHLRPLEYGEWLRLGALSLAFGQAGHLPGSAFVVAQGEGRTLVYSGDLGNREKDVLPDPSLPPLADLVLAEGTYGDRPHRPYRETVREFLEILEKTLSQGGKVLIPTFAVERAQEILYVLYTHGHRLPRAPIYLDSPMAGRVLSLYPRLVRYFSEEVQAHFLQGKNPFRPAGLEVVEHTEASKALNRAPGPMVVLAGSGMLAGGRILHHLKHGLSDPRNALVFVGYQPQGGLGAEIIARPPAVRILGEEVPLRASVHTLGGFSGHAGQDELLDWLQGEPRVVLVHGEEEKLLALGKLLALRGQEVSLARFGEGVPV

SEQ ID NO: 9759 - protein, 325 aa, Mallomonas rasilis
SKVGINGFGRIGRLVARIMVNDPRTTLKAINTGADATYMAYQFKYDTVHGQWKGSLEVEGDDLIINGQRIKTVHARDPKEIGWGKLGVEYLCESTGVFLTADSAKPHVDGGVKKVIFSAPAKDKSPTIVMGVNDKDYTSDMTYVSCASCTTNGLAPMVKAIHDNFGIEEALMTTVHAMTSTQMVVDGSSKKDWRGGRAASANIIPSSTGAAKAVTAVIPSLKGKLTGMAFRVPVPDVSVVDLTCRLARDTTYEEICNKVKELSQGEMKGILGYTNEDLVSQDFVSSPISSVFDAKAGIMLNPRFVKLVAWYDNEWGYSKGEFQHT

SEQ ID NO: 9760 - protein, 449 aa, Pediococcus pentosaceus ATCC 25745
MSQENQRLPMEKVFRDPIHDYVYVQDQVILDLINTKEFQRLRRIHQLGTTSFVFHGAEHTRFSHSLGCYEVARRIVESFARNYPSKTPSDGLWNNDERLVTLCAALLHDIGHGAYSHTFEHIFNTDHEKFTTRIITDPQTEVNQVLRRISPDFPTKVASVISHDYPNPQVVQLISSQIDADRMDYLLRDSYYTGTNYGNFDLTRILRVMRPYEHGIAFQMSGIHAVEDFIVSRFQMYVQVYFHSVSRSMEVILGHLLKLANQLYQSERANHRQRNFQPHYLMPFFDENFTLDDYLKLDDGVLNTYFLQWVDDEDPILSDLAHRFLDRVPLKSARITDQTRSLLPELKQLVAEAGFDSEYYTAENDSYDLPYDAYDPTSKKPRTQIELMQSDGSLVELSTVSDLVRAISGKVSRDERFFFPKEMLIDSNESLFTDTFEAFQAHIKNNIIS

SEQ ID NO: 9761 - protein, 566 aa, Erwinia carotovora subsp. atroseptica SCRI1043
MVAVNDGVSAHPVWWKEAVFYQVYPRSFKDSDGDGIGDLKGLTEKLDYLKALGINAIWINPHYDSPNTDNGYDIRDYRKIMKEYGTMDDFDRLIAEMKKRDMRLMIDVVVNHTSDEHEWFVESKKSKDNPYRDYYIWRDGKDGTQPNNYPSFFGGSAWQKDNATQQYYLHYFGVQQPDLNWDNPKVREEVYDMLRFWIDKGVSGLRMDTVATFSKNPAFPDLTPKQLQNFAYTYTQGPNLHRYIQEMHQKVLAKYDVVSAGEIFGVPLEEAAPFIDQRRKELDMAFSFDLIRLDRAVEERWRRNDWTLSQFRQINNRLVDMAGQHGWNTFFLSNHDNPRAVSHFGDDRPEWRTRSAKALATLALTQRATPFIYQGDELGMTNYPFTSLSEFDDIEVKGFWQDFVETGKVKPDVFLENVKQTSRDNSRTPFQWSNTAQAGFTTGTPWFRINPNYKNINAEEQTQNPDSIFHFYRQLIELRHATPAFTYGTYQDLDPNNNEVLAYTRELNQQRYLVVVNFKEKPVHYVLPKTLSIKQSLLESGQKDKVEPNATTLELQPWQSGIYQLN

SEQ ID NO: 9762 - protein, 324 aa, Pavlova lutheri
SKVGINGFGRIGRLVFRIAMARDNMVVKHINSPMAPEYMKYLLSYDSAHGRYKGTVEVDAKGSLIVDGLEVTLTATRDPTEIPWGKRDVAYVCESTGAFTSTESCMLHVTSANPAKKVVISAPAKDAETPTLVVGVNAAEDYKTSMNVVSCASCTTNGLAPLVKHIDQTYGIAEGLMTTVHATTASQLTVDGSMKGSDWRAGRAAAANIIPSSTGAAKAVAKCYPASKGKLTGMAFRVPTIDVSVVDLTCRLVKSTTYDELKASVKAASEGSMKGILGYTEDQVVSQDFVGSEMSTTFDAGAGIMLNPNFVKLISWYDNEWGYS

SEQ ID NO: 9763 - protein, 459 aa, Bacteroides fragilis NCTC 9343
MKQTRGYLLLICIVSAMGGLLFGYDWVVIGGAKIFYEPYFGIENSAALRGWAMSSALIGCLAGALLSGIWSDKYGRKKMLVIASFLFALSAWGTGAVDHFSYFIFYRIVGGLGIGIASNISPVYIAEVSPAHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVNGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 9764 - protein, 375 aa, Arabidopsis thaliana
MFAQLAPSPSPSPANVSHFVHRRTFRQCTYAVSASLPTANSSRPPPIQANIIVGGKDLNLDVTRKDDSIGFKLEANEDEIDWMNLESDIRLWTRALRPVQWYPGHIMKTEKELREQLKLMDVVIEVRDARIPLSTTHPKMDAWLGNRKRILVLNREDMISNDDRNDWARYFAKQGIKVIFTNGKLGMGAMKLGRLAKSLAGDVNGKRREKGLLPRSVRAGIIGYPNVGKSSLINRLLKRKICAAAPRPGVTREMKWVKLGKDLDLLDSPGMLPMRIDDQAAAIKLAICDDIGEKAYDFTDVAGILVQMLARIPEVGAKALYNRYKIQLEGNCGKKFVKTLGLNLFGGDSHQAAFRILTDFRKGKFGYVSLERPPL

SEQ ID NO: 9765 - protein, 900 aa, Candida albicans SC5314
MPMDYLTPSTLPHPKLKRTNTGFTPNQIIALDAAIPESAKHIWYKYSQLKILDSHKRNGPEDEDNVKSVVDDPDRFEEEFVKHVETSLGRSMYNCDNLAAYQAASNTIRDALVIDWANTQQRQTIQDGKRVYYLSLEFLMGRAMDNALINLNSEQNTQKSLSDLGFNLEDVLDQEPDAALGNGGLGRLAACFVDSLSSKNYSGWGYGLNYQYGIFKQKIIDGYQIETPDYWLNYSNPWVIDRNEIQIPVDFYGYVYEEHDPNTGKVKKNWNGGERVLAVAADFPIPGFNTTNTNNLRLWNAKPTTEFDFSKFNAGDYQQSVAAQQRAESITSVLYPNDNFEKGKELRLKQQYFWVAASLHDIVRRFKKNHKSNWQKFPDQVAIQLNDTHPTLAVVELQRILVDLEGLDWDEAWSIVTKVFAYTNHTVMAEALEKWPVDLVGRLLPRHLEIIYDINYFFLKNVEHRYPNDRDLLRRVSIIEESPKSVRMAYLAIVGSHKVNGVAELHSELIKTTIFKDFVKVFGPDKFTNVTNGITPRRWLRQANPKLAALIAEKLEDPNYDYLTNLGKLKKLEAFVDDYEFLKRWDAIKFDNKRRLATLIKETTDVDVDPTVLFDVQVKRIHEYKRQQLNIFAVIYRYLHIKELLSKGVSIEEIKTKHHIPKASIFGGKAAPGYYMAKTIIHLINKVGDVINNDPEIGNLLKVVFIPDYNVSKAEIICPGSDLSNHISTAGTEASGTSNMKFALNGGLIIGTVDGANVEITREIGEENIFLFGNLAESVEEIRHRHVYEGVKVPESLQKVFHAIESGDFGSPEEFKPLIESIRDHGDYYLVTDDFDLFLEAHKKLEKVYGHHGGDEHDKSHMNEWVKKSVLSVANMGFFSSDRCIDEYAENIWNVEPSNV

SEQ ID NO: 9766 - protein, 589 aa, Shewanella sp. ANA-3
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTSVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTLVLMLLGRLRHHAWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASSAHQHDLAKLLDLSNKGKAELESLMRGDRENVS

SEQ ID NO: 9767 - protein, 273 aa, Pavlova lutheri
THGRFPGTVECDEANNILIVNGKKIKFYAAKSPNEVPWGEAGAHIVCESTGIFTVIDKASAHLQGGAKKVIISAPSADAPMFVMGVNHTSYTKDVNILSNASCTTNCLAPLAKIIHEEFGIVEGLMTTVHATTATQKTVDGPSGKDWRGGRGAGQNIIPSSTGAAKAVGKVLPALNGKLTGMAFRVPTPDVSVVDLTCRLSKQTTYDEIKKVIKAKCETPEYKGIMGYTEDEVVSQDFVHDSRSSIFDAGAGIMLTGDFVKLVSWYDNEWGYS

SEQ ID NO: 9768 - protein, 220 aa, Bacillus cereus ATCC 14579
MNLKQLAGEYAANFVNDGMKIGLGTGSTVYWTIQKLGERVKEGLSFQAVPTSKETEALAQQLNIPLISLNDVQSLDLTIDGADEIDSNLQLIKGGGGALLREKIVASSSKKLIIIADESKLVTHLGTFPLPIEIIPFSWKQTENKIQSLGCQTTLRLKNNETYITDNNNMIIDCIFPNHISNPVHLHTQLKMITGVVETGLFISMTSTAIIGTKNGIKKL

SEQ ID NO: 9769 - protein, 318 aa, Phytophthora palmivora
SKVGINGFGRIGRLVLRAAAKNPEINVVAVNGPFIATKYMEYMLKYDTVHGRFGGELSHDEQNIYVDGKAIRVFNEMNPANIKWGEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEEAVVSSDFIGDSHSSIFDAEAGIALTDDFVKLVSWYDNEWGYS

SEQ ID NO: 9770 - protein, 321 aa, Plectospira myriandra
SKVGINGFGRIGRLVARAAFANPNATVVAINDPFMSLDYMVYLFKYDSTHGPYQGTVEAKDGNLVIDGQVVRIFTAKNPAEIGWGEAGADYVCESTGVFTNTEACLAHVKGGAKKVIISAPPKDNTPMYVIGVNHTKYDGSAHVVSNASCTTNCLAPLAKVVHEKFGIVEGLMTTVHATTANQLTVDGPSKGGKDWRAGRGASANIIPASTGAAKAVGKVLPELNGKLTGMAFRVPVPDVSVVDLTVRLEKSATLAEIKAAIKEASENELKNILGYTEDDVVSQDFVTDKRSSIFDANACISLNDNFVKLVSWYDNEWGYS

SEQ ID NO: 9771 - protein, 349 aa, Actinobacillus pleuropneumoniae serovar 1 str. 4074
MMKMRAAVVAPQCDGTVEIVERDIPEIKNGEALVEVEYCGVCHTDLHVAAGDYGKKPGRILGHEGIGIVKSIAPDVTNLKVGDRVSIAWMFESCGSCEYCTTGRETLCRSVKNAGYTVDGGMATHCVVTADYAVKVPDGLDPAQASSITCAGVTTYKGIKVSGVRAGQWIAIYGAGGLGNLAVQYAKKVFGARVIAIDINDDKLAFAKEVGADLTINPLKEDSVQVIQEKVGGAHAAVVTAVSKVAFNAAVNCVRAGGRVVAIGLPPETMDLSIPRIVLDGIEIVGSLVGTRQDLAEAFQFGAEGLVVPLVQLRRLDEANDIFQEMRDGKIQGRMVIDMKKGCGCGCSH

SEQ ID NO: 9772 - protein, 266 aa, Oryza sativa
MTFGISYSLFRTFRSPPQGTKGDGENYMLNSKVNEELVAAAGVEEGDVVLEIGPGTGSLTAALLDAGATVFAVEKDKHMATLVNDRFGSTEQLKIIEEDITKFNVRSHFLPFLEEKSHHTRKYAKVVSNLPFNVSTEVVKLLLPMGDVFSVMVLLLQDETALRFADASIQTPEYRPINVFVNFYSEPEYKFKVERTNFFPQPKVNSAFNGKRKMLRKSLQHLCSSSEIEAALANIGLPVTVLLADTASARPIFSSRCTAFRLQLQQ

SEQ ID NO: 9773 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 9774 - protein, 306 aa, Triticum aestivum
MEGPVLPNLPNTRVAVVTGGNKGIGFEVCRQLASGGVTVVLTARDETRGGEAVERLNALGLSGVIFHRLEITDASSAATLAGFLKARFGKLDILVNNAAVGGVEYGQEFDTNEEKFGGMDFHQRVEWMLKNAREPIDSAKNSVQTNYYGTKHVIEALLPLLQSSSVGRIVNVSSNYGLLRHIGSEEVRQELNDVDNLTEGRLDELLEKFMKDFEAGALEPHGWPTKFSAYKVAKAAMNAYSRILARRHPELRVNCAHPGFVKTDMSMGSGVLTPEEGARNLVKVALLPDGGPTGAYFAMGEEAPFV

SEQ ID NO: 9775 - protein, 962 aa, Arabidopsis thaliana
MDTMRISGVSTGAEVLIQCNSLSSLVSRRCDDGKWRTRMFPARNRDLRPSPTRRSFLSVKSISSEPKAKVTDAVLDSEQEVFISSMNPFAPDAASVASSIKYHAEFTPLFSPEKFELPKAFFATAQSVRDALIMNWNATYEYYNRVNVKQAYYLSMEFLQGRALSNAVGNLGLNSAYGDALKRLGFDLESVASQEPDPALGNGGLGRLASCFLDSMATLNYPAWGYGLRYKYGLFKQRITKDGQEEAAEDWLELSNPWEIVRNDVSYPIKFYGKVVFGSDGKKRWIGGEDIVAVAYDVPIPGYKTKTTINLRLWSTKAPSEDFDLSSYNSGKHTEAAEALFNAEKICFVLYPGDESTEGKALRLKQQYTLCSASLQDIVARFETRSGGNVNWEEFPEKVAVQMNDTHPTLCIPELMRILMDLKGLSWEDAWKITQRTVAYTNHTVLPEALEKWSLELMEKLLPRHVEIIEKIDEELVRTIVSEYGTADPDLLEEKLKAMRILENVELPSAFADVIVKPVNKPVTAKDAQNGVKTEQEEEKTAGEEEEDEVIPEPTVEPPKMVRMANLAVVGGHAVNGVAEIHSEIVKQDVFNDFVQLWPEKFQNKTNGVTPRRWIRFCNPYLSDIITNWIGTEDWVLNTEKVAELRKFADNEDLQSEWRAAKKKNKLKVVSLIKERTGYTVSPDAMFDIQIKRIHEYKRQLLNILGIVYRYKKMKEMSASEREKAFVPRVCIFGGKAFATYVQAKRIVKFITDVASTINHDPEIGDLLKVIFVPDYNVSVAELLIPASELSQHISTAGMEASGTSNMKFSMNGCVLIGTLDGANVEIREEVGEENFFLFGAKADQIVNLRKERAEGKFVPDPTFEEVKKFVGSGVFGSNSYDELIGSLEGNEGFGRADYFLVGKDFPSYIECQEKVDEAYRDQKRWTRMSIMNTAGSFKFSSDRTIHEYAKDIWNIKQVELP

SEQ ID NO: 9776 - protein, 473 aa, Candidatus Blochmannia floridanus
MNVDYFISFINKNKVKFIDLRFTDIMGKEQHFTIPQSQIDNHFFENGKVFDGSSMVGWKNVHESDMILIPDLTNDHIIVDPFYQDTTVILRCDVLDPHSMQNYDKDPRYISKKSEKFLQDSGIADFAMFGPELEFFVFDDVRFKTSMSGCHVMIDDPEASWNSDKVYFYGNKGHRPKIKGGYSPVPPIDSSQNLRSMMSIMMEKMGLIVETHHHEVATAGQNEIITRFNSLTRKADEVQIYKYIVHNVSNKFGKTATFMPKPIIKDNGSGMHCHISLYKNKVNLFSGDQYGNLSEIALFYIGGILKHTKALNAITNPTTNSYKRLIPGYEAPTFLTYSLSNRSSAIRIPAIINNNPNLCRIEVRFPDPSANPYLAFPALLMAGIDGIINEIHPGNPVNKNLYTLSDLEKEHTLYTSQSLNESLQYLSEDYEFLIRNNVFSKNFIDSYILIHKKMDSLVRSVPHPMEFELYYSI

SEQ ID NO: 9777 - protein, 274 aa, Bradyrhizobium sp. BTAi1
MPTIIITGASDGIGAAAARQLKANGHNVVLVGRSKAKTEALARELNAPFHLADYTQLADVQRLAGELLDHGRIDVLANNAGGIMGQRALTSDGFEMTFQVNHLAPFLLTRLLLERLIASRAKVIQTASAAANIFGRNFDVDDLNNERGYTPQGAYGYGKLENILFTRELDRRHRADGIAAVSFHPGIVRSNFANDTTHLMRLFYHSPLKYLITISPERSAQRLTWLAESAPGTDWQLGECYSGRKPMPVAFKDDGTAARRLWEHSETFVKPWLG

SEQ ID NO: 9778 - protein, 1576 aa, Aspergillus nidulans FGSC A4
MARSRQPTRFSSEAPSESSSSTSPERAADDDTDFFTLQANDSQSSIGAGNPRDSHIQNDPETVLPPIAYLPPEILISIFSKLSSPRDLLSCLLKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQPEQASPSSTGAFLLSGYCIGSGYTGSPILLIIICQPPIVGVPSGPVRPPLLPASVLSRLLRTLLKLKLSLSRDFVRQAQAPEPGVKTMDQTKPPRRNPLAFTPWPVTLITAVVYLAFVIPLLVIHHVVPSAPTSSPDGLNITEAWNDLQVLTAGYRPYNSRQNDKIHDWLLHRINEILGAAPPATTDEKKPDVFVFDDTRSNLTFARDNLAVYFEGTNILVYIRGEDDDQEQWWELPEGSPKGKGGVLVNAHYDSVSTGYGATDDGVGVVTCLQLVKYFTTPKNAPRKGLVVLFNNGEEDFLNGARVYSQHPLSRFPHTFLNLEGAGAGGRAVLFRSSDAEVAASYMRSKHPFGSVLGSDGFKAGLIRSQTDYVVFEGDMGLRGLDVAFLEPRARYHTDQDDTRHTSKDSLWHMLSTAVATTEDLVSDTSDRFDGPARNDHKIASGTGHQAVWFDLYGSTFVLFRLHTLFALSVTLLVVAPIVLLLTSIILTKVDKMYLFRTSIRPEGSLEVLPLYGDRGVIRYPFLLGIPTAVTIGLAYLLTKFNPYIVHSSQYAVWSMMVSVWIFLAWFVSRVADFARPSAFHRVYTLTWTFVVMWVLQVIATVYQDRWALGGSYFIFFAYAGTFLATWISYLELFALPRKSEYANHLRPVSRHASSHSSRRGLSEEDEEDEDEAPTESTSLLGSRQRTTFANYVRVNADTADLSDSEEHTQDVNVYGLEQRWSASLPKWLWLLQFLLAAPIVLILVGPIALLLTGSLHQTGQDGSSSLFIYIAIVALTTLLLSPMLPFVHRCTYHIPLFMLAVFAGTLIYNLVAFPFSDSNRLKLFFIQEVDLDTGLNTASLTGVQPFVHDVAVGLPSAAGQNVTCGPFGDRFKCSWTGIPPHVLTEDKPVEEWLSFEVSRSIDKPRHAQLQISGQNTRACKVVFDSPIKNFHVAGSAYDPRFPHTYAKGIKEIRLWSRVWDNTWTVDVEWFNPDSSSDHSKTSGSLTGQVVCLWSDYNQPGTIPALDEVRQYGPAWIGVSKLADGLVEGRKSFEIA

SEQ ID NO: 9779 - protein, 319 aa, Agrobacterium tumefaciens str. C58
MRTIYRYDICLRLKPIAPTPVKERLLPLTGLFRRPCFQQTGETPMYDVSANGANIPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWDD

SEQ ID NO: 9780 - protein, 117 aa, Brassica napus
  misc_feature (7)..(7): Xaa can be any naturally occurring amino acid
  misc_feature (15)..(15): Xaa can be any naturally occurring amino acid
  misc_feature (17)..(17): Xaa can be any naturally occurring amino acid
  misc_feature (21)..(21): Xaa can be any naturally occurring amino acid
  misc_feature (29)..(29): Xaa can be any naturally occurring amino acid
  misc_feature (32)..(33): Xaa can be any naturally occurring amino acid
  misc_feature (41)..(41): Xaa can be any naturally occurring amino acid
  misc_feature (44)..(47): Xaa can be any naturally occurring amino acid
  misc_feature (49)..(49): Xaa can be any naturally occurring amino acid
  misc_feature (54)..(54): Xaa can be any naturally occurring amino acid
  misc_feature (57)..(60): Xaa can be any naturally occurring amino acid
  misc_feature (65)..(65): Xaa can be any naturally occurring amino acid
  misc_feature (71)..(71): Xaa can be any naturally occurring amino acid
  misc_feature (78)..(78): Xaa can be any naturally occurring amino acid
  misc_feature (81)..(81): Xaa can be any naturally occurring amino acid
  misc_feature (83)..(83): Xaa can be any naturally occurring amino acid
  unsure (1)..(117): unsure at all Xaa locations
GVFGSNXYDELTGSXQXNEAXGRADYFLXPAXXSPSYVECXEKXXXXYXDQKRXTRXXXXNTAGXPKFSSXRTIHEYXRRXMXILNKWNFHELALTTRSPIKNPFMFFTFSKSQCIS

SEQ ID NO: 9781 - protein, 582 aa, Triticum aestivum
MAGGITCGSLLQKLQLVWDEVGESDEDRDKVLYQLDQECLDVYKRKVDQATNSRDLLIQALDDSKIELARLLSALGEKAVARTPEKTSGTIKQQLAAIAPTLEQLNKKKNERKREFVSVQSQIDQICGEIAGTTEVGEQVATPQVNEDDLTLERLEDFRSQLQELEKEKSNRLEKVLEYVSMVHDLCTVLGMDFLSTVTEVHPSLDDSIADNCKSISDETLSKLDKTVATLHEDKKLRLSKLQELVGQLYDLWDLMDAPTQERSMFDHVTCNRSASVDEVPAPGALALDLIEQAETEVQRLDQLKYSKMKEIAFKKQTELEDIYAGAHTVIDTAAAHMKLLALIEAGNIEPTELIADIEGQIAKAKEEALSRKDILDKVEKWMSACEEESWLEDYNRDANRYNSSRGAHLNLKRAEKARILVSKIPALVETLVAKTRAWEESRGLSFMYDGVPLLAMLDEYVMLREEREEDKKRMKEQKRYVEQKLNTDHEGPFGSRVSPNRPATAKKIPGPKSNGTSMNGTPPSRRLSISGQQNGRSGGKDSKRDSMTKAVSSPGNGAAAAAAKEDASSHISGTDLAPTTP

SEQ ID NO: 9782 - protein, 286 aa, Nostoc punctiforme PCC 73102
MIRPRKVFAQHWLKSEKALDAIIKAAECTESDRSPKGDCILEIGPGTGILTRRLLPLVQSLIAVEIDRDLCQLLSKQLGKTENFLLLQGDFLTLDLPSYLVAFPNFQKPNKVVANIPYNITGPIIEKLLGTIANPNPEPFDSIVLLVQKEVAERLYAKPGSKTFGALSVRVQYLAECELICTVPASAFHPAPKVDSAVVRLRPRKIEIPALNPRQLETFLKLGFGAKRKMLRNNLQSVIERDRLSHLLEQLKINPQARAEDISVQQWVILANELAVASGEQGVGNR

SEQ ID NO: 9783 - protein, 337 aa, Triticum aestivum
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 9784 - protein, 200 aa, Triticum aestivum
MAAKAGQRPVMVVVVIMAVMAARVGADMDADRSECAEQLVGLAPCLQYVQGQARSPAPDCCGGLSQVLDKSPKCLCVLVKDKDDPNLGIKINASLGLALPSDCGNTKANVSHCPQLLHLPPNSKDAAIFSPGGDKGTAAAPANDNTVSMVNSRAQQATSAGAASSTATAGVALAALLAGYLARILRGDFLATAASFKSIW

SEQ ID NO: 9785 - protein, 394 aa, Nicotiana tabacum
MTTKNRQIKNFTSNFGPQHPAAHGVSRSVLEMNGEVVERAEPHIGLLHRGTEKLIEYKTYLQALPYSDRSDYVSMMAQEHAHSSAVERLLNCEVPLRAQYIRVLFREITRISNHSLALTTHAMDVGASTPFLWAFEEREKLLEFYERVSGARMHASFIRPGGVAQDLPLGLCIDIDSFTQQFASRIDELEEMSTGNRIWKQRLVDIGTVTAQQAKDWGFSGVMLRGSGVCWDLRKAAPYDVHDQLDPDIPVGTRGDRYDRYCIRIEEMRQSVRIIVQCLNQMPSGMIKADDRKLCPPSRSRMKLSMESSIHHFEPYTEGFSVPAPSTYTAVEAPKGEFGVFLVSNGSNRPYRRKIRAPGFAHSQGLDSMSKHHMPADVVTIIGTQDIVSGEVDR

SEQ ID NO: 9786 - protein, 320 aa, Photobacterium sp. SKA34
MKDHTVRLALIQLLSDGEFHSGEVLGQTLGMTRAAIAKQIQVIQQWGLDIFRVQGKGYCLASAIDLLNQQQILAKVKCPHLDLIPVIDSTNQYLLDRVGQLPSGSVCLAEYQEAGRGRRGRQWVSPFGSNLYLSIYWRLEAGMAAAMGLSLVVGVAIAETLQKLGADDVRVKWPNDIYYQDKKLAGILVEMTGQAGDAAHLVIGMGLNINMPLAEQSEITQAWTTLSQACDSLPSRNILAATLISHLNQTLCDYEYQGLVGFVERWNKIDNFLNRPVKLLIGERTIEGTARGIDAQGALLLETDTGITPYIGGEISLRGC

SEQ ID NO: 9787 - protein, 521 aa, Yarrowia lipolytica CLIB122
MLLPLLFAGCVFFFLHQRLNYYRRKQRAYEKWLASGKFGAGQKVADIQVQNNFLRNPFGLVQFVEFLNRTKGAFFVDFVNQNFQKYGYILPTRTLGKVNIITCDPELIKTVLATNFKDWSIGIRRKAMFPVLGNAIFSVEGDQWTHSRAMLRPQFARDSIANVADLERHVTRLINVFRGYGVQSFDCQKYFFQFTLDSASDFLFGESTNSLSVQDDKSESEDTGESFNVLTQQGENAESFAQAFKVAFTFTAIRLRLQQFYWLLRPSNKKYRDSIDTVHRLVDGYVERALENKEDTDRYIISNQLVKVCDDKKYIRDQLLGILLAGRNTTAAVLAWIMYESARRPEIWNKMRQEVTDTFSDGPVTSDELRKCVYVRSVINEALRVYPSVPMNQRVAVRDTFLPTGGGPDGSLPLYCPRGTKVAYSVFALHMREDFYGSDSHIFRPERWNEGVGKGWQYLPFNGGPRICLGQQFALMEASYTLVRLVQEFDTVELDMEVVDPPPKMSSFSMVHRDGVRIRVK

SEQ ID NO: 9788 - protein, 321 aa, Prymnesium parvum
SKVGINGFGRIGRLVCRAAMMKEGAEVVAVNDPFCDVKYAAYLFKYDSTHGIYKGTVECDEASQMLIVDGKKIAFLAVKNPTEVPWGEKGADIVCESTGIFTVIEKASMHLQGGAKKVIISAPSADAPMFVMGVNHTDYKKDINILSNASCTTNCLAPLAKIIHDEFGIVEGLMTTVHATTATQKTVDGPSGKDWRGGRGAGQNIIPSSTGAAKAVGKVIPSLNGKLTGMAFRVPTPDVSVVDLTVKLGKETTYDAIKALVKAKAATPEWKGIMGYTEDEVVSTDFQGDSHSSIFDAKAGIMLTPTFVKLVSWYDNEWGYS

SEQ ID NO: 9789 - protein, 339 aa, Oryza sativa
  misc_feature (96)..(96): Xaa can be any naturally occurring amino acid
  unsure (1)..(339): unsure at all Xaa locations
MDHEADAYRTDLMTITRYVLNEQSRNPEARGDLTILLSHIVLGCKFVASAVNKAGLAKLIGLAGETNVQAKEQKKLDVLSNEVFVKALVSSGRTCXLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNERNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 9790 - protein, 318 aa, Pythium graminicola
SKVGINGFGRIGRLVLRAAQTNPLINVVAINDPFIPTKYMEYMLRYDTVHGVFNGTVSHDEENLIVNGKKVRVFNEMKPTDIKWSQADVQYVVESTGVFTTTEKASAHLQNGVEKVVISAPSADAPMFVVGVNEDKYKSDMHVVSNASCTTNCLAPLAKVVNDTFGIKEGLMTTVHAVTATQLTVDGPSKKDWRGGRGACFNIIPSSTGAAKAVGKVIPSLNGKLTGMSFRVPTADVSVVDLTCRLEKKASYDEIKQVIKAASENELKGILGYTDELVVSSDFVGDSRPSIFDAQAGIALTDDFVKLVSWYDNEWGYS

SEQ ID NO: 9791 - protein, 150 aa, Wolbachia persica
SDEDVFKKLNKVIDTNITPVVCIGESLDNRQSGRLKQVLATQLSLMLENLSVEQLAKVVIAYEPVWAIGTGVVASLEQIQETHQFIRSLLSKVGESLAKNIKIVYGGSLKAENANDILSLPDVDGGLIGGASLKAAEFNEIINQANKICT

SEQ ID NO: 9792 - protein, 321 aa, Thraustotheca clavata
SKVGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLGGGCKKVVISAPPKGSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLATIKAAVKEASEGSMAGILGYTEDEVVSQDFVSDKRSSIFDANVCIALNDSFVKLVSWYDNEWGYS

SEQ ID NO: 9793 - protein, 479 aa, Sinorhizobium meliloti
MRRNRKVKILATLGPASADEQMIQKLHEAGADLFRINMSHASHEVMRTLIERIRVVEARCGRPIGILADLQGPKLRVGKFAEGKVELKIGQTFTLDNRDVPGDSRRVYLPHPEILEAVKPGHRLLIDDGKLHLRAEKTDGKSIVTTVVSGTRISDRKGVSLPDTLLGVGALTDKDRVDLDAVLATGEVDWVALSFIQRPEDLAEVRKIARGRVGLMSKIEKPQAIERIDEIIELSDALMVARGDLGVEMPLESVPGLQKQLTRACRRAGKPVVVATQMLESMISSPVPTRAEVSDVATAVFEGADAVMLSAESASGEYPVEAVSTMASIASNVERDPHYPGIIYAQRTPPEATGADAISLAAHQIAETLKLAAIVTYTSSGTTGLRAARERPQVPVIALSPIVQTARRLSVVWGLHCVVTEDATDLDDMVNRACRIVSTEGFGKPGDRIIVTAGVPLGTPGATNMLRIAYIGSDGQSGI

SEQ ID NO: 9794 - protein, 1118 aa, Hordeum vulgare subsp. spontaneum
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKHRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 9795 - protein, 1118 aa, Hordeum vulgare subsp. vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKRRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 9796 - protein, 837 aa, Shewanella sp. ANA-3
MSHNSELSPNTSGVPPKKRATKAAPSKPKATLEPCEPCDALPATFNRHVRYGLSRGEVAHGELFQALALSVKEQMLDEWRETRIKDSCYDNKQVAYLSLEFLMGRALGNALLNLDLEQDSREALSQYSVSLEELEEAEHDAGLGNGGLGRLAACFLDSCASMDLSVTGYGIRYEYGMFAQKIVDGYQVERPDRWLREGNPWEVRVPHHNVTVKFFGHTESYVDKQGRRHMIWVDTQDVLAVAYDMPVPGYRNGRVNSLRLWKAEATDDFDLAEFNQGDYTEAVACKNLAEQITMVLYPNDASENGKELRLRQQYFLSSASLQAILKRWVHHHGHDFSEFAAKNVIQLNDTHPSIAVPELMRLLVDEYGLEWDAAWAITSHTMAYTNHTLLPEALERWPVRMMALMLPRILEIIYEINARYLDLVAHHWPGDGAKLASMSIIQDGPDPHVRMAYLAIVASFSVNGVAALHTQLLKSGLFKDFYSLWPEKFNNRTNGVTPRRWLAHCNPALAKLLTSHLGKGWVTDLSQLTALNALTQDASFIQKWREVKQANKVQLAKMIAKECGVEFDPAMLFDVQVKRIHEYKRQLLNILHVIHLYHQIQQGHTEHLVPRCVLIGGKAAPGYFMAKLIIKLASNVAHMVNCDPVVAPYLRFAFLPNYNVSAMEKICPGTDVSEQISTAGKEASGTGNMKFMMNGALTIGTLDGANIEMLEEVGEDNFFLFGLNAEQVTQMRCDYQPQRIIAESHALSEVMALLKSGHFNLLEPGIFDPIIASIESADDQWMTAADFDSYRLAQEAVAKAYKDPKKWTQMSIRNTAASGRFSSDVTIAGYRDDIWKL

SEQ ID NO: 9797 - protein, 632 aa, Schizosaccharomyces pombe
MDKDIGSAVAELQVCSTHYAMTIVSCGFHSPQSLMNADLQHCLLADQNYLLNNSNKNKGSIIEENTRKPFQSARNLQTSLKTHPESAITRYGLGYAGFGNGWTALKPKILFPSQKRRVKGRFTFPFSRRSNLAQSKLPVDLVPIRLEIDADRYKLRDSFTWNLYDKCISLDQFAEQICIDYDIPLHNVHIVQNISKSIQAQINDYEPRKAQSNLSFVSDVSSSTSETVYAHEPSDSLAKASKQQIPTVQNDLRILIKLDITIGRLNLIDQFEWNLFAPESSAEEFATVMCLDLGLSGEFCTAVAHSIREQCQMYIKYLSLIGYLFDGSEIEDEEVRSYILPPLKNTLRFSDMESSSFAPMIYELNDAEMERQDRGYDREARRMRRRQGRAKHGIMLPDLRDIPKIHRSLFPSSSVPSDDDFMHALSLSTNSDGETLNEINTNNPEREHLIVRLKVDSQKLKIIVEQSQTLTLNNFQQRKLTPLPNSMSFDSLNEFESERNTPSTYGQNISPLPQFSSPSLSSDAFLTNSNSSESALVHMQKLNLPDFTPSWVKRCVIETFAKFPNDRFNVIVKPALNPAERMTVRICCHDCINEYFTAGPGFTFGNFHIHLLSSSHQQKKEVRMNTVLDRNT

SEQ ID NO: 9798 - protein, 482 aa, Actinobacillus pleuropneumoniae serovar 1 str. 4074
MKINPLEGSPTMSVKRVFDLIKDNDIKFVMLKFTDIKGKEHGVSLPVSLIGDDLEDLFEEGKMFDGSSVEGWKAINKADMLLMPIAETAVVDPFARIPTLTLRCSIYDPNTMQSYDRDPRSIAIRAENYLKSTGIADSVMFGPEPEFFLFDDVRYNIGMNNVSYKIDDIEAAWNTNRKYEDGNTGYRPLKKGGYCAVAPIDSAHDIRSEMCLILEEMGLVVEAHHHEVATAGQNEIATKFNSLTLKADETQIYKYVVQNVALEHGKTACFMPKPFAGDNGSGMHCNMSLSKDGKNVFMGDKYAGLSETALYYIGGIIKHAKALNAFTNPSTNSYKRLVPGFEAPVLLAYSASNRSASIRIPAVTSPKATRVEARFPDPLANPYLCFAALLMAGLDGVVNKIHPGDAMDKNLYDLPPEELKEIPAVATSLEEALDSLAADYEFLTQGGVFTKEFVEAYINIRRKEVERLNMTPHPVEFEMYYA

SEQ ID NO: 9799 - protein, 144 aa, Triticum aestivum
MAHMRVVHRDEEGHKVAEKVPVPETRRPDTARHVERKLEEQGLHRLERHPANAPRGVGIGAPPPKSGRGGKYTWEGPEGLVDSELDPAPAAIDRNDPNYEEEGEQDEVAEEVVVGEVEVAKVAQARAGVARVEVAPPLLHDHQQ

SEQ ID NO: 9800 - protein, 558 aa, Escherichia coli O157:H7 EDL933
MHHATPLITTIVGGLVLAFILGMLANKLRISPLVGYLLAGVLAGPFTPGFVADTKLAPELAELGVILLMFGVGLHFSLKDLMAVKAIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLILIQQPLAVLATLAIILFGKSLAAFFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVAYITERGANQVVMGEREIARTMLELLETPPAGEVVTG

SEQ ID NO: 9801 - protein, 399 aa, Pseudomonas fluorescens PfO-1
MSGNRGVVYLGAGKVEVQKIDYPKMQDPRGRKIEHGVILRVVSTNICGSDQHMVRGRTTAQVGLVLGHEITGEVIEKGSDVESLKIGDLVSVPFNVACGRCRSCKEQHTGVCLTVNPARAGGAYGYVDMGDWTGGQAEYVLVPYADFNLLKLPDRDKAMEKIRDLTCLSDILPTGYHGAVTAGVGPGSTVYIAGAGPVGLAAAASARLLGAAVVIVGDVNTIRLAHAKAQGFEIVDLSKDTPLHEQIAALLGEPEVDCAVDCVGFEARGHGHDGVKSEAPATVLNSLMGVVRVAGKIGIPGLYVTEDPGAVDAAAKMGSLSIRFGLGWAKSHSFHTGQTPVMKYNRQLMQAIMWDRINIAEVVGVQVISLDQAPEGYGEFDAGVPKKFVIDPHKLFSAA

SEQ ID NO: 9802 - protein, 278 aa, Baeomyces rufus
  misc_feature (1)..(2): Xaa can be any naturally occurring amino acid
  unsure (1)..(278): unsure at all Xaa locations
XXHGAVKVVAVNDPFIEPHYAAYMLKYDSTHGQFKGEITVDGSDLIVNGQRVKFYTERDPANIPWKDTGAYYIVESTGVFTTTEKAKAHLKGGAKKVVISAPSADAPMYVMGVNEKTYKSDIEIISNASCTTNCLAPLAKVINDEFGIVEGLMTTIHSYTATQKTVDGPSAKDWRGGRSAAQNIIPSSTGAAKAVGKVIPELNGKLTGMSMRVPTSNVSVVDLTCRLEKPASYDQIKATIRKASEGSLKGIMAYTEDDIVSTDLNGDSHSSIFDAKAG

SEQ ID NO: 9803 - protein, 143 aa, Arabidopsis thaliana
  misc_feature (124)..(124): Xaa can be any naturally occurring amino acid
  unsure (1)..(143): unsure at all Xaa locations
RTLASSMLSSATMVASPAQATMVAPFNGLKSSAAFPANRIANTYITSIISSCVTVNCMQVWPPIGKTKFETLSYLPDLTDSKLAKEVDYLIRSKWIPCVEFDLKHGFVYREYCNSPGYYDGRYXTMSNLPLFGCTDSAQLLNE

SEQ ID NO: 9804 - protein, 646 aa, Vibrio angustum S14
MTGYFLQAFIYLVAAVIAVPLAKRLGLGSVLGYLIAGVVIGPVIGLVGSETTTIQHFAEFGVVMMLFVVGLELEPKMLWGMRHRLLGLGGLQVVVTALTVMGIAHLFDIAWSYALAIGLIFSLSSTAIVLQTFSEKGLSKTEGGKSAFSVLLFQDIAVIPMLALIPLLAVPELVAKSQAVVAKAAEHHDDLSLVAGLPGWTYAIVIILAIVGVVVGGHYLSRPLFRFVASSGLREIFTATALMLVIGIAALMSLVGLSPALGTFLAGVVLANSEFRHELESNIEPFKGLLLGLFFITVGAGIDFNVLFDQFGTVIGLTIGVMLVKFIVLLVLSFIFKVKGSDRWLFALSLAQAGEFGFVLLSYTVQNNVLPESMSQTLSLVVALSMFLTPGLFILYDRVILPRFCEAKNEREADEIDEQGKVIIAGIGRFGQIVNRLLASNGVKTVVLDHSVTQIDNLRQINIKSFFGDATRHDLLHTAGIEDAKLFIVAIDDKERATELVHYIKQTYPQVRVLARAYDRGHHYSLRCAGADYVISETYRSALALGTEALKNLGVHPFRAEQQKATFVETEARSKEKLYHTWLESTEEDRFNTSYVELFNQLESTLSDVMKQERTDKHTKSERGWTPPPKVFNDEVEQDLVEKHDH

SEQ ID NO: 9805 - protein, 278 aa, Cladonia bellidiflora
VEHGAVKVVAVNDPFIEPHYAAYMLKYDSQHGQFKGTIEVEGSDLIVNGQKVKFYTEKDPSAIPWKDTGAYYIVESTGVFTTTDKAKAHLKGGAKKVVISAPSADAPMFVMGVNEKTYKSDIEVISNASCTTNCLAPLAKVMHDNFTIIEGLMTTIHSYTATQKTVDGPSAKDWRGGRTAAQNIIPSSTGAAKAVGKVIPDLNGKLTGMSMRVPTSNVSVVDLTCRIEKSVTYDEIKEAMKKASAGELEGIMAYSEDDLVSTDLNGDNHSCIFDAKAG

SEQ ID NO: 9806 - protein, 395 aa, Crocosphaera watsonii WH 8501
MIQLANRVTQVTPSLTLAITAKAKEMKAQGVDICSFSSGEPDFDTPQYIKDAAVSALDQGKTKYGAVAGEPGLREAIARKLNNDSQLNYSPNNVIVTNGGKHSLFNLMLALIEPGDEVIIPAPYWLSYPEMVKLAQGNPIIVDTTAETDYKITPEQLRQAITSKTKLFVLNSPSNPTGTVYNPAEIKALAEVIVEHNLWVVSDEIYEKILYDGVVHISIGSLGEEILKRTIISNGFAKSYSMTGWRIGYLAGPEPLIKAVSTIQSHSTSNVCTFAQYGAIAALESPKSPPCLQTMRDAFSQRRQVILEKIRAIPQLSCPTPMGSFYVFVDISKTGLNSLEFCDQLLEKQQVAAIPGKAFGADHCIRLSYATDLASIEKGMDRIERFVQETKVNQL

SEQ ID NO: 9807 - protein, 278 aa, Heterodea muelleri
  misc_feature (275)..(275): Xaa can be any naturally occurring amino acid
  misc_feature (277)..(277): Xaa can be any naturally occurring amino acid
  unsure (1)..(278): unsure at all Xaa locations
VEHGDVKVVAVNDPFIEPHYAAYMLKYDSQHGQFKGTIEVEGSDLIVNGQKVKFYTEKDPSAIPWKDTGAYYVVESTGVFTTTEKAKAHLKGGAKKVVISAPSADAPMFVMGVNNESYKSDIEIISNASCTTNCLAPLAKVIHDNFTIIEGLMTTIHSYTATQKTVDGPSAKDWRGGRAAAQNIIPSSTGAAKAVGKVIPELNGKLTGMSMRVPTSNVSVVDLTCRIEKSVTYDEIKEAIKKASSGELKGIMSYSEDDLVSSDLNGDNHSCIFDXKXG

SEQ ID NO: 9808 - protein, 322 aa, Escherichia coli
MAKRNNDMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGKALTEIFTQAKARQMIICADMIKPRLNETLDDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 9809 - protein, 421 aa, Symbiobacterium thermophilum IAM 14863
MKEYIFRDPIHGNIAVKDETILRLIQSPEFQRLRRIRQLGTSFISYPGAEHTRFAHSLGVYHLMGRVLRHLVEHRVEIGEEEQAMARAAALLHDIGHGPFSHLFEKVTGMNHEAWVARIITSPESTVAHILAERDPAWPARVASFIRGVWEGRPFLKELIASQLDVDRMDYLLRDSRMCGVTYGQFDLERLIQTVTVVDDHIALTDKGITSAEEFLLARYFMYWNVYFHKATRSSEVLLELALRRAVALVRGGEQAALGFLPPALEPVLAGEELSLDQYVALDETDVLYAIKRWTAAPDPVLADLSGRFLHRRLFAGIRLDGGLDPEQEEGVRRALRAAGFDPDYYYQIDRAASATYQYYVAQDAGPTPIKILLSWTDPPELREMTEVSQVLRGIATQPVSRSFLFVPREAAERVRAAVMR

SEQ ID NO: 9810 - protein, 639 aa, Zea mays
MSLSCWRVRFPGADVREAGRGREGMQRSRKALLRRTAAAQVQSAVAEAAGNGRKRRLYGFSVSLVVTLWVAVLLLHSLVGHGDGQRDGGGSGVDITFIEPALNGGPVNSAVQEVHGENLAVPGDTCVGSVENAVLPEDTLVQAAQLCSNDEARSENTEALTKNNQVELSGDQCGYLPQPDFDSGVQPGEKVESEDLPRPPRLSRVAPPDLDEFKTRAIAERGPGISSQPGNVIHRREPSGKLYNYAAASKGAKVLDFNKEAKGASNILDKDKDKYLRNACSAEGKFVIIELSEETLVDTIAIANFEHYSSNPKEFELLSSLTYPTENWETLGRFTAANARLAQNFTFLEPKWARYLKLNLVSHYGSEFYCTLSMLEVYGMDAVEKMLENLIPVEHKKTEPGGKLKEPIEQIPLKESAGGKESSQEPLDEDEFELEDGKPNGHGDPSKNGASDPVSETRTLQAGRIPGDTVLKVLMQKVQSLDVSFSVLERYLVELNNRYGQIFKDFDSDIDSKDALLEKIKTELKNLESSKDSIMNEIEGIISWKVVASSQLNQLVLDNALLRSEFETFRQKQADMENRSLAVIFLSFVFACLALAKLSIGIMSRFCRFYDFEKFHNVRSGWLVLLLSSCIISTILIIQ

SEQ ID NO: 9811 - protein, 582 aa, Laceyella sacchari
MLIEALFHETRVPYACPENLHSLRVRLRAGKGEIARCLVLHADRYELLDSCFQQTEAEWMASDQRFDYFEALLECTAKRLQYVFLLEGKKGERVYFGESGVSKERNRAGVFQYAYIHESALFVTPEWARDAVVYQIFPDRFANGDKENDPPRTEDWSKDARPGRDSFYGGDLEGVIHSLPYLRKLGVNALYFTPIFASPSNHKYDTADYLRIDPQFGNLDTFKRLIREAHRHGMRIILDAVFNHSGDRFFAFRDVLEKGADSQYRDWFFIEQFPVVQTPQPNYETFAVNVPVMPKLRTENREVKEYLFQVVRYWTEMGIDGWRLDVANEVDHAFWRDFRSFVKMLNPEALIIGEVWHNAVKWLEGDQFDSVMNYLFRDCVYRFFAEQTSDASEFDAELTTARISYPDQALQVAWNLLDSHDTERFLTSCGEKEERFRLAVLFQMTYVGTPLIYYGDEIGMTGETDPDCRRPMLWDKEEQNQALFSYYQRLIRIRRSCAPLRRGSFRTWLADPGSPVYAFVRSWQGENAGIVLNNSDSWQNVSLPLDTWAKRNWTDLLTGEKGQASGNRMELILSPYQGIVLV

SEQ ID NO: 9812 - protein, 586 aa, Anoxybacillus flavithermus
MLKEAVYHRPTDQFAYAYDDKTLHIRLRTKKSDVHAVSLLHGDPYCWEDRQWQFTKTEMTKSGSDALFDYWWVAISPPYRRLRYGFELVSGNERCVYTEKGFFHEAPIDDIAYYFCFPFLNRIDVFHAPTWVKDTVWYQIFPERFANGDPSLNPKGTIPWGSADPTPTSFFGGDFAGIMERLDYLVELGINGIYFTPIFKASSNHKYDTIDYFEIDPQFGDKPTFKRLVERCHQKGIRVMLDAVFNHSGHFFAPFQDVLKHGEKSKYKDWFHIHEFPLQTEPLPNYDTFAFVPTMPKLNTENQEVKQYLLDVATYWIREFDIDGWRLDVANEVDHQFWREFRQAVKAVKQDVYILGEIWHDAMPWLRGDQFDAVMNYPFTNGVLRYFAKSEMKASEFAHSITNVLHSYPNNVNEVAFHLLGSHDTPRILTECGENKEKVKLMFTFQFSFTGTPCIYYGDEIGLTGGQDPLCRKCMVWEEEKQDLELFAHVQKLISLRRKYRSLSRGELHFLETNDETNHLVYTKTYEQETVIFLLNNSNRKLDITLPLSVKRKKLTDLWTNKQFVSEENEWTVTLAPYGFLMFLVE

SEQ ID NO: 9813 - protein, 279 aa, Dehalococcoides sp. BAV1
MRTTISQLKEMKQNKQKIAILTAYDYPTAQILDKAGIPAILVGDSLGMVVLGYDSTVSVTMEDMLHHLKAVVRGSQKALIIADMPFMTYHLSPEQALLNAGRFIQEGGAQAVKLEGGVNVADKVKRIVDCGIPVMGHIGLTPQSVNQLSGFKVQGKTLATALSLIEDAKALEKAGAFAIVLETMPAELAAIITAGISIPTIGIGAGEECDGQVQVISDMLGMFTDFIPKHTKRYADLNGIITKAVSEYAAEVTKGAFPTLKESFTLDKKVLEELKKCVL

SEQ ID NO: 9814 - protein, 470 aa, Erwinia carotovora subsp. atroseptica SCRI1043
MKKTKIVCTIGPKTESEEMLGNLLSAGMNVMRLNFSHGDYVEHGQRIKNLRAVMEKTGQQAAILLDTKGPEIRTMKLENGADVTLTAGQTFTFTTDQSIVGNKDRVAVTYAGFTEDLSVGNTVLVDDGLIGMQVTAVSGNDVVCKVLNNGDLGENKGVNLPGVSIQLPALAEKDKRDLIFGCEQGVDFVAASFIRKRSDVEEIRAHLKAHGGEHIQIISKIENQEGLNNFDEILEASDGIMVARGDLGVEIPVEEVIFAQKMMIEKCNLARKVVITATQMLDSMIKNPRPTRAEAGDVANAIIDGTDAVMLSGESAKGKYPLESVTIMATICQRTDSVMKSRLDTIKTPGILRITEAVCRGAVETAEKLDAPLIVVATSGGKSAKSIRKYFPNARILALTTNEVTARQLLLSKGIDTLLVKEIASTDDFYRIGKEAALKTGHAQAGDVVVMVSGALVSSGTTNTASVHRL

SEQ ID NO: 9815 - protein, 371 aa, Candida albicans SC5314
MPIPASMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATEVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 9816 - protein, 457 aa, Campylobacter lari RM2100
MGQCPFHPKPYKNKASTLTTFLLKRRSWLDGLYERSYKMMMGRVKMPGFDLYVVNDPKEVRRIMVDEVREYPKSQLLHELLEPLLGISIFTTNDRVWEKQRELLRPSFEMTRISKVFNLMSEAASDMMARFAKYEDKAIVEVDEAMTFVTADVIFRTIMSSKLDEQKGKLVLDAFVTVQEETVKTAMRRMFRFPTWLSNLLGERKRLKAGGVIRKVLSDIIKPRYDNATNDQGKYEDILSSLLMVVDADTNERFSFNEILDQVAMLFLAGHETTASSLTWTLYILSISPNEQQKAYEEIMQVAGDEEFKIEHIRAMKYLTNVFKESLRLYPPVGFFAREARNDNKMRDKLIKKGSGVVVAPWLIHRHDSFWENPHEFDPSRHEDKSKIKKDTYMPFGMGERVCIGQGFAMQETVLILANILRTYKLELEENFIPDIVGRLTIRSANGMNIRFIKRQK

SEQ ID NO: 9817 - protein, 404 aa, Haemophilus somnus 2336
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 9818 - protein, 458 aa, Shigella flexneri 2a str. 301
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 9819 - protein, 439 aa, Wolbachia endosymbiont of Drosophila simulans
MNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 9820 - protein, 331 aa, Brassica napus
  misc_feature (34)..(34): Xaa can be any naturally occurring amino acid
  unsure (1)..(331): unsure at all Xaa locations
PGVVVDLPTLTEKDKEDIMKWGVPNQIDMIALSXFVRKGSDLVQVRKLLGDHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMQYSPVPMSPLESLASSAVRTANSARATLIMVLTRGGSTARLVAKYRPGMPILSVVVPEMKTDFFDWSCSDESPARHSLIFRGLIPVLYAGSARASHDESTEEAIEFATQHGKEKQLCKTGDSVVALLRVGNASLIKILTVK

SEQ ID NO: 9821 - protein, 1038 aa, Zea mays
  misc_feature (300)..(300): Xaa can be any naturally occurring amino acid
  misc_feature (498)..(499): Xaa can be any naturally occurring amino acid
  misc_feature (501)..(501): Xaa can be any naturally occurring amino acid
  misc_feature (519)..(519): Xaa can be any naturally occurring amino acid
  unsure (1)..(1038): unsure at all Xaa locations
MPMRLLLLLLLTFLATAAAVAGAAGGAAAAGSDADALLAAKAVLSDPAGALASWTNATSTGACAWSGVTCNARAAVIGLDLSGRNLSGPVPTALSRLAHLARLDLAANALCGPIPAPLSRLQSLTHLNLSNNVLNGTFPPPLARLRALRVLDLYNNNLTGPLPLAVVGLPVLRHLHLGGNFFSGEIPPEYGRWRRLQYLAVSGNELSGRIPPELGGLTTLRELYIGYYNSYSSGLPPELGNMTDLVRLDAANCGLSGEIPPELGNLANLDTLFLQVNGLAGAIPPELGWLKSLSSLDLSXNALTGEIPASFAALRNLTLLNLFRNKLRGSIPELVGDLPSLEVLQLWENNFTGGIPRRLGRNGRLQLVDLSSNRLTGTLPPELCAGGKLETLIALGNFLFGSIPEPLGKCEALSRIRLGENYLNGSIPDGLFELPNLTQVELQDNLLSGGFPAVSGTGAPNLGAITLSNNQLTGALPASIGKFSGLQKLLLDQNAFTXXQXPPVLGRLQQLSKADLSGXTLDGGVPPEIGKCRLLTYLDLSRNNLSGEIPPAISGMRILNYLNLSRNHLGGEIPATIAAMRRAAAVDFSYNNLSGLVPATGQFSYFNATSFVGNPGLCGPYLGPCHSGGAGTGHDAHTYGGMSNTFKLLIVLGLLVCSIAFAAMAILKARSLKKASEARAWRLTAFQRLEFTCDDVLDSLKEENIIGKGGAGIVYKGTMPDGEHVAVKRLSSMSRGSSHDHGFSAEIQTLGRIRHRYIVRLLGFCSNNETNLLVYEFMPNGSLGELLHGKKGGHLHWDTRYKIAVEAAKGLSYLHHDCSPPILHRDVKSNNILLDSDFEAHVADFGLAKFLQDSGASQCMSAIAGSYGYIAPEYAYTLKVDEKSDVYSFGVVLLELVTGKKPVGEFGDGVDIVHWVRSTTAGASKEQVVKVMDPRLSSVPVHEVAHVFCVALLCVEEQSVQRPTMREVVQMLGELPKPAAAAAAAGQGDEVPGSGDGDECSAAPSGAPAADESVEAPHGEATKEPSSQSSPTTDLISI

SEQ ID NO: 9822 - protein, 322 aa, Pichia angusta
TSVVCCVRFSKDGKFLATGCNKLTQVFSVETGDLVARLSDESSASSNGSYDTDTGDLYIRSVCFSPDGKFLATGAEDKIIRIWDLATRTIVKYLYGLVQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVS

SEQ ID NO: 9823 - protein, 659 aa, Coccidioides immitis RS
MSSALSKRQQARHERTLQELIRSVPGNDRCADCEARNPAWASWNLGIFLCMRCAGLHRKLGTHISKVKSLSMDTWSQDQVDNMKRNGNAVVNKVYNPKHIKPPIPIDADEVDPAMERFIRKKYESKVLEDGKPKIPSREDPSYVTKHVEDSPPPLPPKPSRKFGFGFRSSSSHSGSNKSSPRRESFGSISQNSTLHSNKPSRSLGFSFNDPSGSLESKLAVLRNMGFPDDKRNATILKGLNGDVEKTIDALVRLGEGNGSTSRSRTPVLKTPTSAKFSDSYDPTGSSNPFDKMGSSSSRSSAGISINRRESHSTTSSSDEAAARKLAPYNPFGVPPSQQAPTQTLEQSFQNLQVSQPLFPNMTGGYPSQQGQATYRHYQQSMTPPVTMASQSGFAVSPGSLNGSYNPFFQSSSAVDGVAGAVYPSQSQNLSPTNPFFSQAAPPNNFQLQLPDLRQPAQISSTSEVFQLQHANTMPMMSTSSFDNPPQHQQPPPFPQSAPITPVHSTNMPFFQNPYAQQQQQYFQPQQPNRMDKSSILALYNFSKPPPTIPEQPQPQSQPDTVVPQTQQSTNPFPLPSSNQATSPQPPQPSTTGGRNPFFTSSNANTGLTNNPLGSGANSQPANPTYIRTHMSQESMDIGRAQSGRHSPDVFASLSARYG

SEQ ID NO: 9824 - protein, 319 aa, Pseudomonas putida KT2440
MLKLLNLLKDGRFHSGEALGAALGVSRSAVWKQLQHLESELNLTIHKVRGRGYQLAAPLALLEAQAIAGFAVGEQWPVFIHETIDSTNAEGLRLASEGQAAPFLVLAERQSAGRGRRGRQWVSPFAENLYYSLVLRVDGGMRQLEGLSLVVGLAVMRTLQAFGVKDVGLKWPNDVLVRGQKITGILLELVGDPADVCHVVLGIGINVNMQVNEQVDQQWTSMRREVGAAIDRNHLVALLSQQLQHELARHRRYGFAAFQEEWEQAHLWQGRNVSLVAGSTRIDGVVLGVDGQGGLRLEVDGMEKSFSGGELSLRLRDDS

SEQ ID NO: 9825 - protein, 524 aa, Bifidobacterium longum DJO10A
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 9826 - protein, 119 aa, Oryza sativa
  misc_feature (17)..(17): Xaa can be any naturally occurring amino acid
  misc_feature (42)..(42): Xaa can be any naturally occurring amino acid
  misc_feature (58)..(58): Xaa can be any naturally occurring amino acid
  unsure (1)..(119): unsure at all Xaa locations
VPIVEPEILLDGEHGIXRTFEVAQKVWSDTFLYMADNNVMFXEGILLKPSMVTPGAEXRTGLTPELVFDYTLKLLHIRIRSDGLGIMFLSSGQSDVEATHNLNAMNQGPNLWYVSFLYA

SEQ ID NO: 9827 - protein, 523 aa, Candida tropicalis
MATQEIIDSVLPYLTKWYTVITAAVLVFLISTNIKNYVKAKKLKCVDPPYLKDAGLTGISSLIAAIKAKNDGRLANFADEVFDEYPNHTFYLSVAGALKIVMTVDPENIKAVLATQFTDFSLGTRHAHFAPLLGDGIFTLDGEGWKHSRAMLRPQFARDQIGHVKALEPHIQIMAKQIKLNQGKTFDIQELFFRFTVDTATEFLFGESVHSLYDEKLGIPTPNEIPGRENFAAAFNVSQHYLATRSYSQTFYFLTNPKEFRDCNAKVHHLAKYFVNKALNFTPEELEEKSKSGYVFLYELVKQTRDPKVLQDQLLNIMVAGRDTTAGLLSFALFELARHPEMWSKLREEIEVNFGVGEDSRVEEITFEALKRCEYLKAILNETLRMYPSVPVNFRTATRDTTLPRGGGANGTDPIYIPKGSTVAYVVYKTHRLEEYYGKDANDFRPERWFEPSTKKLGWAYVPFNGGPRVCLGQQFALTEASYVITRLAQMFETVSSDPGLEYPPPKCIHLTMSHNDGVFVKM

SEQ ID NO: 9828 - protein, 522 aa, Candida tropicalis
MTVHDIIATYFTKWYVIVPLALIAYRVLDYFYGRYLMYKLGAKPFFQKQTDGCFGFKAPLELLKKKSDGTLIDFTLQRIHDLDRPDIPTFTFPVFSINLVNTLEPENIKAILATQFNDFSLGTRHSHFAPLLGDGIFTLDGAGWKHSRSMLRPQFAREQISHVKLLEPHVQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVNKALDLTPEQLEKQDGYVFLYELVKQTRDKQVLRDQLLNIMVAGRDTTAGLLSFVFFELARNPEVTNKLREEIEDKFGLGENASVEDISFESLKSCEYLKAVLNETLRLYPSVPQNFRVATKNTTLPRGGGKDGLSPVLVRKGQTVIYGVYAAHRNPAVYGKDALEFRPERWFEPETKKLGWAFLPFNGGPRICLGQQFALTEASYVTVRLLQEFAHLSMDPDTEYPPKKMSHLTMSLFDGANIEMY

SEQ ID NO: 9829 - protein, 522 aa, Candida tropicalis
MTAQDIIATYITKWYVIVPLALIAYRVLDYFYGRYLMYKLGAKPFFQKQTDGYFGFKAPLELLKKKSDGTLIDFTLERIQALNRPDIPTFTFPIFSINLISTLEPENIKAILATQFNDFSLGTRHSHFAPLLGDGIFTLDGAGWKHSRSMLRPQFAREQISHVKLLEPHMQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVSKALDLTPEQLEKQDGYVFLYELVKQTRDRQVLRDQLLNIMVAGRDTTAGLLSFVFFELARNPEVTNKLREEIEDKFGLGENARVEDISFESLKSCEYLKAVLNETLRLYPSVPQNFRVATKNTTLPRGGGKDGLSPVLVRKGQTVMYGVYAAHRNPAVYGKDALEFRPERWFEPETKKLGWAFLPFNGGPRICLGQQFALTEASYVTVRLLQEFGHLSMDPNTEYPPRKMSHLTMSLFDGANIEMY

SEQ ID NO: 9830 - protein, 540 aa, Candida tropicalis
MSSSPSFAQEVLATTSPYIEYFLDNYTRWYYFIPLVLLSLNFISLLHTRYLERRFHAKPLGNFVRDPTFGIATPLLLIYLKSKGTVMKFAWGLWNNKYIVRDPKYKTTGLRIVGLPLIETMDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDESIGLTPTTKDFDGRRDFADAFNYSQTYQAYRFLLQQMYWILNGSEFRKSIAVVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINETLRLYPSVPHNFRVATRNTTLPRGGGEDGYSPIVVKKGQVVMYTVIATHRDPSIYGADADVFRPERWFEPETRKLGWAYVPFNGGPRICLGQQFALTEASYVTVRLLQEFAHLSMDPDTEYPPKLQNTLTLSLFDGADVRMY

SEQ ID NO: 9831 - protein, 353 aa, Cryptococcus neoformans var. neoformans JEC21
MSGLSYCPRVGGYLKLSRTPTFTILPIFNSLIMSAPTSFKLNTGASIPAIGLGTWQAKAGEVRQAVAHALKAGYRHIDGALCYQNEDEVGLGIKDSGVPRSEIFLTSKVWSSYHDRVEECLDTTLKSLQTDYLDLYLIHWPVRLAPNGTHPLFPVKPDGSRNLDWDWDQAKTWAQMEDVLKKGKAKAIGLSNAGIPIIEHIIKTGKVTPAVNQVELHPYCPQHALLKYCKEKGILLEAYSPLGSTSSPLHEDPDLLAVAKKHNVPTATVLISYQVNRGVVVLPKSVTPARIESNLKTIKLDEEDMNKLDKLAEGGKQTRFTAPPWGSDFGFPDWFGPGNKDAPEGARLLAGKA

SEQ ID NO: 9832 - protein, 207 aa, Zea mays
GGEGLNEGETFPQSLSLSLSLAILLAMLRRSRHGGVRLGRNLLSLWRRALCGRRRRRGGYRRLQQQQQKPCAGSGCTPGRTATATARKLAPVLRWGRSLARRLRLGWRPAGGGGHRMLPDGGGEPAVTTPKGQVAVYVGGEGEASQSLRYVVPVVYFNHPTFGELLREAEEEFGFQHPGVISIPCPAARFERAAALAAAAKKGFGRW

SEQ ID NO: 9833 - protein, 271 aa, Ehrlichia ruminantium str. Welgevonden
MNILLIGCGNLGSILLNKWSLNDQISDIVVVQPSLSKKNIFNTINKITFVRDHKEINKSFMPQIVVIAIKPQQVANAIPDYKAYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAITLISQTFIGSAKLLETRKDSISNLISSITSRGGITQAALEILNSHLPNIMSLSLKSATERLVHLKNSDDNKKNT

SEQ ID NO: 9834 - protein, 333 aa, Bacteroides fragilis NCTC 9343
MIKVGINGFGRIGRMVFRAAVKNFGNDIQIVGINDLLDAEYLAYMLKYDSVHGRFEGEVAVEDGALIVNGNKIRLTAEMDPANLKWNEVDADVVVESTGFFLTDETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVSWYDNEWGYSNKVCEMARVIAAK

SEQ ID NO: 9835 - protein, 404 aa, Tropheryma whipplei str. Twist
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRITGRMIHSSFELAELVLSETLVATVPGEAFGTKGHLRLSYALDETSLLEGTGRLVEFFDTANSDMTKVF

SEQ ID NO: 9836 - protein, 260 aa, Acidobacteria bacterium Ellin345
MRATLTVLGSGTSMGVPTIGCDCAVCSSSDPHDRRLRPSVMVQYDGKLVLIDTTPDFREQALREGIKKIDAIVYTHGHADHILGLDDVRPLSFPRITGGARVPLYANEKTERVLKHVFKYIFDDDYKFGSIAQVEMHRVHHEAIELFGAKFIPVPVIHGETEIYGYRFGSAAYLTDFSSIPDASMEMLRGLDILFLDALRHKPHPTHSTLDNSVSIAEKLKAKHTYFTHISHDLPHEETNRQLPAGIQLAHDGLKLEFEL

SEQ ID NO: 9837 - protein, 250 aa, Shigella flexneri 2a str. 301
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 9838 - protein, 443 aa, Leptospira interrogans serovar Lai str. 56601
MNQNKPTSKLISDFWKGKTSEELFERAKKVSPGGVHSPVRSFRSVGGTPVFFASAKGATLTDISGKEYIDYCLSFGPLILGHRDPEVEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKVQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 9839 - protein, 466 aa, Bifidobacterium longum DJO10A
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 9840 - protein, 460 aa, Mesorhizobium loti MAFF303099
MHNSDSSKTPIGGISRDRIAQLRETEGAAFRKARPKSQAKVGNGLPGFFGGVPMHWMNDWPTPFPILVDSAKGAAITDIDGNRLDDFCLGDTGSMFGHSPPPVARAIRRQAGRGLTYMLPSEDALAIGPLLQQRFGLPFWQIATTATDANRFSLRVARAVTGREKILVFNGCYHGSVDETMVRLIGGKPVNRPGLAGEFRDLTRTAKVIEFNDVAALEAALKDRDVACVIAEPVLTNSCMVLADPGFHDALRRLTRETGTLLLIDETHTISTGPGGYTRKYGLEPDFFVLGKPIAGGVPASVWGMSDEVASRYADYNRTKEPGYSGMGTTLSANPLQFAAMRATLEEVMTAENYDRMDHLAERLDAGLTGVIDRYRLPWHVARVGARVEFICAPGPLRNGAEAETAHAPELEAAIHVALVNRGVLIAPFHNMMLISPATSGAQVNRLIAAFGAVAAKLAA

SEQ ID NO: 9841 - protein, 392 aa, Nostoc punctiforme PCC 73102
MKALCWHGANDVRVDTVPDPKIINPRDAIVKITSTAICGSDLHLYDGYIPTMEKGDILGHEFMGEVVELGSAVKNVKIGDRVVVPFTISCGSCFFCQKDLWSLCDNSNPNAWIAEKLMGHSPSGLFGYSHMMGGYAGGQAEYARVPFADVGLFKIPDGLTDEQVLFLTDIFPTGYMAAENCDIQPGDTVAIWGCGPVGQFAIRSAYMLGAERVIAIDRVPERLQMAKDGKAEVLNYEEVEVGEALKDMTGGRGPDACMDAVGMEAHGTGPDAFYDQVKQAVRMETDRPTALRQVIVACRKGGTVSIPGVYGGFVDKIPMGAAMNKALTFKMGQTHVHKYLRPLLDRVQNGDIDPSFVITHRLPLEQAPHGYEIFKHKKDNCIKIVLKPGQAA

SEQ ID NO: 9842 - protein, 540 aa, Candida tropicalis
MSSSPSFAQEVLATTSPYIEYFLDNYTRWYYFIPLVLLSLNFISLLHTKYLERRFHAKPLGNVVLDPTFGIATPLILIYLKSKGTVMKFAWSFWNNKYIVKDPKYKTTGLRIVGLPLIETIDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDDSVGLTPTTKDFEGRGDFADAFNYSQTYQAYRFLLQQMYWILNGAEFRKSIAIVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINEALRLYPSVPHNFRVATRNTTLPRGGGKDGCSPIVVKKGQVVMYTVIGTHRDPSIYGADADVFRPERWFEPETRKLGWAYVPFNGGPRICLGQQFALTEASYVTVRLLQEFGNLSSDPNAEYPPKLQNTLTLSLFDGADVRMF

SEQ ID NO: 9843 - protein, 345 aa, Streptococcus thermophilus LMG 18311
MKSAVYTKAGQVGLAEIDRPQIVAADDAIIKIVRTCVCGSDLWSYRNPEMEEGHRNSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 9844 - protein, 499 aa, Candida tropicalis
MAISSLLSWDVICVVFICVCVYFGYEYCYTKYLMHKHGAREIENVINDGFFGFRLPLLLMRASNEGRLIEFSVKRFESAPHPQNKTLVNRALSVPVILTKDPVNIKAMLSTQFDDFSLGLRLHQFAPLLGKGIFTLDGPEWKQSRSMLRPQFAKDRVSHISDLEPHFVLLRKHIDGHNGDYFDIQELYFRFSMDVATGFLFGESVGSLKDEDARFSEAFNESQKYLATRATLHELYFLCDGFRFRQYNKVVRKFCSQCVHKALDVAPEDTSEYVFLRELVKHTRDPVVLQDQALNVLLAGRDTTASLLSFATFELARNDHMWRKLREEVISTMGPSSDEITVAGLKSCRYLKAILNETLRLYPSVPRNARFATRNTTLPRGGGPDGSFPILIRKGQPVGYFICATHLNEKVYGNDSHVFRPERWAALEGKSLGWSYLPFNGGPRSCLGQQFAILEASYVLARLTQCYTTIQLRTTEYPPKKLVHLTMSLLNGVYIRTRT

SEQ ID NO: 9845 - protein, 566 aa, Kluyveromyces lactis NRRL Y-1140
MRYLVFLLVLFLGVNCEGDSVLFSSATDVFERPKPLKVTTALATKNSNKSRPLQVSMSSTIRNVPLATQGKDSSVFKSFNEWNKEKLRQNKLAQQERPKRSLFHNNNNGDVIRDELEMDFEIFNDDEPEGKIYKDKFNYASVDCAATIIKTNSEAQGAVSILFENKDKSLLNPCSVPNKFFVVELCEDILIESIVMANFEFFSSTFKNVRFSVAERFPVPKNGWKVLGEFEAENIRNTQQFTITNPMIWARYLRVEVLSHYGEEFYCPITLIRAHGIAMIDEFKMEVQNAGEKLEEVVSIEQKLAEEKEKCMIPSSFLTNNMSINFDLDINHQCLASLKHMNFDEFFTGYKDNENITQAKDSSSFIPINTEESIFKNIMKRLSGLETNGTMSILYIEEQSKLLSKSFDKLEDSYSQQFEALVKAFNETMTSNLENLNQFALQLRESSIKIIEEQRLATDKFISTTTNKVEELENAYQHQARVMYLILFGLISSIIYISLTRESYFEEEMVDDGWYTDNSSLQKLKNNIKRSVSETKGHPYTEAAHYSPISSDSEFEDEDSIVIPAK

SEQ ID NO: 9846 - protein, 702 aa, Oryza sativa
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALVQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSCKSAKNYDSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 9847 - protein, 517 aa, Candida tropicalis
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 9848 - protein, 582 aa, Glycine max
MLEKVGEFNMDKVIQEFELLTRDAERVQRETLKRILEDNASAEYLQSLGLNGRTDPESFKACVPLVTHKELEPYIYRIIDGDASPILTGKPITTMSLSSGTTQGKPKYVPWNDELYETTMQIYLTSFVFRNREFPIKNGKALSFIYGSKQLTTKGGLAARTATSNVFCSAGYKCAMRALQSQCCSPDEVIFGPDFFQSLYCHLLCGLIFREEVQFVSSTFAHSIVHAFRTFEQVWEELCNDIREGVLTRNVTIPSIRMAMSKLLKPNPELANTIHQKCRGLSNWYGLIPELFPNAKYIYGIMTGSMEPYLKKMRHYAGELPLLTADYGSSEGWIAANVNPQLPPEYATPAVLPHIGYFEFIPLSEFENTKGEPDFLCVDPKPMGLTEVKVGEEYEIVMTNPAGLYRYRLGDVVKVMGFHNSTPELKFIRRSSLLLNINIDKNTEKDLQLAVEAAGKLLAEEKLEVVDFSSQVDLSKEPGHYVIFWEISGEASQELLLECCNCLDKSFVDAGYTSSRKVNCIGALELRLVRRGTFQKILDHYLGLGTAVSQYKTPRCVGPTNTRVLQILSENVVNNYLSTAFN

SEQ ID NO: 9849 - protein, 517 aa, Candida tropicalis
MIEQILEYWYIVVPVLYIIKQLIAYSKTRVLMKQLGAAPITNQLYDNVFGIVNGWKALQFKKEGRAQEYNDHKFDSSKNPSVGTYVSILFGTKIVVTKDPENIKAILATQFGDFSLGKRHALFKPLLGDGIFTLDGEGWKHSRSMLRPQFAREQVAHVTSLEPHFQLLKKHILKHKGEYFDIQELFFRFTVDSATEFLFGESVHSLKDETIGINQDDIDFAGRKDFAESFNKAQEYLSIRILVQTFYWLINNKEFRDCTKSVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAFLNETLRVYPSVPRNFRIATKNTTLPRGGGPDGTQPILIQKGEGVSYGINSTHLDPVYYGPDAAEFRPERWFEPSTRKLGWAYLPFNGGPRICLGQQFALTEAGYVLVRLVQEFSHIRSDPDEVYPPKRLTNLTMCLQDGAIVKFD

SEQ ID NO: 9850 - protein, 312 aa, Chromobacterium violaceum ATCC 12472
MAIQWFPGHMNKARKDVSERLKDIDVVIEMLDARLPASSANPMLARMAKGKPRLMLLNKQDLADPAVTEQWLAWYRAKKQTEALGMDAGERAPAQRLIAACRALAPNRGGLEKPLRVLICGIPNVGKSTLINSMSSRKIAKTGNMPGVTKNEQRIILADDFELYDTPGMLWPKIEVEEGGYNLAASGAVGRNAMDEEEVALELLKYLLVHYRAELAARYKLDEEELDGAQDWQALERIGKRRGAVLSGGRINMQKAAEIVLTDFRDGQTGRITLERPEEWAKWEKRAKEIAAQRAAEREAREQEKASRKGSR

SEQ ID NO: 9851 - protein, 512 aa, Candida tropicalis
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 9852 - protein, 464 aa, Novosphingobium aromaticivorans DSM 12444
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 9853 - protein, 334 aa, Schizosaccharomyces pombe
MTLSGKPAALLVGTLKHAHKEWEALGKYAELKTYSDGTREDFLAKCKTEFQNVKAICRTYNSKFYMGIWDKEIIDNLPPSVKFICHLGAGYETVDVAACTARGIQVSHVPKAVDDATADVGIFLMLGALRGFNQGIFELHKNNWNANCKPSHDPEGKTLGILGLGGIGKTMAKRARAFDMKIVYHNRTPLPEEEAEGAEFVSFDDLLAKSDVLSLNLPLNAHTRHIIGKPEFQKMKRGIVIVNTARGAVMDEAALVEALDEGIVYSAGLDVFEEEPKIHPGLLENEKVILLPHLGTNSLETQYKMECAVLMNVKNGIVNDSLPNLVPEQRGDIE

SEQ ID NO: 9854 - protein, 1099 aa, Yarrowia lipolytica CLIB122
MSRPRDDDASDDGQQRPRKRQNTQDFFRYHHPGFIRSVECINFMCHENLKIDVGPGITFVSGQNGHGKSAILNALIQVFSTDRKMKGERGTGAALRRNIEDNKKAKSAKIIVKINNKEADEDLDFTDGGVKGYTMSPFEPETYGDIIIIEREIFEKSRKLKIMTKKKELISEKTEVLLQIMKHFSYQFDNRLVIQTQENAKKRGDPKSLFDFFYNGSGFESIENDLAAMKREVGQQHECLESSLLQTTLAKKERRDELKAECELTAHTKELYDNLQRYKAMYQWLDYSTFQLALNNALSVKMKLEDKCKQLKEVGAKRRAQLEEHKLALEQCEKEDPELDAQIAEANRKKTLLKNEKDDINRQLRSSERDVEDLEDQIRLLNHAIAKLRAERDQSNSNAEHKRLDAKIKACEEKVTTAETQIRAFKLKLEEKRNIWRDARSKSQDASSPRTQKEAQLRDARDEASRLEAMSRDKGNPIAGFGHQFVEADRIIQTNMGRFRQPPLGPIGQYIKVKPGTSQQELTLINSHQPLTRLLRSYVVATPEDERTLRSILPRNHNPTIYYVKPDNYDVDRISPSSQFKTILRCLDVSEARVIQALVEWAAVHSTAIAGSTEEAVRALKQGSQNLESAIAPHKTSDRFIVTATQRGSQLSSSGVVQSGLLRVGKAIVTAEDVSEAKKRVAVCERELQPLKEELRRLEQEEQMALREFRSLEDKESVFEQKLQSLRREHALAVAERDSIPDAPSTDETDQAIETKTQELDNSKQQLSEAREALEAAKVRSREIANSEMEAEVELDKLNAKVHEKFLATEEANLRYTAHQDVVTSTLQKFELAKKKLAEKEVELVDIQANMETQLAAAQALSEEHVPLDEGVDLENGFDYCTKRTGELQAKIDAAKKRNLRDYRIVYAEFQEAEEAYRLAKEEFEAQKKDVRALGETEADRVLAKGQALSLGIMQTSAYFSNIMKSRAASADIVFDLKTRKLEVKNYKLASTSDTSSKGGARDVATTSGGEHSFLQSALMAALWQMVDAPIICLDEYEVFMDDTTRVTAQKNLINTLGGLKQRAQAILISPTVVKNSAVDDARFTYVEVRDPSFASRNR

SEQ ID NO: 9855 - protein, 454 aa, Pediococcus pentosaceus ATCC 25745
MEENGNNELARNLKSRHVQLIAIGGTIGTGLFLGAGSSIHLAGPSILLAYIVTGLVCFWLMRALGELLLSDLESTSFVTFVTKYLGKKVGFVTGWTYWVCWITIAMAEITATGMYVRYWFPSVPQWIPGFIILILLIGLNLITVEAFGETEFWFSIIKIIAIVALIAIGFIMVLLHSKTNVGHADLTNLIHFGGIFPQGLKGFILSFQMVLFAFVGIEMVGMTAAETRDPKSVIPKAINEIPVRIGIFYVGALFFLMAIYPWNEINPNGSPFVQVFKNIGIPGAGGIINFVVLTAAASACNSSLFTTGRMLFSLTYGSSNKLGKRLGTLSKSQVPKNAILLSSLVIAVAVILNILMPEGVFTLISSIATTCFLFIWGTIVLAHLKYKKGQKQAKKEFSMPFFPISNYIVLTFLSFVGVVLLLQKETAIALIGSLIWFGVMFTVAKIKGKGELMD

SEQ ID NO: 9856 - protein, 596 aa, Arabidopsis thaliana
MSQSIQFSTPSHTPHLLHLPHSQFNRPLSSISFRRFPLTTIKYTSIRASSSSSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 9857 - protein, 750 aa, Zea mays
  misc_feature (125)..(125): Xaa can be any naturally occurring amino acid
  unsure (1)..(750): unsure at all Xaa locations
MDLSRFASGVGPSSVAPRAGLQIGAAENGFRACSLRRARHRGGGNGNLTAAASTLRGRGGLFYLAPTRRSHPSLRLFYLLPTRGSHLSLRARWRPRCQGNDSLAYVDGPLETAKGSGEVYDDDAXSSGPDDDDNDKGPADVDGLREMLQRCRNELEVARLNSTMFEEKAQRISESAIALKDRAEGAQRDVSAAVATVQEVIVKEADAKEAVQKATMALSMAEARLQLASEALDAKRGSVGPMEVSIEGVEEEALVSAQEEIKDCRAALLRCEEELERIQEQKMNLQKEVDRLTELAEKAQLDASKAEEDVTNIMVLAEQAVALEMKATQRVNDAEAVLLKAEKVISSVDTVVELTSLAEEQKSAEEDSVSEGYEYSSNGTDDVPVRDEVSSIERLMVGDLTVEGIEQLEPSREIYDEASSDKMSVEPQKEAEPDSDKLKQGKKQEMERKEFTKEPLSAQKSLKKRSSRFFSASFFSSKADGEFTPTSVFRGLMKSVQKQAPKLVVGILLLGAGAFFLNRAEKSQLFQQQGIATSIGKVTSTTKPIVLEIRQIPQRVKKLIELLPHQEVNEEEASLFDILYLLLASVIFVPLFQKIPGGSPVLGYLAAGVLIGPYGLSIIRNVHGTKAIAEFGVVFLLFNIGLELSVERLSSMKKYVFGLGSAQVLATTAAVGVIAHRFAVLPGPAAIVVGSGLALSSTAVVLQVLQERGESTSRHGRATFSVLLFQDLAVVVLLILIPLISPNSSKGRDP

SEQ ID NO: 9858 - protein, 461 aa, Mesorhizobium sp. JX2B5
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9859 - protein, 333 aa, Haemophilus influenzae Rd KW20
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 9860 - protein, 459 aa, Staphylococcus aureus subsp. aureus MSSA476
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVIAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 9861 - protein, 461 aa, Mesorhizobium sp. JS5A15
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDRAQEMGSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9862 - protein, 267 aa, Nocardioides sp. JS614
MSQTAILGAGVMGETLLSGLVRAGRRVDHLLVGEKRPERAQELEERYGVAVVGNAEAARKADTLALVVKPQDMGDLLEEIAGELRPGQLVVSLAAGITTAFIEARVPEGVAVVRVMPNTPALVDEGMAAVSPGSHCSEEHLAEAESLMASVGRVLRIPERQQDAVTAISGSGPAYIFFVVESMIEAGVHLGLPRATATDLVVQTVVGSAKMLRETGTHPAVLREQVTSPAGTTAAALRELEIHKVRAAFLAAMEAARDRSRALAEGS

SEQ ID NO: 9863 - protein, 461 aa, Mesorhizobium sp. HN14A16
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9864 - protein, 1842 aa, Kluyveromyces lactis NRRL Y-1140
MQRSQSSRGPTGNENSHSRSLSNSQGSSLFSNLKKLATGGNHGSSQPSQTRKELISSPKRVFTTASLESATPIGGSKPLNKISSLNTHNLSHYTMDPEANSRSQSASLLTSPTKYSYSRRSSQLTRSSTNKSIISSSAVSVSSNSTSILNRFLTNDGTLKLDRPENPEEINGLFMDLLIKRNVFDSVSSQDQKDMLNYPIEKKWLMVKQDLQSEFKRLKSTKPRFSANDTQNMLKRKTSTSKLNTQYEGMLHTNESQGSLLSPSHFPPEYYVRQIISKKIKNKELNDLWVSLRTEPLDWVISFLEAQGQVAIANLIITSMHQDTTDNQNAVTDPQFLERETALFKCLRVLLNIRECLEEAVNSTLVTNALVEGLLSTKIPTRRLATETLIYLVTKDEDFKSRTAGLDCFSLVMESLNHETSLVQNIHMKAKFSTNDSTDPESNPQLYQVCKILQQWLYVVEQTLDGRGKMGSLVGASDEYRNNTGENSIYEYLVDSIVLIDQLCLNNEDVKKRHMMRTQLKSFGLNRILQKMQLLDYPPLSTMLLQFEDAAIDDYNSLIDSQKFTENVDMDDPVSILQKLTSSFKGTEAESYLLSMLQNLFLSSNKNAQESDDPGKNVQQLKLIDSLISNVAITTLDSESNFNVAIQRLYDSMQTDEIARRAILESRELTKKLEEVKAERDYLNDKISKAENGLVGQLQKELAERDLILDKTQRVTEQLQSELEELKKRHLLEKHEHEIELRKMLTIVNSKTSDDLESGSTVQNDPKPLNPERKTAIQNVLQRSLQKTEQDLLNESRRLGTAVGSKSRLKLLRSKMEDIENQARELEMTNFADVKPKQNQKFKEQVKGQQATKLAELRKKLAIIQNESNDITKFNIEARVNELFQDKKLAALDRLKDLENKYNGFHIDFADDPELKELLTQSSNGGPSLDPTIVQRKVEEMNSIIDELNALKEEMKNRPKTGSSSSSSSSLSSASSSSEDGSSQSQASHGSDIVSNGSSFLESLSQKYSTGQQTATSTNGGRVGRETRYPGSGYHRKSFLNRLKNTTVNPTATSEHLPPFLTELKSKVKMTDDIDDVPVGIGISVSPGASLKSTEKPVSQFTEKPILTDAQQGSDKISNVILNDKYSPTTMQSEIGDSESIEANPTTTIVSAASPPPPPPPPPPPPLPVSLGGTLTAVPSPLPTALSPGIAPPPPPPPPPPPPFPSANTPKATVTSPLLPQSPSLFERYPRPKKKLKQLHWEKIDNAGDSIWKNAQAEKVADDLFERGVLSQLEKAFAARETKSLKGKSKEANEKITFLSRDVSQQFGINLHMFSNLDVKDVVGKVMKCDREFLSTPSVIEFLSKPTIIEVTNNLARYFNPYSTDWEGVTSVDDAKPPEKDPNELQRADQLYVEFMINLQPYWGSRMRAITMITTYEKDYSDLVTKLRKIDRAVQCIEQSESLRHVFDVILAVGNYMNDSSKQAQGFKLSTLQRLTFIKDEKNSMTFLNYVEKIIRENYPEYSHFVEELEPIFSVTKISIEQLVTDCKEFSQSVINVERSIEIGNLSDPSKFHPLDRVLNKVVPVLPEARKKADLLSDEIKLSLLEFENLMKKFGEDANDKFSKNSFFQKFADFITEFKKAKTHNVKLEEEERAYERRKKMIEDQQRKQQEADSKATAKNLSTSQEPSDDRDDIEKLLDKLKNAAPSKGDPSSTRKRALARKKLLDGKSGASIFDNITADSTIEAFVEQNRTLTESPTAKKSASLPETESLSSSKQDPADRARNLLLELRGPDERKDASPSPIKAKDKLRDLKKKDSSVKVDQPNKLQFVGSLEVGPHPKPLSPTQDLMDTSNSSEDEFIDA

SEQ ID NO: 9865 - protein, 512 aa, Candida tropicalis
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 9866 - protein, 275 aa, Geobacter metallireducens GS-15
MRGEGIRARKALGQNFLVDRHVLARIADIVDMRPDDRILEVGPGKGALTEMLAHRCARLVAVELDTRLVPVLRQAFRDNPRVEIVHGDILEIDLRDLLAYEGGERWKVAANLPYNISTPVLFAFLDNRDLFSRLVLMLQKEVGDRLAASPGTKDYGILSVFFQLHFDVTREMIVRPGSFHPVPKVDSAVLSFVPLEKPRVAVGDEQYFRRLVKGAFSMRRKTLWNCLKNAGLGLSGEQLSEALAVCGIEPGRRGETLSLDEFAALSRAMMALGGK

SEQ ID NO: 9867 - protein, 369 aa, Rhodopseudomonas palustris CGA009
MVGSCFRDPIMAHPIQEVLQAFAAGEIVVVTDDDDREGEGDLVVAASLCTAEKMAFIIRHTSGIVCAPITMEDARRLRLDPMVAHNDSNHTTAFTVSIDYKPDNGTGISADERASCCRALANPNAGAADFARPGHIFPLIAREGGVLLRSGHTEAAVDLCKLAGLPPVGVISELMNDDGTVTKGAQVVAFAKKHNLKLVTIADLIAHRQAREKLIERVATFPVESPIGVMQGYAYRSPFDEIAHIAFVFNGVGDGKNVLTRFHKPNIVKEIFTGPRRMESVLAQFKKNGSGVLIYLRDGAAGVPVSPIDEQKTAEADRHRQWREIGVGAQILRDLGVTSIRHLTTSQIDYKGLSGFGIEIVGNEHLEGT

SEQ ID NO: 9868 - protein, 257 aa, Zea mays
MAATVLFTPAQCHRATATTSGRGAPSHCALAPGHRRPGRGSVRAVPPEQSSLPQAAAAVYGTAGDVKAALYRALDGANRGIFGMTSAKRSEIHGLVELLESRNPTPEPTAKLQDKVDGCWKLIYSTISILGKKRTKLGLRDFISLGDFLQIIDVKQEKAVNVVEFSARALKILTGKLTIEASYRVTSQTRVDIKLESSTITPEQLMNIFQKNYDMLLDIFNPEGWLEITYVDESLRIGRDDKENIFVLERADLPDVR

SEQ ID NO: 9869 - protein, 306 aa, Thermotoga maritima MSB8
MARYRVHVNDPLDKEATQLLMNKEELEVTSEHLEKDELMKIIPEVDVLVVRSATKVTADIIEAGKNLKIIARAGIGLDNIDVQKAKEKGIKVLNTPGASAPSVAELAMGLMLACARHIARATVSLKEGKWEKKALKGKELLGKTLGLIGFGNIGQEVAKRALAFGMKIIAYDPAKPETDLPVEYVDLDTLFKESDFISLHVPLTESTRHIINRESIAKMKDGVIIVNTARGGTIDEEALYEEVVSGKVYAAGLDVFEVEPPTDEIRRKLLSLDNVVATPHIGASTAEAQRRVGIELVEKIFKELGI

SEQ ID NO: 9870 - protein, 356 aa, Streptomyces avermitilis MA-4680
MKALVFHGSGESVWEDVADPGIQDAGDAIVRVDTVTICGTDLHILKGDLPEVRPGTVLGHEAVGEIVETGGDVRTVRPGDRVLVSCITACGRCRFCRESAYGQCRGGGGWILGHLINGTQAEYVRVPHADLSVHPLPGAMDSKDAVLLADILPTAYEVGVLNGRVRPGDTVVVVGAGPVGLAAVATSRLYTPEKIIAVDLAPARLDAAKRLGADAVAVAGEEAEPLVADLTLGLGADVVIEAVGVPETFEMCTRMVRPGGHVANVGVHGRPAVLHLEDLWIKNVTITTGLVDTRSTPTLLRMMAAGHLPASSMVTHTFPLDAMEEAYDVFSRAADTGALKVVLGEQQHDVLMVRAA

SEQ ID NO: 9871 - protein, 487 aa, Sinorhizobium meliloti 1021
MTFHAKFSGYADPALHAAGLYIGGKWQSGSGITVLDPSTGNLLAEVADASIEDAQRAVDAADAAAAGWRATPARQRSEILRRWYQLMTQHAEELATLIALENGKALADARGEVAYAAEFFRWYAEEATRIPGEFRHTPSGSHNILVDHEPIGIAVLITPWNFPAAMATRKIGPALAAGCTVILKPASETPLTAYAMARLGEEAGVPPGVVNVLTTSNPGGITNAMLADPRVRKLSFTGSTGVGRVLLAEAAKSVVSCSMELGGNAPFIVFDDADLEVALDGAMIAKMRNAGEACTAANRFYVQAGIHDAFVAGLTARMKSLKLGPGYDPETQCGPMITQNAVRKIDRLVSEALAAGARATTGGKPLTENGYFYPPTVLENVPVNASIAREEIFGPVAPVYKFESDDEAIRLANNTEYGLAAYIYSRDLKRAMKVGKRIETGMLGINRGLMSDPAAPFGGVKQSGLGREGGVTGILEFMEPKYFAVDY

SEQ ID NO: 9872 - protein, 150 aa, Francisella tularensis subsp. novicida
SGEDVFKKLNKIIDTTITPVVCIGESLDDRQSGKLKQVLATQLSLILENLSVEQLAKVVIAYEPVWAIGTGVVASLDQIQETHQFIRSLLAKVDERLAKNIKIVYGGSLKAENAKDILSLPDVDGGLIGGASLKAAEFNEIINQANKICT

SEQ ID NO: 9873 - protein, 436 aa, Synechococcus sp. WH 5701
MSGVLETLAFFRDPDFARSRFERYGDVYETTLLGQRTVFIRGGQAVGDLFAQGDAVQGWWPDSVRKLLGPLSLANRNGVDHKARRRVVGQLFTTVALKRYSPAIVALVNELSHDLLGCAAPVALVPRLRRFAFSVIASTVLGLDPVDRDALFVDFETWCQGLFSLPFALPGSPYARARQARGRLLLRLGSVLNKAQAAVAAGKPLAAGGLDLLAGGLDEAGLPLADDDVAEQLLLLLFAGYETTASSLSCLLQTLLQHPAELAWLQQELGALSWPPPQGEATTAYDAIRAPRLDAVVKEVMRLTPPVGGFFRRTLEPIALAGVLVPADRVVQVSIAASHRHGREDEDLEVFRPQRHLAGDSTATLLPYGGGERVCLGKSLAELEIRLLTVGMLKQLMLVLKPDQDLTLRVIPSPSPTDGLLVRPLPRATGLHSPVR

SEQ ID NO: 9874 - protein, 429 aa, Bacillus halodurans C-125
MKTFEKSSAAFNRAKPLMPGGVNSPVRAFKSVNMDPVFMERGKGANIYDIDGNEYIDYVLSWGPLILGHADDQVVEKLKETTEKGTSFGAPSELETKLAELVIERVPSIEVVRMVNSGTEATMSALRLARGYTGRNKILKFEGCYHGHGDSLLIKAGSGVATLGLPDSPGVPETVAQNTLTVPYNDLESVRYAFEQFGDDLAGVIVEPVAGNMGVVPPEPGFLEELRRLTEENGTLLIFDEVMTGFRVGYHCAQGAFGITPDLTCLGKVIGGGLPVGAYGGKREIMEQIAPSGPIYQAGTLSGNPLAMTAGYETLVQLTEANYEYFDRLGDRLAEGLSAVAKEYDIPHYTSRAGSMVGFFFTDKKVKNFADASSSDLEFFAKYFKEMLHLGVSLPPSQFEGMFLSTKHTEADIDFTVDAARQAFKRLKK

SEQ ID NO: 9875 - protein, 299 aa, Bacteroides fragilis
GRMVFRAAVKNFGNDIQIVGINDLLDAEYLAYMLKYDSVHGRFEGEVAVEDGALIVNGNKIRLTAEMDPANLKWNEVDADVVVESTGFFLTNETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVS

SEQ ID NO: 9876 - protein, 349 aa, Bacillus cereus E33L
MKAAVWYGQKDIRIEDKELKPLKDNEVTVRVAWAGICGSDLHEYQEGPVFVPVDAPDELTGEVAPIIMGHEFAGVVEKVGSAVKKYKVGDRVVVNPTITHGNKPEDIDCYDGFSFIGLHGDGGFTTFANAPEHNIYKLPDTLTLQDGALVEPTAVAVQAVKEGGMQFGDTVAIFGAGPIGLLTTIAAKAAGASKILVFDLSETRLEKAKELGATEVFNSGKINPVEAVKQHAPNGVDVTFEVAGVAPTFKSAIDVTRPRGTVVIVSIFAHSIEWNPMQLTNTGVKVTSTIAYTPTSFQQTVDLMGTGQLKPQGIVTSQIELENIVEKGFEALTSDKSQAKILVKLSGEM

SEQ ID NO: 9877 - protein, 224 aa, Listeria monocytogenes str. 4b F2365
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHIQTILRRQSSGEIYVTNNGNYILDIVNQTFRDAEMWQEKLAQIPGIVEHGLFLHYVDIIVCAKANGEIELIKK

SEQ ID NO: 9878 - protein, 461 aa, Mesorhizobium sp. HN15B23
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLLYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 9879 - protein, 510 aa, Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 9880 - protein, 346 aa, Coccidioides immitis RS
MPPKKAEQPKKKKQTVEDKKKGATAKKQIAQLQAQAQSNKSADQKRKDAEKARREKEKAAAEQAKKEAAELFKPVQVQKVPFGVDPKTVLCIFFKKGTCEKGKKCKFSHDPAVERKAEKRDLYSDSRDAENDKQNDTMDSWDEDKLRKVVLSKHGNPRTTTDKVCKYFIEAVENQKYGWFWTCPNGGDKCMYKHSLPPGFVLKTKEQKAAEKALLDKSPLKTLTLEEFLESERHKLTGNLTPVTEESFAKWKRERLDKKAAEEEARKAKEATGRALFESGNWKDSEDEDSEEDSDDEDQGAWNLEAMRKETEDLRDRSEQDRLAKLKGESLSNGIDPGSTSVAGAG

SEQ ID NO: 9881 - protein, 291 aa, Clostridium thermocellum ATCC 27405
MNIQWFPGHMAKTRRILAENLKMVDVVVELLDARIPASSKNPEIDGIVKNKPKIVVLNKADLADEKISNEWSKWYNSQGYATIFIDSIKGTGIKQLKDQMRDIMKDRIERDRQRGRIFRPIRTMIVGIPNVGKSSLINKIAGKKSAVTGDRPGVTRNKQWINVNNEIQLMDTPGILWPKFEDKTVGINLAVTGAIKDEIIDTVELASILLEHLSKTYPENIKKRYKLESLQDKKGYELLEEAGKKRGCIISGGEVDLTRIAAIVLDEFRGGKIGRITLERPGDAVQELVAD

SEQ ID NO: 9882 - protein, 252 aa, Streptococcus thermophilus LMG 18311
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAPEFVGAQVSAALAGLTLKQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 9883 - protein, 111 aa, Arabidopsis thaliana
  misc_feature (22)..(22): Xaa can be any naturally occurring amino acid
  misc_feature (50)..(50): Xaa can be any naturally occurring amino acid
  misc_feature (57)..(57): Xaa can be any naturally occurring amino acid
  misc_feature (84)..(84): Xaa can be any naturally occurring amino acid
  unsure (1)..(111): unsure at all Xaa locations
MAALLVRSCCSLASRAITTVRXMSIVPDDTVYGGPMRGDSNQRVTQTHLXQKHRKGXPITMVTCYNHPSAVHIDTGEIDVCLDXNSSVMDAHGYDTTLPMFLEEMLGHCRA

SEQ ID NO: 9884 - protein, 270 aa, Burkholderia mallei ATCC 23344
MKIAFIGGGNMAAALIGGLVKRGVDASGLLAVDVNEDARQRAQAQFGVRTAAAVDATLAGYDAIVLAVKPQVLKDVALALAPHLTTQLVVSIAAGIRGADLSRWLGDYPRVVRTMPNTPALVGLGVTGLSALPGVDAAGRDLASKVLGAVGETVWSDDESQLDAVTAISGSGPAYVFYFIEALQEAARQLGMNDEQGRALAVATFAGAAQLAVQSGEPAGVLRERVTSKGGTTAAALASFDAQHVKDAIVRGVLAAQARAREMGDELGGA

SEQ ID NO: 9885 - protein, 505 aa, Bifidobacterium longum DJO10A
MNSRGLKQVDLVHAAEHRGVKMGKSHISQYVAGKTMPREDVLEFLASELDVDTNWLRGEESTTQLNSDASNSVTDGEHAATPLAMGAAKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 9886 - protein, 581 aa, Novosphingobium aromaticivorans DSM 12444
MAEHSSLLRDGFLLLGFALIFVLVFRRLGLGATLGYLLAGAVVGPQVLGLVGDAESKLGIAELGITLLLFLVGLELNPSRLWRMKRDILGLGLLQVTACGLAVAAMIGLTTEFSWEAALALGLPLALSSTAQVLPMLQSSGRLRTPFGERAFAILLFQDLSIIPLITIISAMSRNPADAGGPPGWLLTLYTLAAVVALIAAGRFVIRPLFRLIGNLGEREMFVVAALFTVMASAAVMEALGLSTALGAFVAGVMLADSPYRHELEADVEPFRSILLGLFFLAVGMMLNLHAIAERPLFVLAMAVGLIAIKAGAIFLIGLAFRMTWRGALALGLLLSQGGEFGFVLFAQAQNALLIAPDAASLFGAIVTLSMATTPFLMMATRGIREEAESPKGERAGPQPDGANAIIVGFGRFGQGVSQILLASNIPVTMVDTDIEMIDVAAEFGAKVYFGDGTRIDLLRQAGADEAEMIFFCMDGDQMSPDLVEAVHEAFPRAAIYVRAYDRRALIRLKETPASAVVREVLESAVKMARIALHDAGLSEEAINRAEDMFRARDKERLRLQVEAGDVRVARDRIITEPSGS

SEQ ID NO: 9887 - protein, 294 aa, Oryza sativa
MAAATSTAAYWLAEHPAIVSFRWSPTGLWFSTWAFLLGFLASYVALCLALDAILAALLRRRRPLPLGPLPAAHALLMAAVSAAIFAGTLLSALAEIRDTRWSWRGRSRTTPFRWLLCFPPGTRSSGRVFFWSYAYYLSRYLHAARGLFAVLQRRRGAAARVFAHAASVAMAFLWLEFSQSFQVLAILASTLAHAVAFGFRFWVGAGLPAARGAPVALACQCALLGCNLLCHVGVVWMHFGGVAGGGCSGIGAWVFNTLLNAALLWVFLHCYGKRGVCDDDGGATAASARHDKDL

SEQ ID NO: 9888 - protein, 486 aa, Chromobacterium violaceum ATCC 12472
MLNLQDPSLLRQQCYLGGEWLDADGGQHIAVHNPATGEKIGQVPKMGAAEAERAVAAAARAFPAWKAKSAKERAAILRRWFDLIIAHQQDLAIILTSEQGKPLAEAKGEIAYGASYIEWYAEEAKRVYGDIVPGPAGDRRVLVTKEPIGVTAAITPWNFPSAMITRKAAPALAAGCTMVVRPASQTPLSALALAELAERAGIPAGVFSVITGGSSEIGAVLTGSDTVKKFSFTGSTEVGRKLIAQCAGTVKKVSMELGGNAPFIVFDDADLDAAVEGALISKYRNAGQTCVCANRIYVQDGVYDAFAEKFAAAVATLKVGNGLEAGVSQGPLIDHNAVAKVEEHIADALAKGGRLIAGGKRHALGHTFFEPTLIADVTRDMKVAREETFGPLAPLFRFKTEEEAIRLANDTEFGLASYFYARDVGRIFRVAEGLEYGMVAVNSGLLSNEAAPFGGVKQSGLGREGSKYGIEDYLEIKYVLLGGLDR

SEQ ID NO: 9889 - protein, 384 aa, Bordetella pertussis Tohama I
MPRLATRTNDFLTFQVVELFKEAQALQAAGRDIISLGIGEPDFTAPPQVVEALERATRAGLNGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDNIIVINSFSKYFHMTGWRLGWMIVPESMAAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 9890 - protein, 131 aa, Triticum aestivum
AESGNNSLFQLGASWQANKNFLLKGKLGPSKSSVALAFKSWWRPSFTFSVTAENDHSKGTTSCGFGIRVEDLRQPSYERADPNYVMMSTNKEHLAPAALREFGQRPMFQADVDSGNFDHLPTELRPMSKII

SEQ ID NO: 9891 - protein, 236 aa, Streptomyces avermitilis MA-4680
MTATLITGANKGLGFETARRLIAAGHTVYIGSRDAERGRRAAERLGARAVRLDVTDDASVAAAAKTIEADGGLDVLVNNAGIQEEMGDDNVVIGAADVTVDVMRQTFETNVFGMVRVTHAFLPLLRSSAAPVVVNVSSGLASLTRATIPGDPAYTYPGLAYPASKTAVNMITVQYAKAFPNMRINAVEPGYTKTDLNGNSGVQTVEQGAEIIVRMAQVDPDGPTGGYFDADGILPW

SEQ ID NO: 9892 - protein, 578 aa, Erwinia carotovora subsp. atroseptica SCRI1043
MTYDNHVRAIQSDQKLGGNYLAQIRQKFPAAVLDEEWQTHDQLTITIKTESLPDVVEFIYYPLGGWLPVLFGNDERTLNGNYAVYYALSMEQGEKCWIVVKAYVDPLTLEFPSVTPRVPAAVWGEREIRDMYGLIPVGLPDERRLVLPDDWPDDLYPLRKDTMDYRLRPEPTTQIETYQFKNEGGSEARIVPVGPLHITSDEPGHFRLFVDGERIVDADYRLFYVHRGMEKLAETRMGYNEVTFLSDRVCGICGFAHSVAYTSSVENALGIYVPPRAHAIRSILLEVERLHSHLLNIGLSSHFIGFDTGFMQFFRVREKSMALAELLTGARKTYGLNLIGGIRRDILKEQRQKGIKLVQEMRAEVTQLVDMLLNTPNMEQRTQGIGLLDRKIARDYSPVGPMIRGSGFARDMRFDHDYAGYSALPKTLFTLDGCDVFSRVMVRVQETLESLSMVEFGLDHLPEGPLLTEGFTYRPYKFALGYTEAPRGEDVHWSMLGDNQKLFRWRCRAATYANWPVLRYMLRGNTISDAPLIIGSLDPCYSCTDRVTLVDIKKRKSTTVPYKEIERYSIERKNSPLK

SEQ ID NO: 9893 - protein, 152 aa, Zea mays
  misc_feature (56)..(56): Xaa can be any naturally occurring amino acid
  misc_feature (99)..(99): Xaa can be any naturally occurring amino acid
  misc_feature (148)..(148): Xaa can be any naturally occurring amino acid
  unsure (1)..(152): unsure at all Xaa locations
MASATVLKSSFLPNKCEWIATRQADRSRPPTGSMVRRVSAYADELVKTAKTIASLXCGILTMDESNARCGKRLATIGLENTEANREAYRTLLVTTSALXQYISGAILFEETMYQSAVDGRKIVDILAKHGIVPGIKVDKGLCPIAGSXNESW

SEQ ID NO: 9894 - protein, 289 aa, Schizosaccharomyces pombe
KKAAKGKGDPGKAAKKDPTKKAADATFGLKNKNRSTKVQAKIRQIEQNAAASGSKDAKRQEALRKRREEEKRAAEAAKAEVAALFNAIPKKQTPQNFLTRKEEVKESQKIDLYSDVRDQQTDLPLEKRPWINTDIVCKFFLEACETGKYGWLWQCPNGNMTCIYKHALPYGYVLSRDKKKDDTKEEISLEAFIEIERHRLGPNLTPVTEENFKKWSDGRRDRILKQAEERRSNRAVGRSNLSGREYFESNKDKTHEVVGDEEDWDFSALRRETEALAKAQDATAPIVSV

SEQ ID NO: 9895 - protein, 150 aa, Francisella tularensis subsp. mediasiatica
SDEDVFKKLNKIIDTTITPVVCIGESLDDRQSGKLKQVLATQLSLILENLSVEQLAKVVIAYEPVWAIGTGVVASLEQIQETHQFIRSLLAKVDEKLAKNIKIVYGGSLKAENAKDILSLPNVDGGLIGGASLKAVEFNEIINQANKICT

SEQ ID NO: 9896 - protein, 313 aa, Acidobacteria bacterium Ellin345
MIAPDFQNTRIPLHHGAGHIPALGFGTLIADPALTITATRDALAAGFRHFDCAERYRNEREVGEALRAGRAAGNIAREEIFVTTKLWNTNHRPERVEPAFEASLDRLGLDYLDLYLIHTPFAFQPGDEQDPRDQNGSVIYDEGVTLRETWSALENLVDRGRCRAIGLSDISMDRLAPIYEAARIKPAVVQVESHPYLPETELLEFCKRNGIVLLAFAPLGHGMRPGLLEDPVITSVSERVGKTAAQVLLSWAVQRGTALLTTPRSAARAKENFDISPLPEEAFNEINRIQTRQRLNPVVSTGVPGFIPRPESA

SEQ ID NO: 9897 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 9898 - protein, 358 aa, Propionibacterium acnes KPA171202
MQHILILAGGSGTRLWPLSHQGEPKQLLELIDGVSLLRMAYERVAGLVPDANILVCTGSSYADTVAKLLPEVPAENILGEPVGRDSLSAVAWPAGIIADRDPDGVMAVVTADHIIRPVDDFRAALQHGFDLANTDPTALVTFGVVPTEPNTGFGYLHRGGRLRPGSRAHQVLEFVEKPSAEVARQYLDSGEYWWNSGMFVWRAATLLDCLSQLKPQTRHHVDELVADPSRLAEVYPCMEKVSVDIAVMEPASHGGCGVHVAAIPLEIQWYDVGSYEALAPHLPSDGMGNNVSGLTVSVDSAGNLLINDRPDAVLAVAGLHDMAVVSTDRATLVVPMSQSQQVKAVVAEVAARVGARYA

SEQ ID NO: 9899 - protein, 821 aa, Sinorhizobium meliloti
MMTRLSTTELPQPALRSSEPSQLAVEILERLKYRIGKDPKVAKPHDWLTAAILVARDRITDKWMDSTRKTYSTGAKRVYYMSLEFLIGRMMRDAMTNLGLMDEMRDALASLGVDIDVVAALEPDAALGNGGLGRLAACFMESMATVDVPAYGYGIRYMHGLFRQQMADGWQVELPETWLAHGNPWEFERRESSYEIGFGGSVETVNIDEEVQRYVWKPAERVIATAFDTPAVGWRATRVNTLRLWAAQPIDPILLHAFNAGDHIGALRESNKAESLTRVLYPADATPAGQELRLRQEYFFSSASLQDILRRHLQQYPDFTSLPDAVAIQLNDTHPAVSVAELVRLLTDVHGLDFEQAWDISRRTFSYTNHTLLPEALESWPVPLFERLLPRHMQIVYAINAKILIEARRERHATDEAIRNISLIDETGDRRVRMGNLAFVGSHSINGVSALHTELMKETVFADLHALYPDRINNKTNGITPRRWLMQCNPGLFGLIREAIGDEFMDNTEALQALDAFADKADFQEHFAAVKRANKVRLAKLVQANLGIRIDPSAMFDIQIKRIHEYKRQLLNLIEAVALYDQIRSHPELDWVPRVKLFAGKAAPSYHNAKLIIKLANDIARVINNDPAVRGLLKVVFVPNYNVSLAEVMVPAADLSEQISTAGMEASGTGNMKFALNGALTIGTLDGANVEMRDWVGEENIKIFGMTAEEVGKARAEGHNPRAVIENSRELSQALDAIASGVFSPDDRNRFSGLVDGLYNHDWFMVAADFEAYAKAQREIDQLWTTPSAWYSKAVRNTARMGWFSSDRTIRQYAGEIWRAG

SEQ ID NO: 9900 - protein, 514 aa, Shewanella sp. ANA-3
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYELITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 9901 - protein, 308 aa, Medicago truncatula
MDSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVSLKVRYRQRITILRGNHESRQITQVYGFYDECLRKYGSANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 9902 - protein, 395 aa, Clostridium thermocellum ATCC 27405
MVVSKKALSISPSSTLAIDAKAKKMRSEGIDIIGFGAGEPDFDTPDHIKKAAIDAINAGFTKYTPASGTLELKQAICRKFKRDNGLDYNPSNIVISNGAKHSLVNALQAICNPGDEVIIPTPAWVSYPEMVKLADGVPVYIHCSEEEGFKFTIDKLEKAITDKTRAIIINSPSNPTGMIYSEEELRAVADLAVSKGIYIISDEIYEKLIYDGYKHVSIASFNDKIKDLTIVVNGVSKSYAMTGWRIGYTASNEQIAKIMANVQSHATSNPNSIAQKAALAALEGPQEIIDEMSAEFVKRRDYMVDRINSMNGVSCIKPNGAFYVMMNISKLIGKEIAGMKITGSDSFAEALLEKANVALVPGSGFGTDIHVRLSYATSMENIVEGLNRIEKFLSM

SEQ ID NO: 9903 - protein, 161 aa, Vibrio sp. Ex25
MAITSEFLQSSVVFLSAAVIAVPIAQRLGLGSVLGYLLAGVLIGPWGLGLISDVDAILHFAELGVVLLLFLIGLELNPKKLWQMRGPILGLGGAQVVVTTAVLGSVVSMFGVSMQVSLVIGMGLALSSTAIALKVIEEQGLNGTETGQSGFAVLLFQDIAV

SEQ ID NO: 9904 - protein, 482 aa, Salmonella enterica subsp. enterica serovar Urbana
MSDVSLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCNAIKKAVPIAENGNIVTFGIIPEYAETGYGYIERGAPFSVNGNSTGIDFYHVKNFVEKPERLTAEKYISAGNYFWNSGMFMFKASVYLNELKKFRPDIYSICEQVVSSSYRDLDFIRIPEALFKDCPAESVDFAVMEKTEHCIVCPINIGWSDVGSWQSLWDISEKTNEGDVCKGDILTYNTKNNYIYSESALVAAVGVEDIVIVQTKDAILVSKKSDVQDVKKIVEMLKTQDRTEYISHREVFRPWGKFDSIDQGERYRVKKIVVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 9905 - protein, 338 aa, Zea mays
RVDEIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 9906 - protein, 469 aa, Pseudomonas aeruginosa PAO1
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 9907 - protein, 925 aa, Aspergillus nidulans FGSC A4
MAPSSQAAQRIEEARALAKKDASQAASIYKEVLAQGPGSTESSSRDYENALVGLGELYRDEKKPQEIAELIKTSRDSFSSFAKAKTAKLVRQLLDLFSEIPNTLDIQIAVIRSCIEWAVAERRSFLRQNLETRLVAIFMQKQSYYDALNLINSLLRELKRLDDKLMLVEVQLLESRVYHALGNQAKARAALTAARTSAASVYTPPNLQAGLDMQSGMLHAEDKDFNTSYSYFIEALEGYSSLDEGEKATAALQYMLLCKIMLNLVDDVTTLLGSKQAQKYASPRLEAMKAVARAHANRSLEEYEKALSDYRFELGSDAFIRNHLRRLYDAMLEQNLIKVIEPFSRVELDHIAKMVGLDTQQVERKLSQMILDKVIIGVLDQGAGCLIVYDETERDQAYDAALETIARLNFFGFPDKLPIMNAPPMPPGYGRAYPQGVQRSPATPRRGPQAPGPMPVPMPQHAVPPQYMAPQRNLQHQNDAALRRSRKPTDKNIPDGVEDVVIGEGVQQYKSLRDLEKRLDAAIVRKRLDIQDSISKTVKKYRTMRIWVSNTVENQPWQTGQNGSVPGTTPGSGRYKVRIEGRLLEDVSDLAEKDSDDEGGAQGPGDAMAEDGSDGKKAATTKRSEQRFSHFFKSITVDFDKSPSTSPAEMQTITWTKPQVPPNAVNLPPNADFDSVQFSRASQENLNVTISLVRDETPERYKLSKELAEVLDVEEETRSGIVLGIWDYIRAMGLQEDEEKRLVRCDDRLRAIFGRDQMFFPQIPESIGPHTSPLDPIKLPYTIRVDEEFHKDPTPTVYDIQVAVEDPLRSKMLALTQNPQYAAGMRQIAQLDDQVALIIQALTHSRAKHSFFTALSKDPATFVRRWINSQRRDLETILGEATRGGGEDASGPEFRRGGSNSVWDTAVAHEAVRYMLAKPDAGMSR

SEQ ID NO: 9908 - protein, 482 aa, Salmonella enterica subsp. salamae serovar Greenside
MSDVPLIAVVMAGGTGSRLWPLSRELYPKQFLQFSGENSLLQTTLLRLSALACKDPLVITNEQHRFIVAEQLRQIDQLHDNIILEPCGRNTAPAIALAAFSALKRNEQEDPLLLVLAADHVIAKENVFCNAIKKAVPIAENGNIVTFGIIPEYAETGYGYIERGALFSVNGNSTETSFYHVRNFVEKPDRLTAEKYISTGNYFWNSGMFMFKASVYLNELKKFRPDIYSVCEQVVSASYRDLDFIRIPEALFKDCPAESIDFAVMEKTEHCILCPIDIGWSDVGSWQSLWDISEKTDEGDVCKGDILTYNTKNNYIYSESALVAAVGVEDIVIVQTKDAILVSKKSDVQDVKKIVEMLKARDRTEYISHHEVFRPWGKFDSIDQGERYKVKKIIVKPGEGLSLRMHHHRSEHWIVLSGTAKVTLDDKTMLITANESIYIPLGATYSLENPGVIPLNLIEVSSGDYLGEDDIVRQKERYRKDN

SEQ ID NO: 9909 - protein, 205 aa, Triticum aestivum
MGKSDFLTPKAIANRIKAKGLQKLRWYCQMCQKQCRDENGFKCHCMSESHQRQMAIFGQAPDRVVEGFSDEFLEEFLTLLRRAHRSSRVAATVIYNEFIADRHHVHMNSTRWATLTEFVKFLGREGHAKVEDTPKGWFITYIDRDSEQAIKARLKRKRVKSDLAEDERQELMIARQIERAQKAQANGEEDDDANADDDLGSEDDE

SEQ ID NO: 9910 - protein, 321 aa, Crocosphaera watsonii WH 8501
MVENRQSTVVITGASSGVGLYAAKALADRGWYVVMACRNQPKAHQAAQSLGIALDAYTVMHIDLGNLDSVRQFAQDFRATGKTLDALVCNAAIYMPLLKEPLRSPEGYELSMTTNHLGHFLLCNLMLEDLSHSSAPEKRMVILGTVTHNPDELGGKIPPRPDLGNLEGFADGFKEPISMVDGKNFEPVKAYKDSKVCNVLTMRELDRRYHESTGIVFTSLYPGCVADTPLFRNHYPLFQKIFPWFQKNVTGGYVSQELAGERVADVVTKPEYGESGSYWSWGNRQKKDRQAAFVQNVSPQAQDEAKAEKMWNLSEKLVGLA

SEQ ID NO: 9911 - protein, 279 aa, Propionibacterium acnes KPA171202
MPSTPSPIADRVLELAGDTLFTGPRGGGVTCIDSTGSTNADMAAFVRAGGTSFCLLVADHQEGGRGRFTRSWQDVPGTSLAISALVPNDRPSQDWGWLSMVAGLAVVKVIKEVGGADRSRVTLKWPNDVLVDLDTDQGGKVCGILSERVDGPAGPHAVIGIGINVSMGRDELPLPTATSLALCGLNHDKNELLASLLIHLDELLTVWLETGTVRDQYVARCDTIGTPVRLTFDPEIVGGGEGAIEGIGVDVDVDGAIVVETSDGRRSFNAADVHHLRTR

SEQ ID NO: 9912 - protein, 445 aa, Oceanobacillus iheyensis HTE831
MGKSFTKDEVIKQIKEENVKFIRLQFTDMLGTIKNVEIPYSQLDKALDNKMTFDGSSIEGFVRIEESDMLLYPDLDTFVVFPWTSEKGKVARFICDIYNPDGTPFEGCPRYNLKRNLKKMEELGFDAFNIGTEPEFFLFKLDEKGEPTLELNDHGGYFDLAPTDLGENCRRDIVLELEEMGFEIEASHHEVAPGQHEIDFKYSDAVKHADDIQTFKLVVKTIARKHNLHATFMPKPLFGVNGSGMHVNMSLFNGKENAFYDTSGELELSNTAYQFIAGIIKHATNFTAVTNPTVNSYKRLVPGYEAPCYVAWSGSNRSPLIRIPSSRGLSTRIEVRSVDPAANPYMALSVLLASGLDGIEQGLEAPESVDRNIYVMDKAEREANGVQDLPATLKDAMENLKKDKILVDSLGEHLFEHFIEAKEIEWDMFRTTVHPWEREQYLSNY

SEQ ID NO: 9913 - protein, 79 aa, Triticum aestivum
NVTHPELGVTVQLPIISVKKNPQNQMYTQLGVLTKGTIIEVNVSELGMVTAGGKVVWGRWAQITNNCENDGCVNAVLLI

SEQ ID NO: 9914 - protein, 416 aa, Cleome spinosa
MASAKLSGPPGVSPEDDGEDQADIVPVSETDGETVAFPVFYQTDSRACNPYYPFSDSNSDSGSVSCPDAGPDPDGSFIDFFDESYEVGAVEEFYSDPDPGLRIVGDFNLWGFPDEEEDDVAELGLGLGLGPGTGSDQQRGDSGGQGLRVTGIDSDSDFEDGVFDLNASDDGNGANASGRVVDGTGTPPVWDSFFGEEAVVTNEELEWEEVQNAITWTHEPVEVRVLNRPEEEEELSSSSRISSRDDHEHDLDWQVLLAVNNVVNYIEQAEGISITADDIDANYYMYLASIDEYGENHGDFDAIFGQMLDTDTGISGSPPAAKRVVEDLPLVELTVDDLGKGDIVCAVCKDEMAIEEKVRRLPCRHFYHEDCILPWLGIRNTCPVCRHELPTDDPEYESARRLQRSGSGLARELSGR

SEQ ID NO: 9915 - protein, 481 aa, Cryptococcus neoformans var. neoformans JEC21
MSQDPYTTKASDVNMDDNTSTDKNVSLSRVVTALEPEQVQVVDGVWGTLDESAPNYRSLGWIRASVLMIKVQIGLGVLAIPAVLHTFGLIPAILIIFAVAVATTWADYVVGVFKQNHPEVYTLADVGYIMWGPIGREVFGAVYWIQLTAVAGAGLLSISVALNAMSGHGTCTIVFVVAAAIINILVSSIQTLDRISWIGWIGLVGIMSSVIALAIAVSVQDRPSAAPATGDWSPDIVLVGNPSFSAAIGALSNIIFSFAGAPNFFNIVAEMKNPRDFNKALISCQTFVTAAYLIIGCVVYHYCGQYITSPALGSAGILMKKVCYGLAFPGLVVGCVLNTHLPAKYIFVRLMRNSKHLSANTIQHRVIWISCVVFNCTVSFVIAEGIPIFNDLIGLIGALFATPNAIIFECMMYIWDVYYCADKYPSQHTWKQRSIQAFNVIIMLLSIFAMVAGTYAAAVTIRDDVASNATSKPFSCDDNSG

SEQ ID NO: 9916 - protein, 151 aa, Candida albicans SC5314
MSDERTFIAIKPDGVQRGLISSILGRFEQRGFKLVGIKLVQPTESLLRTHYEDLQSKPFFPSLLSYMLSGPVLATVWEGKDVVKQGRAILGATNPLQSAPGTIRGDFAIDMGRNVCHGSDSVESANKEIDLWFKKEELVEYKPALFGWIYE

SEQ ID NO: 9917 - protein, 359 aa, Salicornia herbacea
MSAFVGKYADELIKTAKYIATPGKGILAADESTGTIGKRLASINVENVESNRQTLRELLFTSPGALPFLSGVILFEETLYQKTSQGKPFAQLLQENGVIPGIKVDKGVVELSGTNGETTTQGFDSLGARCQEYYKAGARFAKWRAVLKIGPTEPSELSIQQNAQGLARYAIICQENGLVPIVEPEVLTDGNHDIKKCAAVTETVHAACYKALNDQHVLLEGTLLKPNMVTPGSDSPKVAAEVIAEYTVTALRRTVPPAVPGIVFLSGGQSEEEATVNLNAMIKLEVLKPWTLSFSFGRALQQSTLKTWGGKKENLSKAQSVFLVRCKANSEATLGKYVAAGNSDNGAASESLFQKDYKY

SEQ ID NO: 9918 - protein, 271 aa, Xanthomonas axonopodis pv. citri str. 306
MSSHADSKPWTVPALAQAKREGRKLVMLTAYDAGFARTFDANGVDLILVGDSLGMVVQGHDSTLPVTTADMVYHTASVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLLVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 9919 - protein, 478 aa, Bifidobacterium longum DJO10A
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENSMQRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLAPTPLEYELYFHI

SEQ ID NO: 9920 - protein, 150 aa, Francisella tularensis subsp. tularensis
SDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 9921 - protein, 241 aa, Zea mays
VVTGGNRGMGLEICRQLAGHGLAVVLTARDDKRGAEAAETLREEGLSDVAFHQLEISEPASAARLAAFVKKKFGKLDILVNNAGVLGVTTDVGDPATLQETLAGKDGMERAEWLRQRTTQTTQDAEDCLRINYHGNKTVTEALLPLLRSSSDGRIVNVTSAWGLLRYFSGDELRRELDDVANLTTQRLDEMSDLFLEDLGKGNGALERRGWPADPVYAAYMASKALVCAYTRVIAREEGAA

SEQ ID NO: 9922 - protein, 363 aa, Vicia faba
MAAAVTAAVSLPYSNSTSLPIRTSIVAPERLVFKKVSLNSVSISGRVGTIRAQITTEAEAPVTKVVKHSKKQDEGIVVNKFKPKEPYVGRCLLNTKITGDDAPGETWHMVFTTEGEVPYREGQSIGIVPDGIDKNGKPHKLRLYSIASSAIGDFGDSKTVSLCVKRLVYTNDAGEVVKGVCSNFLCDLKPGSEVKITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSIRPKDGIDWIEYKRTLKKAEQWNVEVY

SEQ ID NO: 9923 - protein, 560 aa, Arabidopsis thaliana
MADSKSGDTEVAHRSSDPSEKRGGWITLPFMLVTLLGMSITSFGWGMNLIVFLIEEFHIKNIAAAQISNVVNGVVNMLPVVAAILADSFFGNIPVISTSTFISLAGTSLLTLITSLNYLMPRPCETGSILCQSPSKLQLGILYVALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDVKT

SEQ ID NO: 9924 - protein, 262 aa, Crocosphaera watsonii WH 8501
MGLTTQQLISWKQQGRPIVALTAWDYAFAQLLDKAGVDIILVGDSLAMVALGYETTLPVTLDEMLYHAAAVRRGVKRALVVCDLPFLSYQESISQAIHAAGRVLKETGVQGVKLEGGHPASLETVARLSDIGIPVMGHVGLTPQSVHRLGYRQQGNTEAEAERILSEAIALSEAGAFAVVLEHIPANLARIITTKLPIPTIGIGAGGDCDGQVLVTADLLGLSEKKPPFAKSYLNLREIVIGAVNDFSQEVRERKFPESDQL

SEQ ID NO: 9925 - protein, 340 aa, Glycine max
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 9926 - protein, 455 aa, Mesorhizobium loti MAFF303099
MDTQPAPFVPPAPKPRTSPPSTLEMIRIVYRNPLELWGEPTYNEPWISANGVGGHLIVANDPGLIRHVLVDNAKNYKMATVRQKILRPILRDGLLTAEGEVWKRSRKAMAPVFTPRHIFGFAQPMLKRTKEFVTRYEEGGASDIAHDMTLLTYDILAETLFSGEIAGEPGSFANEIDRLFETMGRVDPLDLLRAPDWLPRLTRIRGRKTMAYFRKIVTDTVKMREEKFRRDPDAVPQDFLTLLLKAEGPDGLTRSEVEDNIITFIGAGHETTARALGWTLYCLAESPWERNRVEQEIDEVLAREPDPTKWLDAMPLTRAAFDEALRLYPPAPSINREPIEPEMWKDLYIPRHAAVLVMPWVVHRHRKLWDRPDAFLPERFHPGNREKIDRFQYLPFGAGPRVCIGASFAMQEAIIALAILLSRFRFDTTAETKPWPVQKLTTQPQGGLPMQVTPR

SEQ ID NO: 9927 - protein, 260 aa, Burkholderia mallei ATCC 23344
MTVPKLQAMREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 9928 - protein, 333 aa, Cryptococcus neoformans var. neoformans B-3501A
MAPASHFTFNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 9929 - protein, 804 aa, Kluyveromyces lactis NRRL Y-1140
MATKSNSSNSKKKTGVSSGASEETKTKFKLPQQFIVRPIDNNADNGQGVIEINAEVMKYLELKNDNFCMISREGEKGIVGISRALKDDSSQTNVIKVGKALRSVGNLLLGERVELKKVSKQPEYLKSVSVGTVQHLQISPVPLSFVTEIENRFNQSGILMPGMIFRSLQLDEKTLVDLIIFDVNQSLEELPDTYEAVLPNVPRTSDNSLISPDSVNKSFSKLSLSEHAQDIDNNYLSSPGLFKMKATNVFVTAESEPSSKYGLPHPVLYNAVGGLKKETSILKSTVEFPLHQPQLFTDFGINPPRGILLHGPPGTGKTMLLRCVANETDAHILTISGPSIVSKYLGETEAALRDIFNEAKRYQPSIIFIDEIDSLAPNRANDDSGEVESRVVATLLTLMDGMDGSGRLAVVAATNRPNSIDPALRRPGRFDQEIEISIPDVEARHDILRKQFSRMSKQRQLLSPEDISNIASKTHGYVGADLIALCRESVMKTIQRGLNENIERDDLKVGINDVLEAMADIRPSAMREIFLETPKVYWDDIGGQEELKQKMKEMIQLPLEAAETFAKLGVSAPKGVLLYGPPGCSKTLTAKALATESGINFLAVKGPEIFNKYVGESERAIREIFRKARAASPSIIFFDEIDALSPDRDSGSGTSAANHVLTSLLNEIDGVEELKGVIIVAATNRPDEIDPALLRPGRLDRHIYVGPPSYDARLQILQKCTKKFNIDTAIVDLKALAECTDGCSGAEVVLLCQEAGLAAIMEDTTTDKVEQRHFTKALAGISRGITPEMLEYYSAFAARSGISK

SEQ ID NO: 9930 - protein, 141 aa, Pseudomonas fluorescens PfO-1; identical to SEQ ID NO: 288

SEQ ID NO: 9931 - protein, 384 aa, Burkholderia mallei ATCC 23344
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRNFFRAGLANTRFALLPCAGTYFQCVDYSAISDLPEAEFAKWLTTEIGVAAIPVSAFYHEPHESGVVRFCFAKREDTLATALERLARL

SEQ ID NO: 9932 - protein, 260 aa, Chromobacterium violaceum ATCC 12472
MSSKASVSRRVTVPAIRNSKGRRKLMALTAYSGAIAEAVDEWVDIVLIDDAVPMEGDAQPGAQSFALERMVRHTGAVARATERACVVADLPMPCCGASSEQALRSAARLLEAGAAAVRLAGGPETADTMAFLVSCGVPVMGHIRRESARAGMAPHEAAAREMERAGAFGLLLDGVDEPAARRIADEVSIPVISGPACDGQMLETEDILGLGGDFVQRYAEQYADVRAVAEQVARDHAGAQAYAAASGTRGFGAARSPAAI

SEQ ID NO: 9933 - protein, 651 aa, Triticum aestivum
  misc_feature (322)..(322): Xaa can be any naturally occurring amino acid
  unsure (1)..(651): unsure at all Xaa locations
MARTGRSVLLLLLIPTVLSLLMLSERRLTVALNPIERKDFPAEIASQGHSVKDSKLNAFPLETLSSLKEPVGAVLVEEPLHLANDSIESADQELLPGKKANRVLSETTSGDGAVLKGGDLIDQVTRRTAQDGGLATGSMDKQEKHTGSQQQSSSEGRSLEAITQIPQGYQGAGKNPQKENTDGRSKNMASSDTRVRDIKDHLIKAKVYLGLGAIRANPQYLRDLRHRIREVQKVLGEASKDSDLPKNANEKVKALELTLVKGEQTQDDCSVVVKKLRAMLHSAEEQLYAQKKQTVFLTQLAAKTLPKGLHCLPWTLANEYFXLDPSQQQFPNQEKLDDPKLYHYALFSDNILATAVVVNSTVLNAKHPSRHVFHIVTDRLNYAPMRMWFLSNPPGKATIEVQNIDEFTWLNDSSSLLLKQLGSQSMIDYYFTAQSANSDSYLKYRNPKYLSMLNHLRFYLPEIYPKLDKMVFLDGDVVVRKDITGLWSIDMKGKVNGAVDTCGESFHSFDRYLNFSSPVVAKNFDPNACVWAFGMNMFDLAEWRRQNITEIYHFWQKLNEDGLLWKLGTLPLGLVTFWNKTFPLDRSWHVLGLGYFERPPGSSSVLERAAVIHYNGNMKPWLEIGLPKFRSYWSEYLDYDQPFLRECNINP

SEQ ID NO: 9934 - protein, 150 aa, Francisella tularensis subsp. holarctica
SDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 9935 - protein, 479 aa, Cryptococcus neoformans var. neoformans JEC21
MSDDEFMMDDIADDEEYDFDYDDDDDDVEEGAVGDVENQYYKAKALKEDDAQGALKAFRTIVDDQPEKGEWGFKALKQMTKMNYLRLHEPEKALETYRELLGYTKSNVTRNYAEKTINNILDYVGGEGKHAAKAPKVPLDTLEKFYEVTRVACDEAKNERLSTKCNLKLAKLWLDRKEYTRLHPILQSLHATCAPAANSVSSDDQSKGSLLLEVYAMEIQMYSNLKETRKLKAIYNAAMQVRNAIPHPRIMGVIKECGGKMWMQEKAWGKASEDLFESFRQYDESGSAQRIQVLKYLVLNTMLMGSDINPFDSQETKPYKNDPQIVAMTNLVSAYQRRDVQEAESILKANQATITNDPFIDHFVGDLLTSLRTQYIVDIIKPYTRLELDSLADKLNIHRSEVESLVVSLILDDKIKGKIDQANGILVLDRFGMAQRKRYQALGTMAAELDILAGKVESEKLGVKDGGARAWVGSQAIFG

SEQ ID NO: 9936 - protein, 92 aa, Arabidopsis thaliana
MGKGGWLLNFLNHAKNQESVENLDKNGAVKAPSSGFKMPLHYPRYTKEDYEEMEEWRLDLLLSEYGLLAFHDNTLHEKRAFAIDTFIWPHHP

SEQ ID NO: 9937 - protein, 371 aa, Candida albicans SC5314
MLIKSNYNCINIKRFLLNQTRVSVTASNSFSFYFYFKPYKFNCYKSYSTMSTTTPTIKLNSGYEMPIVGFGCWKVTNATAADQIYNAIKTGYRLFDGAEDYGNEKEVGEGINRAIKDGLVKREELFIVSKLWNNYHSPENVEKALNKTLTDLNLEYLDLFLIHFPIAFKFVPLEEKYPPGFYCGDGDKFHYENVPLLDTWKALEKLVNLGKIKSIGISNFNGGLIYDLIRGATIKPAVLQIEHHPYLQQPRLIEFVQNQGIAITAYSSFGPQSFLELQSKRALDTPTLFEHETIKSIADKHGKSPAQVLLRWATQRNIAVIPKSNNPDRLAQNLAVVDFDLTEEDLQAISKLDIGLRFNDPWDWDKIPIFV

SEQ ID NO: 9938 - protein, 223 aa, Streptococcus agalactiae 2603V/R
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 9939 - protein, 2742 aa, Myxococcus xanthus DK 1622
MKSSFGVSQAPVDSPLVSGVSGDRTRDEIAAWLRAYVAESAELTPEEVDPQEPFVRYGLTSKDAVFLSGELADWLGRDVSPTILWEHATIDALSQALGRGTEPVTHAPATPVTEAAQDEAIAVVSLGCRFPGAPTPEAFWALLQRGGDAITEVPADRWDAASLYAPDPSTPATMNTRWGGFLEDVGAFDPLFFGISPREAVRMDPQQRLLLEVAWEALERAGQAPQGLQGSRTGVFVGISTSDYAQRQFGDRSLLDAYAGTGNAHSIAANRLSYVLGLRGPSMAVDTACSSSLVAVHLACQSLRGRECDLAMAGGVNLILSPELTIAFSQAGMMAADGRCKTFDASADGYVRSEGCGIVVLQRLSDALASGAPILAVIRGSAVNHDGLSNGLTAPSGAAQQDVIQQALRQARLSPEQIGYIEAHGTGTPLGDPIELAALRAVLSPGRSAEQRCFIGSAKSNIGHLEAAAGIAGLMKSVLALGHGEIPPQVHLRVLNPHIALDATRFPIPTRPEPWPQAPGARIAGVSAFGFGGTNAHVILSEPPPRPADAPRVPERDSHVLTLSARSDAALRNMARQYQEHLLRPNAPALADVCFTANTGRNAWPHRLALTANSHAEMASRLESFAQGHAVPRLHQGEVQRGAAPRIVFLYPGQGTQYPGMGRQLFDSTPVFREALERYDAILRPHLDVPLLSVLFPTTDATAQLIHQTRYTQPALFALGHALTELWRSWGVVPDAVMGHSVGEFTAAHAAGALGLEEALALLATRSRLIQALPQNGAMAAVLTDEATVRMALEDEPLVDVAAINGPRHVVISGEREAVQRITAALQAQGVESRPLTVSHAFHSPLLEPMLDGFEQVARVLPAHAPRLPLISNLTGERMSQAPDAAYWRRHARAPVQFFKSLQTLTQAGPALFIELGPHDTLLGMAKRCVPEGASLWLPSLRRQQDAWETLLDSLGALHTRGVTVPWRAVDADRPRRRVPLPTYPFERQRYLLDSALPSPAHRPTMMTQTSAAAPVVSRKERILTELRAVVALLLQAPPEKLDPRMSFLEMGADSLVLLDAIRNVEKRFGVKLAIRQLFEELTTLDALASHLDQTLPASFALSSAPAATSVPAPLPMSTPPAAANALSAPPGSAVEQLIQQQLQLMAQQLALLGGRPSAPLQLPVAAQEAPVPKAVPTNTAKAGGASPFGAGPKSGTPERELPAVQQRHLDALIAKYTTRTKRSKEAAVRYRSKWSDVRWLMNFRAELKEVCYPIVSVRSKGSRVWDADGNEYIDFSMGFGVHLFGHNPPFIMEALQQRLAEGMELGPQSDLGGQAAELLCELTGMKRVTFCNSGTEAVMTALRLARAATGRTKIVMFTGSYHGHSDGTLVVGRMVNGEPQSLPMAAGVSPKVVEDVLVLPYGEDRTLELIREHLHELAGVLVEPVQSRRPNLQPRAFLQALRTMTREAGVPLIFDEVITGFRLHPGGAQAWYGIEADLVTYGKVLGGGMAIGAVADRGGFVDRIDGGDWNYGDASYPAVETTFSAGTFCKHPLTMATTVATLSHLKAQGPALQENLSRRAAGLVARLNDIFQREQAPIEAVHGGSVLRFSAAGNTSYLYQSLEMDLFFCHLIQRGIYIWEGRTCMLSTAHSDEDLDTIVRAITETVADMRAGGFWPRTTPPDPTRVEARTLPMTEAQRQLWVLAQMNAGGSISYNLSMSLRLEGVLQPEVLQRAIQHVVDRHEALRIHIHESGEQQTAAASLALSLALHDLSPLPAPEQAERLSAWYEQENNTPFDLHRGAPFRANLLKLGAQEHVFVLTAHHVAVDGWSLGVIVREIAARYTELRAGKSTPPPPAMQWGEYVQWLQQQAGTKEQTAHERFWLSRRVETLPALELPIDHGRPAHRSYRGARETLRLDRATTQSLREAAAQQQSTLFMLLLSVYTTFLHRLTGQDDVLVGIPTAGRGMEGSEGLVGYCSHLLPIASHVQGEQTFSEYVQGLKQVLWEAYEHQDYPFALLIKRLGLPRSTSHTPLVSVTFNLERPLGNLQMDGLRTHFVPQPVRYAAFDLSLNVIDAEDGLVLDFDYNTDLFEAATLARWAQGFRTLLSGTLAQPEARVADLPMLTPAERRKVLVAWNQNQLGYREDLLTHQLIEQQAAARPGVHAVELDGQCITYADFNRRANQLAHHLRGLGVGPGVLVGAFIDRSPEMLVTLLAILKAGGAYVPLDPAHPVERLRFLLDDARAAVLVTKQSLAERLPAHTAKVVHLDTDAVTLASRPTENPPNTATATSPAYVIYTSGSTGEPKGVVISHGQMAVHFQDMQLHFELTERDRVLQFASFNFDASLEQILPTFMTGATLVLRGNQVWTPEELARRVVEQRLSVMNFPTAYWQQLTQSWAESPPTIGAHDLRLVIIGGDTVLPKVLELWQHGPLGNVRTLNAYGPTETLITATTFAIPKGWSATRVPIGRPLSNRPCYVLDRHGAPVPIGVAGELHIGGPLVAAGYLNRPELTAQRFVPDPFSDDPAARLYRTGDLVRYRPDGTLEFLGRSDHQVKVRGFRIELGEIESALSAHEHVQEVVVMVREEPGALAGHDKRLVAYVVPSAQGSVTPAALRQFLLEKLPDYMVPAFFVLMEAMPLTASGKLDRKALPAPDPEASAPTRPFVAPRTPTEQTLAEVWMKALRLPRVGIHDDFFELGGDSLLATQVASRLRDALKVELPLERLFKQTTIAGLAEHVDTVLWAARAAEDTSVSGASREEGEL

SEQ ID NO: 9940 - protein, 195 aa, Streptomyces sp.
YPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 9941 - protein, 381 aa, Listeria monocytogenes str. 4b F2365
MTKSIRPELRDIQVSGIRTFNTRVTGIPDMIRLTLGEPDFPTPEHVKQAAISAIEENFTNYTPNAGMPELLEAASTYFHEKYDLSYNNKEIIVTVGATEAISVALQTILEPGDEVILPDPIYPGYEPLITLNRAHPVKVDTTETNFKLTPEQLRAHITPKTKALIIPYPSNPTGVTLSKKELFALAEVLKETGIFVIADEIYSELTYHEEHVSIAPLLREQTIVINGLSKSHAMIGWRIGFLLAPEALTQEMLKIHQYSVTCASSISQKAALEALTNGKDDAFQMRTEYKTRANFTQDRLEKMGFTVIPPDGAFYFFVKLPDEITENAFDWAVKLAEEAKVAVVPGNAFSEKGDRYFRLSYATSFNNLAEALDRMAQFIAK

SEQ ID NO: 9942 - protein, 380 aa, Magnaporthe grisea 70-15
MGAPKQGLEKEDKKRDAEFNKALHGQSALAAGGIAAMFSKDKEAKKLAVDEYFKHFDNKTAANETPEERAARQKEYATLTRHYYNLATDIYEYGWGQSFHFCRFSHNESFYQAIARHEHYLAHQIGIKEGMTVLDVGCGVGGPAREIAKFTGCNVVGLNNNDYQIDRATHYAKQEKLDSQLQFVKGDFMQMSFPDESFDAVYAIEATVHAPKLEGVYSEIFRVLKPGGTFGVYEWLMTDDYDNDNLHHRDIRLKIELGNGISNMVPISEGEAAMRAAGFEIIKTDDLAQKGDELPWYWPLAGDLKYLQSYFDLFTVLRMTKWARTCLHGMAGVLEAVGVAPAGTKKTADALATGGDALVAGAKENIFTPMYLMVGRKPMN

SEQ ID NO: 9943 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 9944 - protein, 456 aa, Staphylococcus epidermidis RP62A
METIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPGVVMVDPPRKGCDETFLTTLLKLNPKRIVYISCNPSTQQRDAQILAEQYELVEITPVDMFPQTTHIETVALFVRKDEE

SEQ ID NO: 9945 - protein, 227 aa, Pasteurella multocida subsp. multocida str. Pm70
MELVFIRHGFSEWNAKNLFTGWRDVNLTERGIEEAKSAGKKLLEAGFEFDIAFTSVLTRAIKTCNIVLEESNQLWIPQVKNWRLNERHYGALQGLDKKATAEQYGDEQVHIWRRSYDISPPDLDPQDPHSAHNDRRYAHLPSDVVPDAENLKITLERVLPFWEDQIAPALLAGKRVLVTAHGNSLRALAKHIEGISDADIMDLEIPTGQPLVYKLDDNLKVVEKYYL

SEQ ID NO: 9946 - protein, 549 aa, Chromobacterium violaceum ATCC 12472
MSKDMKRAVVYQIYPKSFSSHRNQATGDLLGVVDRLDYLAWLGVDYLWLTPFYRSPQRDNGYDVSDYYSIDPAYGEMEDFELLLAEAKRRGIGVMLDIVVNHTSTEHAWFQEARKGRDNPYRDFYIWRDAPNNWQSKFGGSAWEWDEASGQYYLHLFDKTQADLNWENPAVRAEVYKMMRFWRDKGVAGFRLDVINLISKDPAFSEDDSDGRHFYTDGPRVHQHLQEMHREVFDGHDLLTVGEMSSTSLEHCIAYSRPDRRELSMTFNFHHLKVDYPDGEKWRPGAVDFIALKRILSDWQTGMHAGGGWNALFWCNHDQPRALSRFGDDGRWRTESAKMLATALHGLQGTPYIYQGEEIAMANPGFADIGQLRDVESLNAYRQLLAEGFTAADAMAVIRQRSRDNARTPMQWDDGPNAGFSAAEPWIGVAADAGSVNVATAIGDPNSTAHHYRRLIQLRKQYRVFADGDYRCLTPDHPSLWIYTRRCADEMLLAISHFGADDSHYALPAGAMPEGWTMELLLSNYPPQPPGRLRPWHSLLYRATPPAAT

SEQ ID NO: 9947 - protein, 666 aa, Burkholderia xenovorans LB400
MISPLEMTLFLLLASVAGVVTFRFLNLPPMLGYLTVGIVVGPHAFGLIPDSAGAQNLAEFGVVFLMFSIGLEFSLAKLRSMRRLVFGLGLLQVLGTIAVAVTLGFVLERWVHITWQASVALGGALAMSSTAIVSKMLAERLEIETEHGRNIFGVLLFQDLAVVPLLIVIAALGGSSKDLVSSLGVAAIKIVVALSLLLIVGQRFMTRWFNVVARRRSQELFILNLLLVTLGCAFITDKFGLSLALGAFIAGMLIAETPYRHQVEEDIKPFRDVLLGLFFITTGMLLNPRVIWEHPLIVLGFLVGPILLKAVMITGLSRLFGASPGVAMRTGIGLAQAGEFGFVLLNLILDKHLVDATLLQAILAAMLLSMLAAPFLIQNADRIVLRLSSTEWMMQSLQMTRIATQSLKQSGHVIICGYGRAGQNLARMLEHEGLSYVALDLDPDRVAAAAAAGESVVFGDAGRRESLLAAGIHRAAAIAITYANTPSALRVLHNIHELEPTLPVIVRTVDDADLEKLLAAGATEVIPEIVEGSLMLASHTLVVMGVPMRRVVRRVEEMRDERYALLRGYFHGADDVDDDDGHEQVRLQSVPVDENSDAVGRTLAELGLFEVGVEVTAIRRHGIRGVEPDPSTKLRSSDIVVLRGLPEQLAEAEERLSKHRRAGAAA

SEQ ID NO: 9948 - protein, 562 aa, Vibrio cholerae O1 biovar eltor str. N16961
MSSSTQSMPWWKTAAIYQIYPKSFCDSGAKGVGDLQGIISKLDYLQKLGIEAIWLTPIYQSPMVDNGYDIADYYAINPDFGTMQDFEQLLKEAHRRGMRIIMDIVVNHTSTEHAWFQSALGDRNSPYRDYYIWRKPVNGGVPNNWQSKFGGSAWALDEATGEYYLHLFAKEQADLNWENPQVREEVKNIIGFWAEKGVDGFRLDVINLISKQQDFTNDDIGDGRRFYTDGPRVHEYLQEISRDVFQRYGSVTVGEMSSTTLEHCQQYSALDGRELSMVFNFHHLKVDYPNGEKWTKAPFDFLQLKQIFNHWQTGLNGKGWGALFWCNHDQPRIVSRLGDDQQYRVESAKMLAATIHLMQGTPYIYQGEEIGMTNPGFTSIKQYRDVESINIHQIMVQQQGVSESDMLAILAQKSRDNSRTPMQWDASLNAGFTRGEPWIEVAHNYPEINAQAALEDPHSVFYFYRRLLSLRKKVAVITDGDYTDLLPEHKEIFAYQRRNQKQVLICLNNYYGHEAECVLPELPLDDALYLLGNYPGIELQRVLAHQVLRPYETRIILIESPL

SEQ ID NO: 9949 - protein, 340 aa, Schizosaccharomyces pombe
MKQSRTKRVLAIGELKFATNTLKRLSEKYHFEFIVPDPHDRSKTIEKIHEAASKSTFDACFWLFRNAAISPFTEEMLGPLLPTCKLFVTGAAGYNNVDVDWATRNGVYVANTPNGPTEGTANMNLMLFMCTLRGAREAEQSLRLGKWRQNLSLTDDPYGKRVGIIGMGAIGKSFAQKILPLGCEIVYHNRNRLEAEEEKRLGASFVSFDELLSSSDVISINCPLTPATHDLISTKEFEKMKDGVYIINTARGAIINEDAFIKAIKSGKVARAGLDVFLNEPTPNKFWLECDKVTIQPHCGVYTNFTVAKTEECVLASIETFLDTGIPTNPVNGPFGMNGC

SEQ ID NO: 9950 - protein, 520 aa, Cryptococcus neoformans var. neoformans B-3501A
MFYAMRTLASLAILPLVLSLQLPHFPTPQDTLELAESFIRSGHAHAGDHAAEVEMVHANDMRLSTIGDEHVILTHKKYPNHKVRIKSTTGWCDPDVKSYSGFLDVGYGKNLFFYFFESRSKPSEDPIVMWINGGPGCSSSLGMLMELGPCSVKDDPKGVNDTARNPYAWNEKANVFFLDEPIGVGFSHADNGQTVSTTEEAAIDVQAFISIFFETFKEFEGRAFHMAGESYGGRYLPVFASAVVDGNKQLIKDGKTPINLNSVMIGNGVTDYFTTTESYFPFQCTVHGDLTEPVQSIGACVAMAEAVPKCHKLAKKGCLETHDYTTCSMAINYCEEVLGETFLSAGVNPYDVTMPCTVEELADSLCYPVTKKIGTYLDLPDVRHTLGVEKLRSNWSSCDGPVFTRFTQSLDNTGKTWLYVAGLLERGVRVLNYVGMLDFICNHVANELWMERLEWSGKEGYNAAQFSDWVVDGHRAGEFKTYGNLTMLKIRGAGHMVPYDKPKEALSMVTSWLDAAALDQ

SEQ ID NO: 9951 - protein, 451 aa, Nostoc punctiforme PCC 73102
MVADVFELPAPSVNSIVGHLFELGQDPLGFLTRCRDYGDIVPLQLGLTPSCLIINPEYIEEVLKNRNDFIKSRGLRALKSLLGEGLLSAEGESWFWQRRLAQPVFHQKRINGYSQTMVEYTNRMVQTWHDGETHDIHEDMMRLTLQIVMKCIFSDDIDAGEAKVVADALDVAMQWFESKRRQNFLVWEWFPRPENIRYRDAIAQMDEAIYKLIQERRNGGEKTNDLLTMLMEAKDEQTLQQMDDKLLRDEVATLMLAGHETTANTLSWTWMLLAQNPGVREKLESELNQVLQGKLPTLEDLGQLVYTQQIIKESMRLYPPVPLMGREAAVDTQIGDYEIPQGMAIMISQWVMHRHPKYFENPEAFQPERWTQEFEKQLPKGVYIPFGDGPRICIGKGFAQMEAALLLATIAQRFQIDLVPGYPIVPQPSITLRPENGLKVQLKQIALDTSK

SEQ ID NO: 9952 - protein, 470 aa, Ehrlichia ruminantium str. Welgevonden
MFLSAEDTLNYIKKNTINFVDLRFTDSTSRWHHITRNAETINTYVLSSGVNFDSSSIPGWQSVEKSDMILLPDVSTAFVDPFTAQPTLVIICNVINPYDKSEYPKDPRYTAHKASQYMLSTGIADKCYFGPEVEFFVFDNATFYNGMYHSYFKIESSEHISQFQKREHINNSHCPKIKGGYMPTPPVDSLHDLRSEILTMLKEVGITPLIHHHEVAASQCEVGFQHDELIRSADNVQKCKYIIHGVASSYGKTATFMPKPVIGDNGSGMHCHQSLWKDNINIFVNSDGSMSEICLYYIGGIIKYGKAINAFTNPSTNSYKRLVPNFEAPTWLTYSYENRSSAIRIPYVPNTDLNAKRIEVRFPDPLANPYLCFSAQLMAGLYGIKNKIHPGPSIDKNLYTLDKKELQSFISVANSLEESLDALDNNREFLLEGDVFTNDQIDTYIKLKSSEVRDLHLHPHPIEFINYYSS

SEQ ID NO: 9953 - protein, 227 aa, Streptococcus pyogenes MGAS8232
MEALKKIAGVTAAQYVTDGMTIGLGTGSTAYYFVEEIGRRVKQEGLQVVGVTTSSVTSKQAEVLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 9954 - protein, 204 aa, Listeria monocytogenes str. 4b H7858
MDLPLSKRVKGVAPSPTLAITAKAKQMKQEGIDVIGLGAGEPDFNTPQNIIDAAIESMNKGFTKYTPSSGIIELKQAIVDKLQKDQFLNYETNQIFVGTGAKHVLYSAFQTILDPGDEVIIPVPYWVTYPEQVKLAGGIPVFVETGFDADFKISAANFEKAITKKTKAIVLNSPNNPSGMCYTKEELIAIGEVAEKHQIYILSD

SEQ ID NO: 9955 - protein, 143 aa, Brassica napus
MAAKQEASSSSIVQSNIIDDLLSRVNTATALLTYLKSKATTLVVAEDFSQLSLADDGEQQGSSISERDQTYVSEMLKHVETVTCVMDSLAKRAILAESEAAVQRGKALLSQQEVQRKSGQISSMSSKLEDMEKFALGTTSILG

SEQ ID NO: 9956 - protein, 486 aa, Streptomyces avermitilis MA-4680
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 9957 - protein, 607 aa, Zea mays
  misc_feature (92)..(92): Xaa can be any naturally occurring amino acid
  misc_feature (103)..(103): Xaa can be any naturally occurring amino acid
  misc_feature (598)..(598): Xaa can be any naturally occurring amino acid
  unsure (1)..(607): unsure at all Xaa locations
MSRKRREGGGGGRGAGPVDHHGGGKGSEAGAAATDAVSMDGGLREVSVPVVFSVWCLLFLLRSQFLHSQADDDPSSEFYEEHGMRDSYCKVXPLEAYVLPYHXTRVSPPTRTHSRPRRRPRRPRSGSPQYMATTGGNASSPEAAFVGLDEFRSRMMQGKAENDTGPPTDGGVAHRLEPNGAEYNYAAAAKGAKVLAHNKEAKGAANILGGDKDKYLRNPCSAADKFVVVELSEETLVDTVALANLEHYSSNFREFEVYGSTSYPTEAWELLGRFTAENAKHAQRFVLPEPRWTRYLRLRLVSHYGSGFYCILSYLEVYGVDAVERMLQDFIAGAGAGAGAEADASRDRAPIDFANRDADCNDTTAQQDGNGGAGRNDSTAGDGKSNSSRSGDAKLPPQVAALASPTGRIHSDGVLKILMQKMRSLELSLSTLEEYTRELNQRYGAKLPDLQNGLSQTAVALEKMKADVHDLVDGKDSVAKDLDDLKAWKSTVSGKLDDLIKENQEMRQVPFPRGAARRGGSSDRQWSVEEMRGVQETLQNKELAVLSISLFFACLALFKLACDRVFCLFAGKGREEPDAEEHTRSSRAWMLVLASSSXTTLIGLLYN

SEQ ID NO: 9958 - protein, 472 aa, Haemophilus influenzae Rd KW20
MPNANAIANVFKLIEENNVKFVLLRFTDIKGKEHGVSIPVSLVDEDMFEDGKMFDGSSVEGWKTINKADMLLMPMAETAIVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 9959 - protein, 312 aa, Oryza sativa
KGVDVVAINDPFIDVTYMVYMFKYDSTHGRFKGDAHEEGGMLVVNGKKIQVFQESDPSNIPWAKAGAEYVVESTGVFTTLEKAEAHRKAGAKKVIISAPSPDAPMFVMGVNHEKYEPGMNIVSNASCTTNCLAPLAKVIHDNFTIVEGLMTTVHAATATQKTVDGPSKKDWRGGRGAAQNIIPSSTGAAKAVGKVIPELNGKLTGMAFRVPTPDVSVVDLTVRLGKDATYDQIKAAVKAAANSDQWKGVLGYTEDEVVSTDFLGDTHSSIFDAKAGISLSPTFVKLVAWYDNEYGYSNRVVALIKYMKTKDN

SEQ ID NO: 9960 - protein, 456 aa, Xanthobacter autotrophicus Py2
MMYLIAAIAGIAGALFGFDEGVIAGALAPLRRDLGIDPVAEGMMTAAVPFGAFLGAIVGGRLALALGRRRLLLAAAVLFVVGALLSAFAFGLWTLTFARLIIGLGVGVAAMMAPLYISECAPAAQRGMLVSIYQLAITLGILGAYVVGYAFHESWRWMFAVGAVPAIALFVGIFGLSDTPRWLAVRGREAEARAALARVREKSESDPAVKAEFAEILTGATQDENRKARLSDLLTPRVRPALIVAMGLFLLQQLSGINAVIYYAPTVFELSGFSSTTTQILATAGIGVVNVLMTLVGMALIDRLGRRLLLLIGFAGTAVALSVIAIGAATGSEMMGKLALGGLVLYIASFAIAIGPLPWVMMSEVFPLDVRALGMSIASLVNWGFNFLVVFSFPVLVAEFGLAGVFGLYAVVCVVGLAFTQWLVPETSGVSLEEIERHLDSGRPLRDLGRFTPRAA

SEQ ID NO: 9961 - protein, 164 aa, Oryza sativa (japonica cultivar-group)
MKAPADHHHHHHSSTPPPATKISIPISAAAGGAEAALLGKGRYKAWALAAIALLALWSMFAASVTIRWSSGDLAAEFGDLPDPLIDDLDPLEMEDREKLVRRMWDVYTRTGVDRVRLPRFWQEAFEAAYEELAGDDTQASETAVSEIARMSVHRPELEQSSNKY

SEQ ID NO: 9962 - protein, 287 aa, Bacillus anthracis
MKKKNHKYRGKKLNRGESPNFSGQHLMHNKKLIEEIVDRANISIDDTVLELGAGKGALTTVLSQKAGKVLAVENDSKFVDILTRKTAQHSNTKIIHQDIMKIHLPKEKFVVVSNIPYAITTPIMKMLLNNPASGFQKGIIVMEKGAAKRFTSKFIKNSYVLAWRMWFDIGIVREISKEHFSPPPKVDSAMVRITRKKDAPLSHKHYIAFRGLAEYALKEPNIPLCVRLRGIFTPRQMKHLRKSLKINNEKTVGTLTENQWAVIFNTMTQYVMHHKWPRANKRKPGEI

SEQ ID NO: 9963 - protein, 444 aa, Xanthobacter autotrophicus Py2
MKTLLLTASLVLLFGILFGFSTASIAGVVEAIAQAFALSTRATEMVVTSLLVGCFIGAAAAAPVSARIGRRPACLLAAVLAMAGYSLIPLGQGVAPGAGMLVAARILIGLGVGLSSMVVPMYAAEVTPARHRGAVVSLFQLAITLGILAGYAVPLALIGRASWQQMLGGGVLVAAACAAIVLLLPESPRWLRSRGMSARADAAARALGISDEMGEEHAPDGANWRAVLGRGATGAVLVLCSVLFVLQNFSGIDGILYYAPHIFTELGFPAGTAALAATFGLGLFNVIATIAAMALVDRLGRRPLLIVGSAAMAVSLGAVIVAALADWPWVALAGLCAYIVAFALSLGPLPYVLMSELFPSAIRERGIAVASATSWLFNGIVAGTFLSVVQGIGLAGTIGIFFVVCVLSLVVSVLFVPETRRIGLEEIEADVLDGRPLRQLGAGG

SEQ ID NO: 9964 - protein, 428 aa, Staphylococcus aureus subsp. aureus MSSA476
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRNITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 9965 - protein, 458 aa, Escherichia coli O157:H7 EDL933
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 9966 - protein, 448 aa, Glycine max
MSDHLPWAVPLGLDEFKSRAISSKIKSGTSGSSGSVMHRVEPGGAEYNYASASMGAKLLGSNKEAKGASNILSRDKDKYLRNPCSAEDKFVIIELSEETLVDTIEIANFEHHSSNLKAFELLGSLSFPTDVWVFLGNFTASNVRHAQRFVLQQPKWVRYLKLNLQSHYGSEFYCTLSVVEVYGVDAVERMLEDLIHTQDNLLAPGDGNADKMTVSPHPNPPESEDAHQNTFGGINSYPASDISSANHEKLNSNVPDPVEEIRQQVGRMPGDTVLKILMQKVRTLDLNLFVLERYMEDLNTRYVNIFKEYSKDIGGKDILIQNIKEDIRNLVDQQDAITKDGSDLKSWKSHISMQFGHLLRDNAVLRSEVNEVRRKQASLENKGVLVFLVCCIFSMLVILRLSLDMATSVYRVLQSVNRTDCSRKFCAVSSSWFLLLLNCIIIIFILTL

SEQ ID NO: 9967 - protein, 1214 aa, Oryza sativa
AMADIKLGLDPVPKPTDSVAASAGAAAANAAAAASASSAEAPPDQLDTVVCVVAARGVAEQRVEPNIEAMAEAGLLVLERKKVELTPEVAAVFTVDPSARRAPASDTRKGQTEEAVARADGKRGPGLELAVELANIPEAKHLAVELFVSATGAGGANSARAKSIATQTETVTGNANPKFQTHLFVPYQPFHDSVAPTALGDEKDVKTAPALGVEYELRVLNRASAASPAATDLLAVVPLDSKQLTATTGSLAFPLSNHSDAAVDAKLKQSGAVLTIRAAPSKTSIRPDRVLIHVTARNLPVAPPPPKPKAKPEIGPDGEPLPPKPTATGLPEAILPEPLGHSVVCVLVPKRPTQDNGEQLTEAIVGNSNPTFTVPFSVPRPTDSEVEPDSVMSPANQYDLQIWAASTDAPQTPAALAAAASNPRGDLLATIQVNVSKLIDSPGGYQSFVLADSATSELNPHDQTVRIAKAAAAGKGWGEKLLAADASVTIVGVTTQPSEEGQLHLNKDELASVRAFTSGPVVCLLVRGANAFIKLKHLTLIRELDFMYFSAETWSALRDSLLLFPQRHGRGLSQQRVERTLAVLKPGTTAPELEAVLRAVDDVDMVVVARDKRVIDAKVAKQLWPTADAEELAYLSSDVSEVLVLEAPGAVDQWQLLLGPADPTEATKRAPQSLRGRFARSRVRNLAYGSLTPTQAKADIALLFRDPFPLQRTLAIIKPDAVAAGSTDAILSVVTEQYGFAVLATERTRLSKPRAEQFYAEHQGKPFFNSLVDFMSSGPIVALCLAKPAAITSWRKLIGPTRRHEALSKKPHSLRARFGHSDTQNACHGSEHDKAAEREIQFFFPQLPAESLPTEVEQLKAIFNAKPFAPRGPNAKAPKSLNDVLVDGLTALCRERPLKLDAVKWLGQWLLKNNPNQPTVEVADPSDAHTAPGKGADSKIKFIGSADRDEKVATVAAPVTPVVSGPVAAPPAPRKMVWVVGPPGVGKNTLCARLAKEFGYEHVNVGNLCRSAIRAGSDYADLLTDCALNGRVVPSSVVVRLLQQAMRASPSANNRWLISDFPASLDQAFDFESATGGAVSFIVHLTCASDVTLKQRIEQRTATTPAFARRSEDNPASVDKRLALFREDILPQVLSQFAQFPGKVRAVNVDGDVSDAYARLKALFEPKVLAAPDAAAGAGAGAAPAVASPKKGKKTVGAPAPAPPAVEYMKINGV

SEQ ID NO: 9968 - protein, 453 aa, Listeria monocytogenes
MEASLLKKNQSIELTIEDLTHDGSGVGKIDGYPFFIPNTLPGEKVTAKIIKLNKNYGFARMENIETVSANRVEPPCAVYSKCGGCSLQHLSYDGQLEFKRNQVEETMKRIGKLNVEVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRDLVEQLELTSIVQNINPHKTNVIFGDRTKTLWGKDIIEDTIHGIRFAISARSFYQVNPLQTEVLYQQAIDAAELTGEETVIDAYCGIGSISLCLAKKAKHVYGVEIVDQAIQDARANAELNELANTTFETGKAEEVIPSWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 9969 - protein, 346 aa, Gossypium hirsutum
MSKAGALDLASGLGGKIEKAEVLSAVEQYERYHVFYGGEEEERKANYTDMVNKYYDLVTSFYEFGWGESFHFAPRWNGESLKESIKRHEHFLALQLGLKPGHKVLDVGCGIGGPLREIARFSSTSVTGINNNEYQITRGKELNRIAGVEKTCNFVKADFMKMPFPDSAFDAVYAIEATCHAPDAYGCYKEIYRVLKPGQYFAAYEWCMTDSFDPNNSEHQKIKAEIEIGDGLPDIRLTGQCLEALKEAGFEIIWEKDLAVGSPLPWYLPLDTSHFSLSSFRLTSVGRFITRNMVKALEFVGLAPKGSQRVQDFLEKAAEGLVEGGRKEIFTPMYFFLARKPLSESQ

SEQ ID NO: 9970 - protein, 1820 aa, Oryza sativa
  misc_feature (1662)..(1662): Xaa can be any naturally occurring amino acid
  unsure (1)..(1820): unsure at all Xaa locations
MQKGQRVQELAAELGTVERTLAQPGLKERERSALTHKQRQLKYQLQTLCGYDKLNDVLDYGDKLLLAPPPMHGEWLPRAAVFVLVDLMVVMVARPKGIFKECGKRIHSGLELIRGELSKLGIVDGVTEANLGHSTIWTSWPVFDCFYLQFLENKVAVELTRSEFVEAQEALAQMINWFTRFPTILRGCENTIEMLRGQYAHSVGCFDEAAFHFLEAARLTDSRSMQSMCQVYASVSYICMGDAESTSQALELVGPAYRTMDSFVGVREKTCIIFVYGLLLMRQQNPQEARLRLAGGLRIAHQQLGNIQLVSQYLTILGTLALQLHDCGQAREILKSSLTLAKTLYDIPTQIWILSVFTELYRELKERENEMENSEYERKKEDDLQRRLSEAHSSPFHQELPRLTHEAPFQVEKTRIQVQQLHNFSREQQGMPGPTTAKADLDIPESVGLYAAQPSSVKRLIEPSSGAAANVYRHASYIGESQKLCAALVLKSFSNCQVPTAYFRRMESDGEDTPAAAARACGAGHRASHSLPTSAGGRVCLSCAAALLSSAASAPAHHVSHALAALSLALADPAFLAPLRAAHPRLLAAPLAEALAGAASRRDAALAAQASDLAADLAAAVGSPAASDLVARVARALSSGSLVKHLHTLHCLGILLNSTKDAATYIGDKQSLYLNLVNNLRLPRLIPLHIDTFLALRITLSDSILNLFWYSDEIRGEILFVLYKLSLLNATPWDDICDNDNVDLSAIGRSLLQFSLEVLLKTQNDDVRLNCIALLLTLAKKGAFDILLLSDPSLINSAEAEDNVPLNDSLVILFAEAVKGSLLSTNIEVQTGTLELIFHFLSSDANIFVLKTLIDQNVADYVFEVLRLSGNNDPLVISSIKVLSILANSEERFKEKLAIAVSTLLPVLHYVSEIPFHPVQSQVLRLVCISIINCSGILSLSQEEQIACTLSAILRRHGNGELGMSSETFALVCSMLVEILKLPSADDIQKLPSFIVEASKHAISLTFSHEYDCLFLIPHSLLLLKEALIFCLEGNKDQILRKKSLEDSIIETCETYLLPWLESAIVDGNDEETLSGILQIFQIILSRASDNKSFKFAEMLASSSWFSLSFGFMGLFPTDHVKSAVYLVISSIVDKVLGISYGETIRDACIYLPPDPAELLYLLGQCSSEDFNLASCQCAILVILYVCSFYNERLAADNQILASVEQYILLNGAKFPHEIPGSLMLTLLVHLYAFVRGISFRFGIPHSPEAEKTLFHAMTHKEWDLLLIRVHLIALKWLFQNEELMEPLSFHLLNFCKFFCEDRTVMLSSSTQLVDIQLIAELVYSGETCISSLLVSLLSQMIKESAEDEVLSVVNVITEILVSFPCTSDQFVSCGIVDALGSIYLSLCSSRIKSVCSLLIFNILHSASAMTFTCDDDAWLALTMKLLDCFNSSLAYTSNEQEWKILIGILCLILNHSANKVLIEPAKAIILNNCLALLMDGIVQEACAKGPSLFQHNQETTFGELLILMLLLIFFSLRSLQAILEASIDWQEFLQYSDDTESSSVLGIPCHDLCRLMHFGPSPVKLIASQCLLELLNRISDQRSCLNAELRCSAKYLKSMIAVTEGMVFDQDSRVAENCGACLTVILGWERFGSREKAVIRESKWSRLILEEFAVALTAPGXTSKSFSNQQKIAANIALSLLQLSQVPDWLTSLFSDSLISGIVANLSARNVTAEIVTLFSELMAKNYLNQEHIAGLHNLFQVCRRQAYEGGGGSKAQPSEQKAAAARCADDVRALLFGMMLEQRACSRATVEMEQQRLLREIDSFFFQESSLREQNSVK

SEQ ID NO: 9971 - protein, 243 aa, Haloquadratum walsbyi
MDTNADINPSTANMDTTTDRYIESSETVTAAVTAFRDGDPVLVHDFTDREGETDIIYPARAIDADAIARLRNDAGGLICTAVSDTVATTLELPFLEDIIEHPTTADHDLGYDSRSSFSLPVNHRETFTGITDDDRAQTIHRLGTVAEAADAGEYTAEDFAAEFRTPGHVNILRGAPKLLTDRRGHTELGLALADAADCAPAVVVCEMLDDATGNATAPTDAQTYAEKNDIVFIDGAAVVTELG

SEQ ID NO: 9972 - protein, 139 aa, Triticum aestivum
  misc_feature (28)..(28): Xaa can be any naturally occurring amino acid
  misc_feature (38)..(38): Xaa can be any naturally occurring amino acid
  misc_feature (66)..(66): Xaa can be any naturally occurring amino acid
  misc_feature (83)..(83): Xaa can be any naturally occurring amino acid
  misc_feature (97)..(97): Xaa can be any naturally occurring amino acid
  unsure (1)..(139): unsure at all Xaa locations
NCKTFTAVEPIPGLLEWRIIYVGSAKNXEYDQVLEEFXIGPVQEEATMKFTVECPPPDFTRIPRDXLICVTAIIITVSYRAQXFIRVGYYVHNVLNXTLPEEERPNAEPATLIAHTRRTILTDKPRITKFRINWGEHRE

SEQ ID NO: 9973 - protein, 331 aa, Vibrio parahaemolyticus RIMD 2210633
MTIKVGINGFGRIGRFVFRAAQERADIEVVGINDLIDVEYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDNFVKVVSWYDNEIGYSNKVLDLIAHISK

SEQ ID NO: 9974 - protein, 274 aa, Coxiella burnetii RSA 493
MNTSNITFIGGGNMARNIVVGLIANGYDPNRICVTNRSLDKLDFFKEKCGVHTTQDNRQGALNADVVVLAVKPHQIKMVCEELKDILSETKILVISLAVGVTTPLIEKWLGKASRIVRAMPNTPSSVRAGATGLFANETVDKDQKNLAESIMRAVGLVIWVSSEDQIEKIAALSGSGPAYIFLIMEALQEAAEQLGLTKETAELLTEQTVLGAARMALETEQSVVQLRQFVTSPGGTTEQAIKVLESGNLRELFIKALTAAVNRAKELSKTVDQ

SEQ ID NO: 9975 - protein, 294 aa, Spirulina sp.
AKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 9976 - protein, 94 aa, Arabidopsis thaliana
  misc_feature (25)..(25): Xaa can be any naturally occurring amino acid
  misc_feature (60)..(60): Xaa can be any naturally occurring amino acid
  misc_feature (65)..(65): Xaa can be any naturally occurring amino acid
  unsure (1)..(94): unsure at all Xaa locations
PLWLRHLLKYLPPQATMVAPFTGLXSSTSFPVTRKANNYITSITNNTGRLSCIKVWPPIXRRSFXTLSYLPDLSDLELPKEVDYLLLNKYIPCV

SEQ ID NO: 9977 - protein, 211 aa, Ehrlichia ruminantium str. Welgevonden
MGIIVSENPSFISSIEDIIEDAKAGKVFVLIDDEQRENEGDLVVLAEKVTTDAINLMVTHGSGIVCLSITEDLMYKLGLELIPRRNINNNSASFATSIDARYGITTGVSVHDRVRTILTAVSKNVTMDDLVTPGHIFPIVSKKGGVLERLGHTEASVDIAKIAGLTPAAVVCELMNPDGTMSRLSDIIEFSQRYDIKVTTIAKLVEYINTH

SEQ ID NO: 9978 - protein, 297 aa, Streptomyces coelicolor A3(2)
MDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 9979 - protein, 218 aa, Zea mays
  misc_feature (186)..(186): Xaa can be any naturally occurring amino acid
  unsure (1)..(218): unsure at all Xaa locations
MGNSQASPASASSSRFVMASRAFPKQELDGLRELFASLAAQSRTGGRAISRPVFLEYYQVRGRLGDRLFQLVAKESGGSDGVTFEDLIISKVSARLNSIHSVVRLVVASKATYGRGTRDEVDEFIYQLCDVTGDGALTRSDLESVLASVHETVFAIKKEAVEVSNNRPFEEFLNSAVFSKDVEGVXGKSMSLSDFRNWCTLLPSLRKFLGNLLMPPDS

SEQ ID NO: 9980 - protein, 322 aa, Ustilago maydis 521
MSKVTASGIISGNISTQRIKLNNGQEIPQVALGVYKAPNDGSTENACKWAFDAGYRHIDSAARYMNEESVGRALAEWTKENNVPRSEIFITSKLWDADHDKAAAAIEDSLKKLNVDYMDMYLMHSPGTMGAEKRLEAWKALEEAVDAGKIKTIGVSNFDVEELDHLLANCRIKPAVNQIESHPFFAHEELREACISRGIHIQAYSPMAQGQALDRPEIKTIASKHGKTPAQILLKWGLTHGNIILPKSLTKHRIESNAQLFDFELDSDDMDVLDNLDEGMKVGKLGPAGTSQPASPGGTRPGSRRSSGSGGLSGNKLQMSSS

SEQ ID NO: 9981 - protein, 141 aa, Haemophilus influenzae Rd KW20
MMTERTFSIIKPDVVKRNLIGAILTRFEQNGFKIIASKMVRLTREQAEGFYAEHQGKEFFVPLVEYMMSSPIVVSVLEKENAVKDYRTLIGTTNPETAAEGTIRKDFALSQRENSVHGSDSIESANREIAYFFTNSEIFER

SEQ ID NO: 9982 - protein, 411 aa, Brucella melitensis 16M
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKHAGERLRSGLDAQAARYGFDLLQTGPAVMPLVQFTGDSDAALGARFCQEALKQGVYLHHKHNMFISCAHTDDVIDDALSRTEDAFKAISTK

SEQ ID NO: 9983 - protein, 339 aa, Arabidopsis thaliana
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSFSSSSPCKRRKLSGYSWVGDETSTSN

SEQ ID NO: 9984 - protein, 949 aa, Bacteroides fragilis YCH46
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQDIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSISKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 9985 - protein, 439 aa, Blastopirellula marina DSM 3645
MDGEPGEVTERDIIDSPWVQRMRQIHQLQTAWWVYPTAEHTRFQHILGVMHLASRAIAQLYPSLQESCADVPSRGYVETLVRMAGLLHDVGHGPFGHFFDTHFLSQFNLTHEKLGAQIIEQKLADMLSQLRRNPHSVLEPNEQIDPQQIAWLIQRPREADAAPYPQWLIHLRSLLSGIYTIDNMDFVLRDAYMTGYSSRSYDLDRLLHYSFFTPSGLTIHHRGMGALIRFMNVRAELFHNVYFHREVMAIDKTLEDLFRDSRQHFFPGDPSADLDRYRELTEFSLLIDVARWSQSDNPEVRALGARWDQLLQRKIEWKFVCERSLGFNDTTTEQSNILQSDQMAEFAIRQGLPAELKELPLKVAVSRYIFRHETAQQNYLYDAAQNVAKPLTSDQIFRSLPISRKICRIYARNTDHAPQLSTALDALFGGNRVDDLTNM

SEQ ID NO: 9986 - protein, 515 aa, Pseudomonas aeruginosa UCBPP-PA14
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAAAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFKEFPREQAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 9987 - protein, 411 aa, uncultured bacterium 314
MNKIIKEQINQLKPSATLAINEESNKLKKSGKKVYKFGFGQSPFPVPESIVSALKNNANKNTYLPMQGLEELRSAIANQLNQSNNNDFVAEDIIVGPGTKELMLLTQIAFAGEILLPAPSWVSYQPQAVIAKNKVHWIQTSSNSNWFPTAEQLENKIKSIKNQNLILFMNSPNNPSGIVCKNLQEITEVAKKHKLIILSDEIYSRLTFDNQYKSISNFYPEGTIVSTGLSKWCGAGGWRLGFFAIPKQLEELKNSLKILCSESFTSVSAPIQYAAVEAYKGDHSAYLNAVRKILSFTGNYVYENLKSNVINVTKPEGGFYLFPEFTNAKFSSSSEMCKDILNKTGVALLPGSDFGVDSKKMLTRLSYTDFDGSNFLANTIGGKKLDHATIKKYAPNIVEGVAKLKDWSKSL

SEQ ID NO: 9988 - protein, 1476 aa, Coccidioides immitis RS
MPDARAGAMSSGAWRRSIGGCRNRTCEMLGVGQILIELHRFNNNNDDEFGALLLNPIDLLHSVLRVRTPFPKRPSTQHWSNPPARFCLLFERRRNSGSPTVLYPCEDVRRDAPQPWLEAGGASSSSNSTTTPPSLLTSEAAQLPPTKIGRAVEISPIERGAFIYSGRGEGTPDLGHSTASGAIKQRRELNSMGSRFNAVPEWSEHYIAYSNLKKLIYSLEKQVNNPELQEDAEFERAPLLDSALDTDSIFKRTLDGELAKVCSFYHAKETDLYKEVEDVVDEAESYTTDSVGFNMDSVADSMVKSRTFSFGNYNRRASTFRGAGHSNDRRASTAGESVAGGEGNPHEDDAYSEEDVDISELPSHDIRRRSMSLREPDGREPSDGHAISEMSDSRFFGMSSDLGHEHDPHLLALYNAGVSLKKHIISIYVSLCGLKSFIQLNRTGFSKALKKYDKILDRSLRRGYMNTTVSTAYPFTNQTIQHLDDKIARIERLYADTVTKGDLSLSKRELRLHLREHVVWERNTVWREMIGIERKAQAANMGIRNTLLGGAQDAEAARRQGDEQEPPTKEIVTPVGRCPVPSWMLTSNFATLIAILIIFSVMLAVPIIDEPEQQNCLAMLAFVIPLFVTSILIPFLTVILQVMRSDEDRSRLHPKDAAKYAFASMWTSVIMLLLGGFTIAAALSKHDIARRMATFVLSKAGTRPRTVLVTNMFVSMFLSMWISNVAAPVLCYSIIQPMLRNLPPDSRFSKALVLGIALASNVGGAASPIASPQNIIALQNMYPPISWGTWFFISIPVCVICILLIWVLLVATFHPGRGTTIVPIRQVKDKFSGVQWFITIVTLITIVLWCVSHEMESTFGDMGVIAIIPLVLFFGTGVLNKEDFNNFLWTIIILASGGLCLGKAVTSSGLLHTIARGITHRVENLSLYGVMFTLSSLILIIATFISHTVAALILLPLVHEVGSAMEHPHPSLLVMGAALMCSVAMGLPTSGFPNMTAIMMEVPETGQRYLRVKHFISRGVPASVISFAVVVTVGYAQQISTTDRCTFSAVAIVGLVPLAEREQITLFCVWTMRAECWIRLILFVRWNIIRNGEGIDKSHTDHTSRRMNICHNTRPVEDTCCFNAPGGLILLTQFWDAQPATGPEDSWTLHGLWPDNCDGSFEQYCDKNREYKNVTDILQSHGKEHLLEYMSTYWKDWKGNDENLWEHEWNKHGTCISTLETRCYSGYKPQAEVVDYFEKAAEMFEGLDTYKVLAAAGIEPHPTKTYTLRELQDAISKSHGMEVTLNCRDSRLNEVWYFFNVKGSLQSGKYVPTKPGGASSTCPESGIKYFPKGGSSPTSSTRSGEPTSTGSSPSPTGTGGAFQGKGHLEVTSGNKRTGCLISYGTWYSTGTCATFTATPSGDGFTLRSSKGDCGIRNSVFECDTDVEPSVFTADDEKLAFGGSSTFSADEIPRGTTQVPIYTGGRSIELTIGWKRI

SEQ ID NO: 9989 - protein, 294 aa, Mycobacterium leprae
MLSSMARIAIIGGGSIGEALLSGLLRAGRQVKDLVVAERMPDRARYLADTYSVLVTSVTDAVENAMFVVVAVKPTDVESVMGDLVQAAAVANDSAEQVLVTVAAGVTITYLESKLPAGTPVVRAMPNAAALVGAGVTVLAKGRFVTGQQFEDVLAMFDAVGGVLTVPESQMDAVTAVSGSGPAYFFLLVEALVDAGVAVGLTRQVATELAAQTMAGSAAMLLERMDQDRHSAEVAPLGAQVDVPAAQLRATITSPGGTTAAALRELERGGLRMVVDAAVQAAKIRSEQLRITSE

SEQ ID NO: 9990 - protein, 719 aa, Cleome spinosa
MIRASSYVNSFFRHRARRNPNAQLRNLSVDGKDGVSEAEGSGSIGGERVSQDISRRNYTEMAKIVATITREKPRWEQTLVSDFPSFNFADPLFFRELVATQNNVLLSLRFFQWLCTNHDCTPDPISSNMLFEALLDAKAVRAAKMVRDIAGFIPDSASLEQYVKCLCGVGFIEEAIEVYFQLKEAGIRISIVACNSILSGCLKAGKTELLFEFYQEMIKAGTASDANTETVGCLIQAFCDSGQVARGYELLNQFLKTGLDPGNPTYNKLIAGFCQAKNYASMSEVLHTMIARNHLPTIYTYQEIINGLCKNEECLEAYRVFNDLKDRGYAPDRVMYTTMIHGLCEMGSFGEARKLWFEMMDKGMQPNAYTYNTMLHGSLKSGDFERACELYNEMCNKGYGTTTVTCNKIISELCSRGKSDEAFEVFKKMSETGIQADAITYNSLIRGFCKEGKVDERMNLLNELVAQDPQPSVSLYELLIIKSCKDGDFEAAKRLLGDMSSKGLHPNAYTYDTMLHGSLKSGDFEHVRELYNETCNKGYGTTTATCNKIISELCSRGKSDEASEMFKKMSETGIKADAITYNSLIRGFCKEGKVGKSMNLLNELVAQGLQPSASSYASLIIQLCQNGDAESAKRLWGDMVSKGIEPHANLREHLISGLCKQGRATEGMDRLMGMLENKIKPKKAAFEDLAECLIQSESSGSVGPSPSRSQRQKAHVTIH

SEQ ID NO: 9991 - protein, 141 aa, Brassica napus
MTEETPRYAVVTGANRGIGLEICRQLASNGIRVVLTSRDVKRGLEAVETLRQEIGVSDQTLVFHQLDVTDPASVTSLVEFVKTQFGKLDILINNAGVGGTITDVETLQAGAGKVGFNWEETITENYELAKECMNINYYGPK

SEQ ID NO: 9992 - protein, 472 aa, Ralstonia solanacearum
MQRSSHAKIVATLGPASDDHATIEALARAGADVFRLNFSHGAHADHQRRLERIRAVEAALGRPLGVLLDLQGPKLRVGTFAEGRVRLDDGAPFRLDLETGRPGDATRVALPHPEIFAAIRPGVALLLDDGKLRLEVVACGPDHAETRVVNGGMLSDRKGVNVPGVVLPLSALTEKDRADLAFGLALGVDWIALSFVQRAADIAEIRQLVHGRAGIVAKLEKPAAIDSLDAILAETDAVMVARGDLGVELPAEQVPAIQKRIVRACRRLGKPVIVATQMLESMIGAPVPTRAEASDVATAVYDGADAVMLSAETASGQFPVEAVAMMRRIIAQTEADPHYRAAIDASHTPPGANTPDAIGCAAHSVAGLLDVAAMVAYTSSGASALRMARERPRAAILGMTPRPETARRLALVWGVHPVICDGVLDVEAMTDVARQTAVQRRFAQAGQTLVIAAGLPFGTPGSTNLLRIAQVE

SEQ ID NO: 9993 - protein, 572 aa, Cryptococcus neoformans var. neoformans JEC21
MVLGHFSPQTNTTVPPPPHPSAFVPLFQTNTSVVSGKPNAFSTMAGTPSSQLAWLSGLSTNFNEMSADQKFLRKTSIIATIGPKTNNVETLVQLADAGMNIVRMNFSHGSYEYHQSVIDNARAAAAKSPSGRPIAIALDTKGPEIRTGLMKDDTDVPISAGHEFWVTTDKAYAEAGTAEHIYIDYTNIVKVTAPGKLIYVDDGILSLQVISIQGEKIRVKSLNSGVLSSRKGVNLPKTAVDLPALSEKDKSDLAFGVKNGVDMIFASFIRSANDVKEIRKVLGPEGADIKIIVKIENEQGVMNFDEILRETDGVMVARGDLGIEIPASQVFMAQKMMIAKCNVAGKPVICATQMLESMTYNPRPTRAEVSDVANAVIDGADCIMLSGETAKGKYPIEAVKMMAETAFLAESSIAYPPLFDQLRALTPRPTETAETLALSAVAAAIEQDAGAIIVLSTSGVSARLISKYRPACPIICVTRNEQTARQLHLSRGVYPVWFPEPRGIPAEKWQIDVDNRIRYGLRMALGLGIIKPEATVMAVQGWKGGLGHTNTLRILSVPSDPADLDLHSIERD

SEQ ID NO: 9994 - protein, 529 aa, Cryptococcus neoformans var. neoformans JEC21
MAGTPSSQLAWLSGLSTNFNEMSADQKFLRKTSIIATIGPKTNNVETLVQLADAGMNIVRMNFSHGSYEYHQSVIDNARAAAAKSPSGRPIAIALDTKGPEIRTGLMKDDTDVPISAGHEFWVTTDKAYAEAGTAEHIYIDYTNIVKVTAPGKLIYVDDGILSLQVISIQGEKIRVKSLNSGVLSSRKGVNLPKTAVDLPALSEKDKSDLAFGVKNGVDMIFASFIRSANDVKEIRKVLGPEGADIKIIVKIENEQGVMNFDEILRETDGVMVARGDLGIEIPASQVFMAQKMMIAKCNVAGKPVICATQMLESMTYNPRPTRAEVSDVANAVIDGADCIMLSGETAKGKYPIEAVKMMAETAFLAESSIAYPPLFDQLRALTPRPTETAETLALSAVAAAIEQDAGAIIVLSTSGVSARLISKYRPACPIICVTRNEQTARQLHLSRGVYPVWFPEPRGIPAEKWQIDVDNRIRYGLRMALGLGIIKPEATVMAVQGWKGGLGHTNTLRILSVPSDPADLDLHSIERD

SEQ ID NO: 9995 - protein, 243 aa, uncultured bacterium 580
MEKVAFISGANRGIGFETSKKLAEKGIKVILGSRDMVKGKKALEELAAQGIEADLIQYDAADLEAPQKVYDYILDKYNKLDILVNNAGVLLTGNLFVTNSTTVSDKDIKETFQTNLFSVISLTQALLPLIKKSEAGRIVNVSTILSSLTLHSAKDSPITPAKEFAYNASKTALNAFTIHLALELKDTNIKVNSGHPGWVKTELGGPNAPMEVKDSYETSLYLATLDKDGPSGGLFHKEEVLPW

SEQ ID NO: 9996 - protein, 73 aa, Arabidopsis thaliana
  misc_feature (26)..(26): Xaa can be any naturally occurring amino acid
  unsure (1)..(73): unsure at all Xaa locations
SYDTIVASTPHATIFARFNRQKAYTXFPATLKANNDITSITSNCGRVNSIHMLPPIGKNNFETLSYLPDLTDS

SEQ ID NO: 9997 - protein, 391 aa, Staphylococcus aureus subsp. aureus NCTC 8325
MKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 9998 - protein, 270 aa, Mycobacterium sp. JLS
MNTEHRPPLDVTRLRASLGEGWRTLDVVDETGSTNADLLARAAAGEDVAGSVLLTEFQSSGRGRHGRQWTAPPRSQVAMSVAVDAGGVRPDAWGWLPLLTGVAVRDAVAEVSAVEAGLKWPNDVLVGEGKLAGILAEVAAPQHVVIVGIGLNVTLSAAEAPDPRATSLTMLGARNHDRTALAAALLRNLGTRIARWRRAAGADEGLIADYRRHSLTLGREVTATLPGDRRLDGTATDIDDLGRLTITTGRDSVTVAAGDITHLRPGPTRA

SEQ ID NO: 9999 - protein, 410 aa, Silicibacter sp. TM1040
MNGEKTILVAGTWDTKDDELSYLSEVIRGQGGQVLSMDVSVLGEPKLPTDVSKHDVAEAAGSSIQRAIDSGDENTAMQIMGAGSARLALDLWRAGRIHGVIVLGGTMGTDLALDLCAALPLGVPKYVVSTVAFSPLLPPERIPADLQMILWAGGLYGLNDICKASLSQAAGAVLGAARAVEAPSFERPMVGMTSFGKTVLRYMVTLKPELEKRGFDVAVFHATGMGGRAFESLAGEGAFAAVMDFAPQEVSNHLFGGLSAGEGRMTHAGHAGVPQLIAPGCYDLVDFVGWQGAPEQLRGRECHAHNRLLTSAMLDARERQRVAQEMCNKLARASAPVTVFLPRAGCNEWDRAGGDLHDAEGLRAFCDEMRRGVPENAQLQELDCHINDAEFTNAVLAQFDAWIKEGVIVR

SEQ ID NO: 10000 - protein, 329 aa, Triticum aestivum
  misc_feature (81)..(81): Xaa can be any naturally occurring amino acid
  misc_feature (115)..(115): Xaa can be any naturally occurring amino acid
  unsure (1)..(329): unsure at all Xaa locations
MSCLGWLKKRKGSGSGRRGSSASAPATTMTTMTTTTTTTTTTGSAVSTSRSDDSGAGRPTSKSTGSASSQRSISSLYEERXHGQLRAFEYDELRAATNDFGRSQKLGEGGFGGVXKGFVRPLDPRADRIAVAVKRLYTRVFFFFSCKGHKQWLAEVQFLGVLEHPNLVKLLGYCAVDGERGAQRLLVYEYMPNKSLEDHLFSRTHPALSWNRRLQIILGAAEGLAYLHEGLELQVIYRDFKASNVLLDKDFQAKLSDSGSRGRGNRREHHVSTALWGPRYRPGYIRRLTQDTWARGGLTTLTGAVLKERPRDKTIMVVPRSPLRYMPSS

SEQ ID NO: 10001 - protein, 498 aa, Ustilago maydis 521
MTMTPSLFRAVRPAAHFYRSSATSSSSRLLSTTARRSLATEAQDTTPSAKAAPTSPATSAFTVEELHDKSAHEILREGGSRKDRSLRHFTVNFGPQHPAAHGVLRLILELNGEEILRTDLAICKANIADSIQSCLFWPSGVCILQPHVGLLHRGTEKLIEYKTYTQALPYFDRLDYVSMMTNELCYSRAVEKLLNIEVPERAKWIRTMFGEITRILNHCMAVLSHVMDVGGLTPFLWAFEEREKLMEFYERVSGARLHAAYVRPGGVAYDLPPGLLDDIHKWATQFGSRVDEIEEVVTGNRIWKGRTIGIGKVTAQEALDYGFSGVMLRGSGIPWDIRKVAPYDAYDQVEFDVPVGKNGDCYDRYLCRVEEFRQSLRIIEQCLNKMPAGQIKVDDHKLVPPPRATMKESMESLIHHFKLFSEGYAVPPGETYSAIEAPKGEMGVYLVSDGTNRPYRCKIRAPGFAHLAGADFMARHHYIPDMVAIIGTLDLVFGEVDR

SEQ ID NO: 10002 - protein, 500 aa, Streptococcus thermophilus
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGPYPVESVRTMATIHKNAQTLLKEYGRLNSSTFDRSSNTEVVASAVKDATNSMHIQLIVALTESGNTASLIDTYRPEADIWAITFDELTQKSLMLNWGVIPVVTETPSSTDDMFEVAERVALESGLVESGDNIVIVAGVPVGSGNTNTMRIRTVK

SEQ ID NO: 10003 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 10004 - protein, 227 aa, Oceanicola granulosus HTCC2516
MAEARRRAADIVEPTWIMAHRQSAGTGRRGRPWQGGEGNLFATLIYKPACSHAEAARRSFLAANALYETLALYVDRDTLALKWPNDVLLHEGKVAGILLEASGGGPFVDWLAVGIGVNLATAPPDDPAMNARPVSLFDQGGAPVAPEDFLTVLATNFATQEGILAELGFARVREAWLERAARIGEVITARTSRDEITGTFDTIDEDGNLVLLTADGPRAIPAADIYF

SEQ ID NO: 10005 - protein, 407 aa, Grifola frondosa
MLASLIVGRLAGSSLAKRFTSPVRPMDLVRRISSGCSTSGPASCHNTTQETDLCCFEAPGGLLLQTQFWDTNPSTGPANSWTIHGLWPDNCDGTFMEDCDPSRDYTNIAGLLEAQGASDTLSFMQEFWVDINGQNEQFWEHEWSTHGTCYSTLEPSCLPSGSPTGAEAVAFFNTVVKLFQTLPTYDWLANAGITPSTSKTFTLSTLTSALKAASGVTPALECSGSTLDAIEWYFNLKGSVIDGDFVMIDTPESGSCPSSGIKYPPKSGSTTTITPTATTTSGGSSPTGGSGSLPSTGTITASTTGGLLTAGTWSTQTLATYHFSGTVSSFTMTTSKGNCGVSSGTLKCGSGVSLSTFSAVSSGSDLLLGFQGSTAFSSDSTPSGTDQEPVFTGSSHSKTYTLAIVAS

SEQ ID NO: 10006 - protein, 393 aa, Methanosarcina barkeri str. fusaro
MRPSCDPSKFVADVVKEIPPSGIRRFFDLVSGLEDVISLGVGEPDFITPWHIREMCIHSLEKGQTSYTSNYGLPELRDELTRTYYRRYGLDYDPSSEILITTGVSEALDIAVRTVVNPGDEVIIVQPSYVAYLPSVVLAGGKPVIVSTHRDDEFSLTAEALKPAITDKTKAIILNFPNNPTGAIMSKEGLEDIADLVVENDLFVISDEVYECLTYEGKHVPLSSLDGMKERTVMLNGFSKAYAMTGLRLGFAMGSPEIIHSMMMIHQYSMLCAPITAQIGAIEALRHGKDEMERMVREYDRRRHFIVRGFNRIGLECCNPKGAFYAFPYVGNTGLSSSEFAERLLDEKKVVAIPGDAFGEAGEGFLRCAYAASINDIRKALDRMEDFVDRLKQ

SEQ ID NO: 10007 - protein, 180 aa, Zea mays
  misc_feature (25)..(25): Xaa can be any naturally occurring amino acid
  misc_feature (69)..(69): Xaa can be any naturally occurring amino acid
  misc_feature (86)..(86): Xaa can be any naturally occurring amino acid
  misc_feature (119)..(119): Xaa can be any naturally occurring amino acid
  misc_feature (130)..(130): Xaa can be any naturally occurring amino acid
  misc_feature (139)..(139): Xaa can be any naturally occurring amino acid
  misc_feature (173)..(173): Xaa can be any naturally occurring amino acid
  unsure (1)..(180): unsure at all Xaa locations
MTQTTIFKLPTPLQMPDHIKLSQKXHEMSLNHQNTKPKCKVSYVHRLSKDARTPIETKVFSINKKRYAXNDSINKTLELPHESYKXFNGEDHAQKTDHPPYLLKLDHTHRANILFCTIXAVEKDNVAKCXIPLAKDIPXGEQQMYQELRTGQRKTTIDIRMDTIATIVVTGFXRKPPKYE

SEQ ID NO: 10008 - protein, 218 aa, Vibrio sp. Ex25
MNQSSLLAEFGDPITRVENALIALKEGRGVLLLDDEDRENEGDIIYSVEHLTNEQMALMIRECSGIVCLCLTDAQADKLELPPMVVNNNSANQTAFTVSIEAKVGVTTGVSAADRVTTIKTAANPHAKPEDLARPGHVFPLRARPGGVMTRRGHTEGTIDLMQMAGLQPAGVLCEVTNPDGTMAKAPEIVAFGRLHNMPVLTIEDMVMYRNQFELKLA

SEQ ID NO: 10009 - protein, 272 aa, Flavobacteria bacterium BBFL7
MSTAKKEYKRITVKSLTEMKRNNEKISMLTAYDYTMARIIDSAGVDVILVGDSASNVMAGHETTLPITLDQMIYHASSVVRAVERSLVVVDLPFGSYQSDPKEALRSAIRIMKESGGHSVKLEGGSEVKDSIKRILHAGIPVMGHLGLTPQSIYKFGTYTVRAKEKAEAEKLKEDALALQRWGCYAIVLEKVPAALAQEVADSLTIPVIGIGAGSGVDGQVLVSHDMFGMTHEFNPRFLRRYLNLYEDMGNAVGQYVKDVKSVDFPNDKEQY

SEQ ID NO: 10010 - protein, 406 aa, Triticum aestivum
  misc_feature (217)..(217): Xaa can be any naturally occurring amino acid
  misc_feature (234)..(234): Xaa can be any naturally occurring amino acid
  unsure (1)..(406): unsure at all Xaa locations
TRPDGIYLLAEKKRNSAGKVLAILMPTIAVILAIPVVYFFCWRKRRPEEVYLPSTSDDIQHIDSLLLDLATLRIATDDFDNSKMLGKGGFGMVYKGVLPDGEEIAVKRLGQTSRQGIGELKSELVLVAKLHHKNLVRLVGVCLEEQEKILVYEYMPNRSLDMILFDSERNKELDWGKRFKIINGIARGLQYLHEDSQLKIVHRDLKASNILLDVDYXPKISDFGLAKIFGGDQXSEDVTRRIAGTYGYMAPEYAMRGQHSGKSDVFSFGVLVLEIVTGRRNSGSYNTEQDVDLLNLVWEHWTRGNVVELMDPSLSNHPPVDQVLKCIHVGLLCVQRKPASRPTMSSVNIMFSSHTVRLPSLSRPAFCIQEVSVSETSTAYSEAYPLTENSTVMSSNQVSITELSPR

SEQ ID NO: 10011 - protein, 320 aa, Vibrio cholerae O1 biovar eltor str. N16961
MKEHSAKLAILKQLADGDFHSGEVLGAQLGISRAAISKHIQGIRDWGVDVFRVQGKGYQLAQAMTLLDQSVIQSQVNNPVELHPIIGSTNQYLLDHVETLVSGTVCLAEYQASGRGRRGRHWVSPFGANLYLSIYWRLDAGMAAAMGLSLVVGVAIVEALEAMGVDGVKLKWPNDLYYQDKKLAGILVEMSGQAGAAAHLVIGMGINLAMRDNEGNIDQPWISLAEVTGQSRIDRNALAINLIAALDRTLRQYEISGMQNFVERWNRWDNFIGRPVKLLMGANEVRGIERGIDEHGGVLLETEEGLKSFIGGEISLRKND

SEQ ID NO: 10012 - protein, 966 aa, Oceanospirillum sp. MED92
MPTQNQAPLATLEQTDAFIARHIGPSAAEQQAMLKELGVADLDQLITQTVPEDILVKSPINLPDSRTEEEVLTYLKSVAAKNKINTSMIGMGYTDTIVPNVILRNVLENPGWYTAYTPYQPEVSQGRLEAILNFQTMVLDLTGLDLANASLLDESTAAAEAMTLCKRMSKAKKANTFLIDKNVHPQNISVIETRAEPLGYEVIVGDVAELIDQHECFGVLVQYPGTFGDVNDYAELIEKAHDKKALFCAAADIMSLVTLKSPGEMGADVVFGSAQRFGVPMGFGGPHAAFFATRDAYKRSVPGRIIGVSVDSRGNKALRMAMQTREQHIRREKATSNICTAQVLLANMAGFYAVYHGPQGLKTIAGRINRFASILAKGLQSKGVELVNQSWFDTITIKLDNAEAVYSKALEAGINLRNTGDNQLGMTCDECTSRETINTLWDCILGEDHGLNLEQIDAEIAASGENSYAANLARESEILTHPVFNSYHSETEMLRYLKKLENKDISLAHSMIALGSCTMKLNATAEMIPVTWPEFGKLHPFAPMDQAQGYKQLIDELEEQLKAITGFDAVCMQPNSGAQGEYAGLLAIRKYHQANGDGHRNICLIPTSAHGTNPASAALADMKVVLTACDENGNVDVADLRAKAEQHKDDLSCLMITYPSTHGVYEEDIREICQIVHDNGGQVYMDGANLNAQVAVSQPAEIGADVSHMNLHKTFCIPHGGGGPGMGPIGIKAHLAPFVANHPIQQIDGPNPENGAVSAAPWGSASILPISWVYIALMGGTGLRAATENAILNANYLSKKLGEHYPVLYTGRNDRVAHECIIDMRPLKESSGITEEDVAKRLMDFGFHAPTMSFPVAGTLMIEPTESESKAELDRFIEAMAQIREEIGQVEDGDIDAENNPLRNAPHTMADLIGGDWDRPYSFEQGAFPVARLHTSKVWPTVNRIDNVYGDRNLFCSCIPVEDYAE

SEQ ID NO: 10013 - protein, 247 aa, Mycobacterium leprae
MQQGNTATLILLRHGESDWNARNLFTGWVDVGLTDKGRAEAVRSGELLAEHNLLPDVLYTSLLRRAITTAHLALDTADWLWIPVRRSWRLNERHYGALQGLDKAVTKARYGEERFMAWRRSYDTPPPPIEKGSEFSQDADPRYTDIGGGPLTECLADVVTRFLPYFTDVIVPDLRTGRTVLIVAHGNSLRALVKHLDEMSDDEVVGLNVPTGIPLRYDLDADLRPVVPGGTYLDPEAAAAVISQARP

SEQ ID NO: 10014 - protein, 656 aa, Chromobacterium violaceum ATCC 12472
MHSMAPIVLVLLAAVLVVTLCRSLKVPAMLGYLVVGFLTGPGVMNLIPQGKETAFLGEIGIVFMMFTIGLEFSLPRLRAMRQLVFGVGFAQVALTMLLVAMAIAYLTGSPLTGFAIGGALAMSSTAIVSKLLAERLELNQPHGQLAIGVLLFQDIAVVPLLIMLPAFAGGSDTLWLDLAKAGGKVLVVLALLLFFGQRLVRPWFHLVARQRSGELFMINVLLVTLGIAWMTELSGLSLALGAFVAGMLISETEYRYQVEEDIKPFRDILLGFFFITVGMKLELSVLFGRFGEVLLLLALLLPLKLAVVFGLGRLFGHRSNDAMRSALALAQGGEFGFVLLSLALNLKLVAAPMAQAAIAAILISMLAAPFLIMHGERITRRLIKQDWMLQSLDLHQMLVAGMSKDEHVLICGYGRSGQALARLLETEKINMFALDMDPERVREAGEAGDPVVFGDAGKKEVLLAAGLMRAKVVVVTFADTHAALRILHTVREVRPDLPVIVRTIDESELDVLRQAGADEVVAEVMEGSLMLASQALLEAGVPPSRVLRRIRAVREERYDLFRGFFRGSSDETESLEESLVPRLLSVQVCGGAAAIGQPLGALGLDALGVELKAIRRNRVRRTDFDDSFEVAPDDVMVLLGTPEQLALAESRILQGD

SEQ ID NO: 10015 - protein, 446 aa, Rubrobacter xylanophilus DSM 9941
MDLQEAKNFLEKNNVRYVLAQFVNIHGVSKTKAVPVKHFENVVTEGAGFAAFAVGNLGLGPETPDYMAVGDLSTLTLVPWMPGYARIVCEGHMRGEPWHYDPRVILKKQTQRLKERGWTFYTGLEPEFFLLARDEENGLLRTADPTDVLEKPCYDYKGLARQRNFLETITEILGEVGIDVYQIDHEDANGQFEINFFHKDCVFSADDMIFFRMAAVEVARRSGMVCSFMPKPFADRTGNSMHIHHSIADEEDNNLFEDKNDPQGMGLSKLAYQFLGGIMAHAPALTVFNAPSVNSYKRLAVGSSRSGATWAPAHVSYGPDNRSALVRVPAGRLELRLTDSGANPYLATAALIAAGLDGIDRNLDPGEPCRDNLYALSSGDLQRRNIRQLPSTLNAACDALEADSVICEALGADFVEEFLETKRQEWDRYNRHVSEWEIDRYLEFWS

SEQ ID NO: 10016 - protein, 264 aa, Dianthus caryophyllus
MLNFGATARNGVVSTRRWKSDTCIDLGPSDVRSEAHVLAVDDSLIDRKVIERLLKTTSCKVTVVDSGMRALEFLGLDAEQRTSVVDGLKIDLIITDYCMPGMTGYELLKKIKESSTFKETPVVIMSSENVIARIDRCLEEGAEDFILKPVKLSDVKRLRDYMTNKYDKSNSRVISGTNKRKQMDGSDQSYDSSSSSSSSSSLSLSPISTQSQPLISPSSSTPSSPCGPLDSNSMPSSPSGPSDTPSRRRRMAVDVDDDQTAVMP

SEQ ID NO: 10017 - protein, 850 aa, Oryza sativa
  misc_feature (173)..(173): Xaa can be any naturally occurring amino acid
  unsure (1)..(850): unsure at all Xaa locations
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKGISYATAKKKKGMTVGFVTFENIEQXKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTVIKALRTHPRIRRLVYISCNPDSLVANAIELCTPSSEKQEKNKGNRGWRTMSSAGLARQRTKSMPNSEPFVPKRAMAVDLFPHTSHCEMVMLFER

SEQ ID NO: 10018 - protein, 218 aa, Glycine max
  misc_feature (23)..(23): Xaa can be any naturally occurring amino acid
  misc_feature (27)..(28): Xaa can be any naturally occurring amino acid
  misc_feature (30)..(30): Xaa can be any naturally occurring amino acid
  misc_feature (45)..(46): Xaa can be any naturally occurring amino acid
  misc_feature (54)..(54): Xaa can be any naturally occurring amino acid
  misc_feature (56)..(56): Xaa can be any naturally occurring amino acid
  misc_feature (59)..(61): Xaa can be any naturally occurring amino acid
  misc_feature (63)..(64): Xaa can be any naturally occurring amino acid
  misc_feature (66)..(66): Xaa can be any naturally occurring amino acid
  misc_feature (70)..(70): Xaa can be any naturally occurring amino acid
  misc_feature (78)..(79): Xaa can be any naturally occurring amino acid
  misc_feature (86)..(87): Xaa can be any naturally occurring amino acid
  misc_feature (89)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (98)..(98): Xaa can be any naturally occurring amino acid
  misc_feature (109)..(109): Xaa can be any naturally occurring amino acid
  misc_feature (112)..(112): Xaa can be any naturally occurring amino acid
  misc_feature (115)..(116): Xaa can be any naturally occurring amino acid
  misc_feature (119)..(119): Xaa can be any naturally occurring amino acid
  misc_feature (123)..(123): Xaa can be any naturally occurring amino acid
  misc_feature (126)..(126): Xaa can be any naturally occurring amino acid
  misc_feature (139)..(139): Xaa can be any naturally occurring amino acid
  misc_feature (149)..(149): Xaa can be any naturally occurring amino acid
  misc_feature (152)..(152): Xaa can be any naturally occurring amino acid
  misc_feature (163)..(163): Xaa can be any naturally occurring amino acid
  misc_feature (165)..(165): Xaa can be any naturally occurring amino acid
  misc_feature (172)..(173): Xaa can be any naturally occurring amino acid
  misc_feature (176)..(176): Xaa can be any naturally occurring amino acid
  misc_feature (178)..(178): Xaa can be any naturally occurring amino acid
  misc_feature (180)..(180): Xaa can be any naturally occurring amino acid
  misc_feature (183)..(183): Xaa can be any naturally occurring amino acid
  misc_feature (185)..(185): Xaa can be any naturally occurring amino acid
  misc_feature (187)..(187): Xaa can be any naturally occurring amino acid
  misc_feature (190)..(190): Xaa can be any naturally occurring amino acid
  misc_feature (195)..(195): Xaa can be any naturally occurring amino acid
  misc_feature (207)..(208): Xaa can be any naturally occurring amino acid
  unsure (1)..(218): unsure at all Xaa locations
LFTFFQPLKLPLFLLPPTSPSSXSHFXXKXHDELIVNAAYIGTPXXGILAADEXTXTIXXXLXXIXVENXESNRRALXXLLFTAPXXLXYLXGXILFXETLYQSTAAGXPFXQVXXEAXVLPXIKXDKGTDELAVTNAXTTTQGLDGLXQRXAQYYEAVARFXKXRAVLKIXXNEXSXLXIHXNXYXLAXYAVIXQENGLVSIAEPXXLGDGSPDISV

SEQ ID NO: 10019 - protein, 94 aa, Brassica rapa
TRSTRAGRMRSTWGDDCLEFKPERWISGSDSGRFINHDPFKFVAFNAGPRIYLGKDLAYLQMKSIAAAVLLRHRLTVVTGHKVEQKMSLTLFMK

SEQ ID NO: 10020 - protein, 525 aa, Cryptococcus neoformans var. neoformans JEC21
MASPPIPTFQNGRSICLATSTATLVEPTERTPLLKEVQNGTGKPVSPPQYDHEEEGTEGKEVELLVPGKSNFSQTLLNVLGDLIGTGLLACPIAIAHAGWVLGPLLLCLVSGITLWTLKILIRIIEKDRSMRNFADVARYSLGARAEKWTTAMFVSDCCIWIIALIVLFSDSFEVVLPMFTSNQWKVIGLVVIVPLNFIPLRFLAWTSALGITSTWTLVAILIFTGLATPTSPGSVLDPAPTDLWPAHGLVKLGLSFGLLISGFGGHFLVPNLIRDMKHPEQAERVCEVGYGICIIVYALVSVFGYLMFGRDVSDEISRDLAKTSAFSPLMAQIAVWMVAINPLTKLPLGLRPLTDIVYSALRLQSTTFVPKIHVSYAESSEPDEEDDELCSPITSNAPTVLSSFSASTISAATSITLEDEHYTHALSNAQRRHDRREQLKAIFRALITIVLLGVFVLGALAFPSFETLMSIMGGGMSIITCILIPIAAGANIWGWRWYSILLFGLSAVVCVIGVVCACLNNGDA

SEQ ID NO: 10021 - protein, 321 aa, Zea mays
MDIFLIRACLLRLLLVLFAAAATSPAAAQSQPPSPARILDAALQDYAYRAFARPRTGIVYNATLPGNLTGIAVSAVRLRSGSLRRKGFPGYFQFGVPTGVVVQPYVERVVLVFHDLGNWSDHYYPLPGYTYLAPVLGLLVYDAANLSAAGLQELNVIASGGPISVRFGGNVRAVPAGSAAPRCVVFDLDGVPQFRDLEATDMCSTYRQGHVSIVVNSSGIAPAPPPPGAIAPSIPTTGGNTKGSSKAWKIAVSVVGAAVALGLMAALLLCLVRHKRDKKLQVMERNAEVGETLRMAHVGRTQAPVALGTRTQPVIENDYTA

SEQ ID NO: 10022 - protein, 427 aa, Colwellia psychrerythraea 34H
MNKSEQLFEQAQKIIPGGVNSPVRAFNGVGGTPCFIKRAQGAYIYDADDKAYIDYVGSWGPMILGHNHPAILEAVITTAKNGLSFGAPTEIEITMAEKVRELVPSMESLRMVSSGTEATMSAIRLARGYTGRDKILKFEGCYHGHADALLVKAGSGALTLGVPNSPGIPEDFAKHTLTVSYNNIDEVKEIFAKYADEIACIIVEPVAGNMNCIPPVEGFLEGLRDVCDQYSSVLIFDEVMTGFRVALGGAQAHYNIKPDLTTLGKVIGGGMPVGAFGGKQEIMDYIAPVGPVYQAGTLSGNPIAMAAGLASLTELAQGNKHQQLSSATEKLAMGLKAAAERNGVSLSVNYVGAMFGFFFTEDKNPITTYEQATQCDGEMFKRFFHLMLDEGVYLAPSSYETGFLSTSHTDDIIEKTLVAADKCFAQL

SEQ ID NO: 10023 - protein, 435 aa, Candida albicans SC5314
MSGQQLLEEARKAVTNKQYDEAEIKYKQIINPSESSTSTTTTTTTTTTTAKQLQQQESAILELGKIYETLNEPTKLSDLIADSRSILGNFAKSKTAKIVKTLIEDFDKLSAKDEKSLDIQIDVTKSSMQWAIESKLSFLRQSLQLKLSDLLYQKKHHHEAIKIINELLREYKKLDDKSSLVEVQLLESKIYHALRNIPKAKAALTSARTSANSIYCPTILQAELDCQSGILNSEDKDYKTAFSYFYESFEGFNSQDDPRSIIVLKYMLLTKIMLNLIDDVNNILNNKNVIKYKSKDIDAMKSIAMAYSNRSLKEFENSLLTYANELKSDAIIKNHFNALYDNLLEQNLLKIIESYSCVELSHISKVIGLNLQQVEGKLSQMILDKVFYGVLDQGNGWLIIYDEPRKDAAYEASLELVKNLSNVVDLLYEKASSLN

SEQ ID NO: 10024 - protein, 339 aa, Haemophilus influenzae Rd KW20
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 10025 - protein, 145 aa, Arabidopsis thaliana
  misc_feature (39)..(39): Xaa can be any naturally occurring amino acid
  unsure (1)..(145): unsure at all Xaa locations
RPTRPEDEGRACAILYSFDVVTSPDQATMAGPFTDLKNXSSFPATLPASSDMTCITSLGGRVCCLNGCSPIDYRKVETLCYLHDLTDEKLAMEDDYLLPNKRNPRGECEHKHGLVLRGHENTPGYYHGRYWALWELTLAGCTDFT

SEQ ID NO: 10026 - protein, 767 aa, Porphyromonas gingivalis W83
MKQSGTAAHKLTIFYVGMLLLFLIGLWLFATIGKELETNVVDKAMSLRGRGGLVGAFDSFSESVHHHFTDTIGVLLLQIIVILTVARLVAWFFGKIGQPTVIGEIVAGILLGPSLLGAVWPEAYEVLFPLSALANLELLSQFGLILFMFVIGMELNINDIKPRFSQSMIISHAGIFIPFLLGLLISYMTYKDYAADTTTFLPYGLFIGISMSITAFPVLARIIQERQLGKSHLGMLSISTAAAGDISAWLMLAGVMAITQSGSFLSAIYNFLFLILYLLVIFGLVRPFFKVIGRLYDNQEVVSKTMIGFIFVLLLASAYATELLSMHALFGAFMLGLVMPENVQFRKILTEKVEDVSLTLFLPLFFVSSGLQTKLGLLDSASLWLLTGAFTLIAIIGKFGGTYVAARFCGERKKASLYLGAFMNTRGLMELVVLAIGRELGILPPVIFTILVMMTLITTFMTTPLLRLIDLFFKRETELENAALQKENSGAVLLSFGRASSGAHLLHATDLLMHRGDEKPSVTALHITVGSDTNLTSSEVYEERAFAPIREESDRRRLPIRTLHHHTFEHPEAEVVRTVNAGGYSFLLVGAGINLSDRKSDRELLYFRKKLQRKLGPISIATPEALLNAHEMLRDKMHYFIEQTQCSVGIFIHRGFKHAGKVLLLMENEGDEELLAYARSLARNNGSVLDVLPETDGLPPTLSMGENRLKAGLPSTINISSYHFMLVSYRYWLRFAGECPSVIEHLPSTIIIHHRNDRSSTLKAAMI

SEQ ID NO: 10027 - protein, 516 aa, Hordeum vulgare subsp. vulgare
MKCTVVALVLLVAVQCLVLGAGPAAAAKARRTRQGDYLNRLRGSPSSRASWESLAAVEEQTTTKAAGRPAPVAAAVEAGRKEADRVEALPGHPRGVDFAQYAGYVTVDAAAGRALFYYLAEAVGGNGDKTKPLLLWLNGGPGCSSLGYGAMEELGPFRVMSDGKTLYSNPYSWNHAANVLFLESPAGVGYSYSNTTADYGRSGDNGTAEDAYQFLDNWLERFPEYKGREFYITGESYAGHYVPQLAHAILRHASPDINLKGIMIGNAVINDWTDSKGMYDFFWTHALISDETADGISKNCNFTAYGAGVASNALCDAASDEVGESLADIDIYNIYAPNCQSEKLVTPPIAPSIDNFDPCTDYYVEAYLNRPDVQKALHANVTRLDHPWSACSDVLTRWVDSAKTVLPIIQELMKNSIRVWVYSGDTDGRVPVTSSRLSVNQLQLPVAAKWRPWFSSTKGAGEVGGYIVQYKGDLSLVTVRGAGHEVPSYQPRRALVLVQNFLAGKALPDCKECEQD

SEQ ID NO: 10028 - protein, 275 aa, Bdellovibrio bacteriovorus HD100
MNPLLKSQKIGFLGAGNMAQAMIKGLIEGGFPAKNIFASNRSEGKLHKLAETFKINPVFSNDELVDTCDIIILAIKPQDLLQALEPVTRSFDEHKIVISVAAGIRMEKLERYVQGARLARVMPNTPSLIGRGVIGYLLNDDDDSGLDSTVEDLFQPLGRVIQVHDEDQFEALMVSCSSGTGFVFEMMMYWQDWIEEHGFSVEEARMMTIETFVGASLLAAQAREGVEDLQARVTSKKGVTAAGLQSMRELEIERALRISFEKAAMRNKEMAREIK

SEQ ID NO: 10029 - protein, 382 aa, Haloquadratum walsbyi
MAVSDSTSSTVVDVVGVVLAGGIGSRLYPASRGHRPKQFLSLFGDRSFLTRTVDRLRGVTDTILILTRDAFAETVREQVSDVTVITEPVGRDTGPAALYATHYVEETYGDDAVVLLAPSDHVVGAAFDTAVRRMSAVAMNTNRLVTLGVAPTRPETGYGYIEPAATINSINGLNDNAVSWKSIQSFHEKPEVETAKKYIEAGHYWNAGIFAWRPAVFNTVAADSPLAPLQTALQNNTSESVADVFAASDSQSVDRAIFEQSEATAVVPTDMMWDDIGTWDAFDRLATQDELITENINTQTASAEDEHSDTTTREETVTVGDVEVEMIDSTDNIIVGNGSHISTVGVSGLIIVTWNDRTLVVNKDDAQSVRELVSRLRESGLF

SEQ ID NO: 10030 - protein, 237 aa, Vigna radiata
MLGIFSSSVVSPPEELVAAGSRTPSPKTTAGKLLTRFVESKASAVSLQVGEHVQLAYTHHSESPWYPRSFAVKDEIFCLFEGALDNLGSLRQQYGLAKSANEVILVIEAYKALRDRAPYPANRVVCHLSGSFAFIVFDKSTSTVFVASDQAGKVPLYWGITADGYVAFADDADLLKGSCGKSLASFPQGCFYSTAVGGLRCYENPKNKITAVPAEEEEIWGATFKVEGSAVLAATEY

SEQ ID NO: 10031 - protein, 123 aa, Zea mays
  misc_feature (61)..(61): Xaa can be any naturally occurring amino acid
  misc_feature (69)..(69): Xaa can be any naturally occurring amino acid
  misc_feature (87)..(87): Xaa can be any naturally occurring amino acid
  unsure (1)..(123): unsure at all Xaa locations
MSTYCGEYKDELIKNADYIGTPGMGILAADESIGTVGRRLSSINVENVEENRRALRELLLXCPGALQYXSGGSLFQETLYQKTKDGXPFVGVLNEGGVLPGFKVDKGTTEVGGSEQDTTTQGH

SEQ ID NO: 10032 - protein, 351 aa, Staphylococcus aureus subsp. aureus COL
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKVLLKPLDLDENEGEN

SEQ ID NO: 10033 - protein, 357 aa, Methylobacillus flagellatus KT
MATMKAAVFVSPGKIALRDKPVPEIGPLDALIRITTTTICGTDVHILKGEYPVAAGLTVGHEPVGIIEKLGSEVHGFKVGQRVIAGAITPSGHSNACLCGIGAQDGPDSPHGFKVAGGWKFGNTIDGSQAEFLRVPDAMANLSPIPDHLSDEQVLMCPDIMSTGFSGAERGNIKIGDTVVIFALGPIGLSAVAGAKLLGATKIIGVDSIPDRLNIARALGADHVINFKTHDPVQEILKLTDGRGVDVAIEALGVQQTFESSLRVLRPGGTLSSLGVYSSDLRLPLDAFGAGLGDFTIVSTLCPGGKERMRRLMEAVGSGRADLSNLVTHRFKLSEIEEAYDLFANQRDGVIKVAITP

SEQ ID NO: 10034 - protein, 1481 aa, Thermoanaerobacter ethanolicus
MFKRRTLGFLLSFLLIYTAVFGSMPVQFAKAETDTAPAIANVVGDFQSKIGDSDWNINSDKTVMTYKGNGFYEFTTPVALPAGDYEYKVALNHSWEGGGVPSQGNLSLHLDSDSVVTFYYNYNTSSVTDSTKYTPIPEEKLPRIVGTIQSAIGAGDDWKPETSTAIMRDYKFNNVYEYTANVPKRYYEFKVTLGPSWDINYGLNGEQNGPNIPLNVAYDTKITFYYDSVSHNIWTDYNPPLTGPDNNIYYDDLKHDTHDPFFRFAFGAIKTGDTVTLRIQAKNHDLESAKISYWDDIKKTRTEVPMYKIGQSPDGQYEYWEVKLSFDYPTRIWYYFILKDGTKTAYYGDNDEQLGGVGKATDTVNKDFELTVYDKNLDTPDWMKGAVMYQIFPDRFYNGDPLNDRLKEYSRGFDPVEYHDDWYDLPDNPNDKDKPGYTGDGIWNNDFFGGDLQGINDKLDYLKNLGISVIYLNPIFQSPSNHRYDTTDYTKIDELLGDLDTFKTLMKEAHARGIKVILDGVFNHTSDDSIYFDRYGKYLDNELGAYQAWKQGDQSKSPYGDWYEIKPDGTYEGWWGFDSLPVIRQINGSEYNVKSWADFIINNPNAISKYWLNPDGDKDAGADGWRLDVANEIAHDFWVHFRAAINTVKPNAPMIAELWGDASLDLLGDSFNSVMNYLFRNAVIDFILDKQFDDGNVVHNPIDAAKLDQRLMSIYERYPLPVFYSTMNLLGSHDTMRILTVFGYNSANENQNSQEAKDLAVKRLKLAAILQMGYPGMPSIYYGDEAGQSGGKDPDNRRTFSWGREDKDLQDFFKKVVNIRNENQVLKTGDLETLYANGDVYAFGRRIINGKDVFGNSYPDSVAIVVINKGEAKSVQIDTTKFVRDGVAFTDALSGKTYTVRDGQIVVEVVALDGAILISDPGQNLTAPQPITDLKAVSGNGQVDLSWSAVDRAVSYNIYRSTVKGGLYEKIASNVTQITYIDTDVTNGLKYVYSVTAVDSDGNESALSNEVEAYPAFSIGWAGNMNQVDTHVIGVNNPVEVYAEIWAEGLTDKPGQGENMIAQLGYRYIGDGGQDATRNKVEGVEINKDWTWVDARYVGDSGNNDKYMAKFVPDMVGTWEYIMRFSSNQGQDWTYTKGPDGKTDEAKQFIVVPSNDVEPPTALGLQQPGIESSRVTLNWSLSTDNVAIYGYEIYKSLSETGPFVKIATVADTVYNYVDTDVVNGKVYYYKVVAVDTSFNRTASNIVKATPDIIPIKVIFNVTVPDYTPDDGANIAGNFHDAFWNPSAHQMTKTGPNTYSITLTLNEGTQLEYKYARGSWDKVEKGEYGEEIANRKITVVNQGSNTMVVNDTVQRWRDLPIYIYSPKDNTTVDANTNEIEIKGNTYKGAKVTINDESFVQQENGVFTKVVPLEYGVNTTKIHVEPSGDKNNELTKDITITVIREEPVQEKEPTPTPESEPAPMPEPQPTPTPEPQPSAIMAL

SEQ ID NO: 10035 - protein, 88 aa, Zea mays
MPHPYPALTPDHIKELADIAHRIVAPGKGILAADESTGSTAKRLQSIGSENTEENRRFYRQLLLTADDRVNPCIGRVILFHETLYQKA

SEQ ID NO: 10036 - protein, 212 aa, uncultured marine gamma proteobacterium EBAC20E09
MSLENEFHLIIAEKQSKGRGRQGKTWSSPDSHNIYMTICTQNDLSFAPESLITGIICKKSINNINENINIGLKWPNDLILNKKKIGGILIEKEHYQNRVKTIIGIGINLNIKKKESWWGDLSKFNLENKRNDLIIEITNNLIKVFDEKDFDWQNEWRQACVHINKEIKIHKNNNKKENAIFKDVDNFGNAIIETTSGLEVFSSGQITIKGIY

SEQ ID NO: 10037 - protein, 143 aa, Pseudomonas aeruginosa
MALQRTLSIIKPDAVSKNVIGEILTRFEKAGLRVVAAKMVQLSEREAGGFYAEHKARPFFKDLVSFMTSGPVVVQVLEGEDAIAKNRELMGATDPKKADAGTIRADFAVSIDENAVHGSDSEASAAREIVYFFADTEVCERIR

SEQ ID NO: 10038 - protein, 343 aa, Saccharum sp.
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 10039 - protein, 444 aa, Deinococcus radiodurans
MTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 10040 - protein, 266 aa, Listeria monocytogenes str. 4b F2365
MKKIGFIGAGNMGTAMIRGLAQANLDNSEAIIVGGRNLEKLKPLEAAFTGLQITTDTEKLVEQADIIILAVKPYTIPEILTSVKEQLTPDKIIISVAAGVTIQDLEELTSAKTKIVRVMPNTPALVGEAMSSISPNINVSSEEINEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSAVINAVQAAANKNSSM

SEQ ID NO: 10041 - protein, 290 aa, Brassica napus
  misc_feature (54)..(54): Xaa can be any naturally occurring amino acid
  unsure (1)..(290): unsure at all Xaa locations
KKRPLFDTSNTWAFVFGLMGNGGSFAVFLSPVPTFYRVWKKKTTEGFQSLPYVXLFSATLWLYYATQKKDVFLLVTINSFGCFIETIYISIFLAFAPKKARMLTVKLLLLMNFGGFCLILLLCQFLAKGITRAKIIGRPTRPICVGFSVCVFAAPLSIIRTVIKTRSVEYMPFSLSLTLTISAVVWLLYGLALKDIYVAFPNVLGFALGALQMILYVVYKYCKTPPHLGEKEVEAAKLPEVSLDILKLSTVSSPEVRQANKCTCGNDRRPEVEDGQNAKNGKQSSSASAT

SEQ ID NO: 10042 - protein, 161 aa, Oryza sativa
  misc_feature (92)..(92): Xaa can be any naturally occurring amino acid
  misc_feature (107)..(107): Xaa can be any naturally occurring amino acid
  unsure (1)..(161): unsure at all Xaa locations
MAGVSVRRARSVRASLFSPKPATPKDARPAKVQEMFVYEINERDRESPAYLRLSAKQTENALGDLVPFTNKLYSGSLDKRLGISAGICILIXGVFEGAYGQVKLNQXIVFPFKIFYTFYLKGIPDLPRELLCTPVPPSPTVEPTPAAKGTEAHACLNNFNN

SEQ ID NO: 10043 - protein, 429 aa, Glycine max
ILSCSSSFGTPLNWGAKHISLEAGFSHDIFVEWANDVKNLVLFTERGQFATLARMLQADPPPKAVKVVVSKRVPLVGEELIAYEEEQNRIKKEALKASLMKEEELKTSHGADNNTSDSMVIDSGNNHVPPEVSGPRGGGYRDIFIDGFVPPLTSVAPMFPCYENTSEWDDFGEVINPDDYVIKDEDMDQTAMHGGDINGKLDEGAASLILDTKPSKVVSDERTVQVRCSLVYMDFEGRSDGRSIKNILSHVAPLKLVLVHGSAEATEHLKQHCLKHVCPHVYAPQIEETIDVTSDLCAYKVQLSEKLMSNVLFKKLGDYEIAWVDAVVGKTENDPLSLLPVSGAAPPHKSVLVGDLKLADIKQFLSSKGVQVEFAGGALRCGEYVTLRKVGDASQKGGGSGAQQIVIEGPLCEDYYKIRDYLYSQFYLL

SEQ ID NO: 10044 - protein, 250 aa, Zea mays
MGRKFFVGGNWKCNGTADQVEKIVKTLNEGNVPSSDVVEVVVSPPYVFLSVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 10045 - protein, 123 aa, Brassica napus
MFEIIQAAITGGAALALLLLAGITLGGSAVGLAVTTPLFVIFSPILVPATIATALLATGFTASGSIGAMAITIFMWLFKKITGKNPPKIPFLTPKIQLRKGEKRRIKKRKKKKRMSRPFRTMG

SEQ ID NO: 10046 - protein, 510 aa, Vibrio cholerae O1 biovar eltor str. N16961
MSAKKPMALVILDGWGYREDNANNAINNARTPVMDSLMANNPHTLISASGMDVGLPDGQMGNSEVGHTNIGAGRIVYQDLTRITKAIMDGEFQHNKVLVAAIDKAVAAGKAVHLMGLMSPGGVHSHEDHIYAAVEMAAARGAEKIYLHCFLDGRDTPPRSAEASLKRFQDLFAKLGKGRIASIVGRYYAMDRDNNWDRVEKAYDLLTLAQGEFTYDSAVEALQAAYAREENDEFVKATEIRAAGQESAAMQDGDALLFMNYRADRARQITRTFVPDFAGFSRKAFPALDFVMLTQYAADIPLQCAFGPASLENTYGEWLSKAGKTQLRISETEKYAHVTFFFNGGVENEFPGEERQLVASPKVATYDLQPEMSSKELTDKLVAAIKSGKYDAIICNYPNGDMVGHTGVYEAAVKACEAVDECIGRVVEAIKEVDGQLLITADHGNAEMMIDPETGGVHTAHTSLPVPLIYVGNKAISLKEGGKLSDLAPTMLALSDLDIPADMSGQVLYS

SEQ ID NO: 10047 - protein, 381 aa, Glycine max
RIRSATSAPPPRLMPDLSTLTRIPWNKQDEMVLADMCVKPGEAWEYCPRDALRRASKILKDEFDLEMNAGFENEFILLKSITREGKEEWIPFDSSPYCSSSAFDAASPILHEVAASLHSLGISVEQLHAEAGKGQFELVLKYTVCTKAADNLTFTREVVRAIARKHGLLATFIPKYALDDLGSGSHVHLSLSRNGQNVYMASDRSSKHGISTLGKEFMAGILHHLPSILAFIAPLPNSYDRLQPNTWSGAYLFWGNENKEAPLRATSPPGTPDGLVSNFEMKSFDGSANPYLGLAAILAAGIDGLRRKLSLPEPVDTNPNPETLQRLPASLSESLDALNKDDFLKEFMSDKLLTTIKAIRKAEIDHYTKHKDAYKQLIHRY

SEQ ID NO: 10048 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 10049 - protein, 327 aa, Novosphingobium aromaticivorans DSM 12444
MTKTFGRQSTTDDVLAGLDLTGKTILVTGVSAGLGVETTRALVSRGAKVVGTARDLAKARKALVHAGVDRASIELVELDLADLASVRRASDKLRLEGQPFDLVIANAGVMAPPFGLTADGFETQFGTNHLGHFAFVNRIAGLMRPGSRLVLLASSGHRFANVDLADPNFESSAYDPFVAYGRSKTANILFAVEFDRRYRSLGLRATAVHPGGIRTELDRHMGDGQLQSLVDQINADMAKEGKPPLEWKSPPQGAATTLWAGLVADADDVGGRYCEDCQVSPVVRDESIGFASPGVRPYALDAEMAKALWAKSEEWVSETFDLRSAAD

SEQ ID NO: 10050 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 10051 - protein, 319 aa, Oryza sativa
MWFFNFNRNGPSGFSGASTAEEVTAGVDARGLAAVVTGASSGIGLETTRVLALRGVRVVMAVRNVAAGHKAREAIRAEIHGAIVHVLEMDLSSMDSVRRFASEFDSLNLPLNILINNAGILSKDCIRSIDGLELHFATNHIGHFLLTNLLLENMKSTSRTTGVEGRIINVSSSGHILTYPEGICFDSVKDLSRFSTYIAYGQSKLANILHSTELARILKGDGVNISANAIHPGFVGTNLFKNWTMANAVVNTIGRIVCKTVEQGAATTCYVALHPQVTGISGKYFSNCNLETPSSQASNAELAKKLWEFSSNIVSAAKL

SEQ ID NO: 10052 - protein, 820 aa, Oryza sativa
MVYFLMFLLLLSIPLCKTDDQLTLGKPIFPSEMLISKGGIFALGFFSPANFSNSLYVGVWFHNIPQRTVVWVANRDNPITTPSSATLAITNSSGMVLSDSQGHILWTTKISVTGASAVLLDTGNFVLRLPNGTDIWQSFDHPTDTILAGMMFLMSYKSEIVGRLTAWRSHDDPSTGDFSFSLDPSSDLQGMTWNGTKPYCRNGVRTSVTVSGAQYPSNSSLFMYQTLIDSGNKLYYSYTVSDSSIYTRLTLDSTGTMMFLSWDNSSSSWMLIFQRPAAGSCEVYGSCGPFGYCDFTGAVPACRCLDGFEPVDPSISQSGCRRKEELRCGEGGHRFVSLPDMKVPDKFLQIRNRSFDQCAAECSSNCSCKAYAYANLSSGGTMADPSRCLVWTGELVDSEKKASLGENLYLRLAEPPVGKKNRLLKIVVPITVCMLLLTCIVLTWICKHRGKQNKEIQKRLMLEYPGTSNELGGENVKFPFISFGDIVAATDNFCESNLLGRGGFGKVYKRFPIYIDDNMKGILEGGTEVAVKRLNEGSGQGIEEFRNEVVLIAKLQHRNLVRLLGCCIHEDEKLLIYEYLPNKSLDAFLFDATRKYVLDWPTRFKIIKGIAKGLLYLHQDSRLTIIHRDLKASNILLDTEMNPKISDFGIARIFHGNQQQANTTRVVGTYGYMSPEYVLGGAFSVKSDTYSFGVLLLEIVSGLKISSSKLTPNFFSLTAYAWRLWKDGNATELLDKFFVDSYPLHEAFRCIHVGLLCVQDHPNDRPSMSSVVFMLENESTLLPAPKQPVYFEMKNHGTQEATEESVYSVNTMSTTTLEGR

SEQ ID NO: 10053 - protein, 75 aa, Glycine max
SGPICYQRNRAGAGMVAPFTVLKSMAGFPTRNTNNDITSIASIVGRVQCMHVCPPIVKKKFETLSYLSDLDYAQL

SEQ ID NO: 10054 - protein, 417 aa, Rickettsiella grylli
MPEIRNYTLNFGPQHPAAHGVLRLILELDGEVIQSADAHIGLLHRATEKLAESKPYNQSIGYMDRLDYVSMMCNEHAYVLAIEKLLGVTPPKRAQYIRVMFDEITRILNHLLWLGAHALDIGAMTVFLYCFREREDLIDCYEAVSGSRMHATYYRPGGVYRDLPDKMPQYKPSQWHNEKEIREMNANREGSLLDFIENFVTRFPQLIDEYETLLTDNRIWKQRTVGIGVLSAERALQLGCTGPILRASGVAWDLRKKQPYEVYDELDFDIPIGKHGDCYDRYLVRVEEMRQSNALIKQCVGWLRANPGPVTLKKHKIVPPTRLQMKEDMESLIHHFKLFSEGYCVPPGEVYAAIEHPKGEFGIYMVSDGANKPYRVKIRSAGFPHLAALNELVSGHMIADLVAILSSLDIVFGEIDR

SEQ ID NO: 10055 - protein, 370 aa, Zea mays
SVPHWATNLSCAGLAAAAQPHRNSTPPHPHSNSHLMEKAAHVAAGATQEQESSPNRLDDAARHHGSAEAIPERLAVVTGGNKGVGLEVCRQLALKGVTVILTARDEKRGKDAAETLRRECQLPNIIFHQLDVRDDDSATTLARYVERRYGKLFILVNNAAISGIVADEEGLKALNIDAETWTSGRAANLLKEVFQNTNDEAFNCLNTNYYGCKRVTEALLPLLKLSTSGGARIVNASSLASELKRLPNEKLRNDLSNIDIWDEDRIEAVLNTFLEDLRSGRLEEAGWPVMLPAYSVSKMVINLYTRIMARRYPEMRINCVRPGFVKTDINWNLGVLTPEQGARGPVMLALLPDDGPTGCYFDQTEMVNVW

SEQ ID NO: 10056 - protein, 404 aa, Haemophilus somnus 129PT
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 10057 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 10058 - protein, 136 aa, Brassica napus
  misc_feature (12)..(12): Xaa can be any naturally occurring amino acid
  misc_feature (36)..(36): Xaa can be any naturally occurring amino acid
  unsure (1)..(136): unsure at all Xaa locations
SVQKAPEGTPGXGGVLAVIVHSAEDVEGKPPYQPLXVRIYFKGEERKTKHVKKNRDPRWEEEFTFMLEEPPVREKLHVEVLSTSSRIGLLHPKETLGYVDIPVVDVVNNKRMNQKFHLIDSKNGKIQIELEWRTTS

SEQ ID NO: 10059 - protein, 283 aa, Citrobacter freundii
RAAQERSDIEIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIAL

SEQ ID NO: 10060 - protein, 965 aa, Colwellia psychrerythraea 34H
MTSKTIVNSLAELEQTQDFIRRHIGPSESETQAMLNDLGVESVDALIDEIVPSDIRLADLPNVEESKTEVQALADLKAVASLNKVNDTYIGLGYFGTLTPNVILRNVLENPGWYTAYTPYQPEIAQGRLESLLNYQQMCIDLTGLELASASLLDEGTAAAEAMALAKRVSKNKKSNLFFISDDVYPQTIDVVKQRAEMFGFDIVVAPAADAAEHDIFGALIQYPGASGQVTDVSELIAKIHDNKGIVAVAADIMSLVLLKSPGELGADAVIGSSQRFGVPMGYGGPHAAFFTTLDKYKRSLPGRIIGVSKDTRGKNALRMAMQTREQHIRREKANSNVCTAQVLLANMAAFYAVYHGPQGLKTIANRIHRLADILCLGTATKGLTAVHANYFDTLTFNVDNKDEIVARALAANANFRTDVDGQISIALDETTTRENVAQLFDILLGEGHGLNVSDLDDQIVASGHSSIPASLVRESAILTHPVFNSYHSETEMLRYIKRLENKDLALNHSMISLGSCTMKLNATAQMIPVSWPEFANMHPFAPVNQAQGYKAMIDELAKWLVELTGYDKMSMQPNSGAQGEYAGLIAISKYHESRGDSHRNICLIPASAHGTNPASAMMVDMKIVIVACDKEGNVDMADLKAKAEELADNLACIMITYPSTHGVYETTIAEICNIIHDNGGQVYLDGANMNAQVGLTSPGFIGADVSHLNLHKTFAIPHGGGGPGMGPIGVKSHLAPFLPDHALINVDEATKGNGAVSSAPFGSASILPITYLYIALLGKKGVTDATKYAITNANYVSKKLSEHYPILYSGKNGRVAHECIVDLRPLKASSGVTEVDMAKRLMDYGFHSPTMSFPVAGTFMIEPTESESKVELDRFIEAMVCIRDEVRKVESGEWASDNNPLHNAPHTLADITEPWDRPYSIQEAVFPVVAVTANKFWPTVNRIDDVFGDRNLICSCPPIESYID

SEQ ID NO: 10061 - protein, 283 aa, Serratia sp. MF 426
RAAQERSDIEIVAINDLLDADYMAYMLKYDSTHGRFNGTVEVKDGHLVVNGKTIRCTSERDPANLKWNEVNVDVVAEATGLFLTDETARKHIAAGAKKVVLTGPSKDDTPMFVMGVNHKSYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLAKPASYKEICAAIKAASEGELKGVLGYTEDEVVSTDFNGEKLTSVFDAKAGIAL

SEQ ID NO: 10062 - protein, 283 aa, Enterobacter cloacae
RAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEICTSVFDAKAGIAL

SEQ ID NO: 10063 - protein, 283 aa, Serratia sp. MF 416
RAAQERSDIEIVAINDLLDAEYMAYMLKYDSTHGRFDGTVEVKDGHLVVNGKTIRCTSERDPANLKWNEVNVDVVAEATGLFLTDETARKHIAAGAKKVVLTGPSKDDTPMFVMGVNHKSYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLAKPASYKEICAAIKAASEGELKGVLGYTEDEVVSTDFNGEKLTSVFDAKAGIAL

SEQ ID NO: 10064 - protein, 534 aa, Colwellia psychrerythraea 34H
MDSILVIIAISLTIASVINIILTKFSISHIIGYIITGTVVSTLFDFNGSKNLHSLDLIGEFGIVFLMFTIGLEMSFSKLDKMKKLIFYNGFVQMAFSALIIFIIAFYAFTLDAVSSLVIALSFSLSSTAIVLPYLKKSKDIVTPYGERSVAILVFQDLAVIPILLLMSFLSNNELSLTDVLLKTLLYASGIIIFMFTIGKKIIAWLLHFSSKARMEELFLSSVFTIVLGASLFAHEMGFTYSLGAFIAGMIIAETKFHIKVESDISSYKDLLLGAFFFSIGTKINIEYFISHLHWVLGILVLVMMIKAIIIYMLMRKQLNKSDSIKSAVALCQVGEFSFAIFALAMNQDIIADELGSFLILITVLSMILTPFMVNNIYKIASVFVVEYFEADNIATVKTTNHTIVCGFAVLGRIVAKELSKREAKFLIISDNLQHVLLARKRGYDAYFGHLDKLPVLESLNVDQTSSIIITVNTLKNKQIICESVLDYYPDANLVVKVNTIEEKAALADINIRSFVHAQQETAELLVKQSIVEF

SEQ ID NO: 10065 - protein, 249 aa, Burkholderia mallei ATCC 23344
MYKLVLIRHGESTWNKENRFTGWVDVDLTEQGNREARQAGQLLKEAGYTFDIAYTSVLKRAIRTLWHVQDQMDLMYVPVVHSWRLNERHYGALSGLNKAETAAKYGDEQVLVWRRSYDTPPPALEPGDERAPYADPRYAKVPREQLPLTECLKDTVARVLPLWNESIAPAVKAGKQVLIAAHGNSLRALIKYLDGISDADIVGLNIPNGVPLVYELDESLTPIRHYYLGDQEAIAKAQAAVAQQGKSAA

SEQ ID NO: 10066 - protein, 532 aa, Synechocystis sp. PCC 6803
MAEAPIAPVVLVILDGWGYRPDTRANAIAQANTPIMDSLIAAYPNTLVNTSGKDVGLPKGQMGNSEVGHLNLGAGRVVPQELVRISDAIEDGTFFDNQALIEVCQRVRDRRGKLHLIGLCSDGGVHSHIDHLLGLIDLAKLQGISQLCIHAITDGRDTPTNEGAHFVQQIQAHLEKIGLGRIVSVSGRYYALDRDRRWDRVEKAYRVMTEDGVGDGRSAAQVIKDYYASDITDEFIPPTRIGAGAIASGDGVIFYNFRPDRARQLCYALVNPSFDGFPRERIQPLDFVTFTQYDPALPVVVAFEPQNLNNILGEIISRQGMKQFRTAETEKYPHVTYFFNGGLEQPFAGEDRELIQSPMVSTYDKAPQMSAKAVTDAVCRAMEKGIYSLVVVNYANPDMVGHTGKLKEAIQAIETVDLNLGRLLASAAKVGGTVLITADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 10067 - protein, 164 aa, Pisum sativum
MPKDRTIGVALDFSKSSKNALKWALENLADNGDNITSSTSAKIPLMISQSAMVQIWFSFDSFERVQRPEIMNKYGVQIDIEVLDLLDTFSRQKEVNVVTKVYWGDAREKLLDAVEDLKLDSLVMGSRGLSTIQRILLGSVSNFVMANAPCPVTIVKDNISTSSK

SEQ ID NO: 10068 - protein, 442 aa, Methanococcoides burtonii DSM 6242
MNINTKEDVLKAIENNNVKFIRLQFTDIQGVVKDVEIPVTQIEKALSVGISFDGSSIEGFVRINESDMVLKPDTSSFAILPWNQKKGVVARMICDIYLPDGTPFEGDPRYTLKKVMKEAKEMGFSLNVGPELEFFLFERHDGKATTIPHDFGRYFEFAPADLAEDIRRDIVLTLMDLGFEIEASHHEVAFGQHEIDFKYGDALTTADNVTTFKYVTRTIAKLNGLHATFMPKPIFGENGSGMHVNLSLSKNGENIFYDADGDMQISDEARYFIGGLLKHVKAITAISNPLINSYKRLVPGYEAPVYIAWSGANRSSLIRIPAARGKGTRVELRSPDPSCNPYITFAAVLAAGLDGIRNKIDPGDNREENIFELTDKGLRDFGIETLPSTLNDSAKYLADDELLKEALGAHVHNSVLSLAKAEWDSYRIQVHDWEIERYLNTV

SEQ ID NO: 10069 - protein, 437 aa, Mycobacterium leprae
MTLYQQISVDGSGTMSDVTTHQLPMHTPGYHRQRAFAQSSKLQDVLYEIRGPVSQHATRLETEGHRILKLNIGNPALFGFDAPDVIMRDMIQALPYAQGYSDSQGILPARRAVVTRYELVDGFPRFDVDDVYLGNGVSELITMTLQALLDNGDQVLIPSPDYPLWTASTSLAGGTPVHYLCDETQGWQPDIADVESKITERTKALVVINPNNPTGAVYSNEILNQIVDLARKHQLLLLADEIYDKILYDDTKHISVASIAPDLLCLTFNGLSKAYRVAGYRSGWLAITGPKDHASSFIGGINLLANMRLCPNVPAQHAIQVALGGHQSIEDLVLPGGRLLEQRDVAWTKLNEIPGVSCVKPTGALYAFPRLDPEVYGIVDDEQLVLDLLLQEKILVTQGSGFNWPAPDHLRLVTLPWSRDLAAAIDRLGNFLVSYRQ

SEQ ID NO: 10070 - protein, 420 aa, Zea mays
HRCRVVPAGRFYEITRNKGVGLTFAAMGMTSFCDGPADGSNLTGVGEIRLVPDMPTLVRLPWSRHEEMVMADMQIRPGEGWEYCPRNTLRKVTKVLLDEFNVTMKAGFENEFFLRRKLVSNGVEMWVPYDNTNYCSTSAFDGASSILQEVYSSLKDSGIVVEQLHAEAGKGQFEIALKYILCTVAADKLIYARETIKSIARKHGLVATFLPKPDLDDFGSGSHVHLSLWENDQNVFMGSSKDNFHGMSKTGEQFLAGVYHHLPSILAFTAPHPNSYDRIQPDTWSGAYLCWGKENREAPLRTACPPGVPLDLVSNFEIKSFDGCANPHLGLAAIVAAGIDGLRRHLKLPEPIESNPSDHSSKLKRLPQNLQESVESLSADKVLHELIGDKLVTTAIAIRKAEINHFAKNPGALKDLIHRY

SEQ ID NO: 10071 - protein, 461 aa, Vibrio angustum S14
MKHPNVLQITLVVALGGLLFGYDTAVISGATESLQIFFNLNPAELGFAAASALIGCVIGSIAAGYTSTKYGRRGALLIAALLFFISALGSAVPDQYWTFIFYRIIGGIGVGIASMVSPMYIAEIAPRQKRGALVSCNQFAIIFGMLVVYFVNYGIALMGSESWLNEMGWRYMFGSEMIPAGLFFFLLFSVPETPRWLAMRGRDEQAKELLSKISKGKDFDSQWKEIKDSLVEVSTASITSRKILPILVIGIMLSVLQQVTGINVFLYYAPVILKSFSSSSTDIALLQTILVGAVNLTFTVIAIITVDKYGRKPLMMLGAGLMAISMIAIGTAAYLNAIGGYLLVFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 10072 - protein, 396 aa, Bacillus cereus E33L
MKQFELSRAAESLQPSGIRKFFDLAANMKGVISLGVGEPDFVTPWNVRQACIRSIEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVYFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMERMERFVENKKRTKHNTFCP

SEQ ID NO: 10073 - protein, 478 aa, Mycobacterium smegmatis
MAEKTSDDIFKLIKDENVEYVDIRFCDLPGVVQHFSIPASAFDESVFEDGLAFDGSSVRGFQSIHESDMMLLPDPNTARIDPFRAAKTLNMNFFVHDPFTREAYSRDPRNVARKAENYLASTGIADTAFFGAEAEFYIFDSVSFDSKINGTFYEVDSESGWWNTGEPFESDGSANRGYKVRPKGGYFPVAPYDHYVDLRDQMATNLQNAGFTLERGHHEVGTAGQAEINYKFNTLLAAADDVLLFKYIIKNTAWQAGKTVTFMPKPLFGDNGSGMHAHQSLWKDGQPLFHDESGYAGLSDIARHYIGGILHHAPSLLAFTNPTVNSYKRLVPGYEAPINLVYSQRNRSACVRIPITGNNPKAKRLEFRCPDSSGNPYLAFAAMLMAGIDGIKKKIEPLQPVDKDLYELPPDEAAAIPQAPTSLSAVIDKLEEDHEYLTEGGVFTEDLIETWISYKRENEIMPIQIRPHPYEFSLYYDV

SEQ ID NO: 10074 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKTAKASQEL

SEQ ID NO: 10075 - protein, 513 aa, Photobacterium profundum
MSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 10076 - protein, 130 aa, Triticum aestivum
MIKVENIEENRRQYRHLLMSTKTDISEYLGGIILFHETLYQKDDSGKLLKDLMVEKGIAIGIKVDKGVVKLLGTKDETTTQGLDGLGDRCAQYKADGCDFAKWRCVLKITDSTPSQLAIDENANVLARYA

SEQ ID NO: 10077 - protein, 278 aa, Leptospira interrogans serovar Lai str. 56601
MNNKENPLKQTIMLNNGISMPILGLGVWKTKSGKECKEAVLNALEAGYRHIDTARIYDNEVDVGQAIRESGIPRKEIFITTKLWNADQGSDKTRKALENSLDRLGIDFVDLYLIHFPVTSKRMDSWKELEKLYHDKLCKAIGVSNYTIIHLTELLKNSQITPAVNQVEFHPFLNQIHLLEYCKKHKIQLEAYSPLAHGQKIEDPTIAKIAQKYDKTPAQILIRWAIEQKIVVIPKSIKKERIIENSKVFDFAISEEDMKILNSLDEDFRTCWDPSEVV

SEQ ID NO: 10078 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 10079 - protein, 540 aa, Oryza sativa
MGGRGALPVVAGVVLVLLVVAARGASAAGGGDPEAGEGRGGFLAAALAAASRRLHLDRARHLRLLSSLHRNLTATLRDLSAAASASASASASEAGYASAGDEVRRLDLQAKDLIRAARAAIADAKPLFDPQLKIQRLKDAIFAQNELLARAKKRGAFASLIAAKSIPKPLHCLAVRLTAERIARPENYADPVPPPHALEDPAMFHYAIFSDNVLAASVVVRSAVANSLDPSKHVFHVVTDRMNLGAMQFRCKKQFYVQISSMFYSNLSSLLLKVIIRLMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKEKFNPNACGWAYGMNFFDLDSWRREKSTEQYHYWQSQNENRTLWKLGTLPPGLITFYSTTKPLEKSWHVLGLGYNPSISMEEIRNAAVVHFNGNMKPWLDIGMNQFRHLWTKYVDYDDSFIRQCNFAPP

SEQ ID NO: 10080 - protein, 530 aa, Methanosarcina mazei Go1
MLSTVSSIAQEKLEILSTRENEIYLRISETGFKEVCPALAERKFSLIGLFCAEAFEGKDNFTLFYAFKKGGMSPVLILVRETGNEKRITSIAETFPSASWFEREVRDGFGIEFDGAFDTRRLFLHECYPEGFHPLLKSFKNGPISPVEAPHKEYKFRQHKGEGVYQIPVGPVHAGIIEPGHFRFSVIGEPIFSLEIRLFYKHRGIEKLAEGKNPSECVALAEAVSGDESMANAAGFCMAVEQVCGIKVPERAERLRAVMLELERIYSLLGDLAGMAVDVGFALVASPFFILREEVFRLNEKLTGSRFLRGITFPGGLKKDIPESALKEIPEFLGKFSRSFESAYNRATSSSSLIDRFVTTGVIKKELISPLNLTGPIARASGSSSDTRLDRPYGAYRNFTPEHCLRKKGDVFSRFEIKASEIRAAVGLILRLTEKLPQGPVLAENSGSGESAGEINISGTTGYSLSLVEAPRGQNLHWVYLKNGIVDRYKVRTASFCNWQAIEHAVLGNIVPDFPLINKSLNLSYAGTDL

SEQ ID NO: 10081 - protein, 534 aa, Staphylococcus aureus subsp. aureus MSSA476
MKQFNVLVADPISKDGIKALLDHEQFNVDIQTGLSEEALIKIIPSYHALIVRSQTTVTENIINAADSLKVIARAGVGVDNININAATLKGILVINAPDGNTISATEHTLAMLLSMARNIPQAHQSLTNKEWNRNAFKGTELYHKTLGVIGAGRIGLGVAKRAQSFGMKILAFDPYLTDEKAKSLSITKATVDEIAQHSDFVTLHTPLTPKTKGLINADFFAKAKPSLQIINVARGGIIDEKALIKALDEGQISRAAIDVFEHEPATDSPLVAHDKIIVTPHLGASTVEAQEKVAISVSNEIIEILIDGTVTHAVNAPKMDLSNIDDTVKSFINLSQTVGELAIQLMYNAPSSIKITYGGDLASIDSSLLTRTIITHILKDDLGPEVNIINALMLLNQQQVTLNIENNKAETGFSNYLEVELSNDSDSVKVGASVFTGFGPRIVRINNFSVDLKPNQYQIVSYHNDTPGMVGKTGALLGKYNINIASMTLGRTEAGGDALMILSVDQPVSNNIIDELKQVGEYNQIFTTELTVQS

SEQ ID NO: 10082 - protein, 377 aa, Saccharomyces cerevisiae
MDMEIDDPMHGSDEDQLSPTLDEDMNSDDGKNNTKARSNDEDTDEELEDFNFKPGSSGIADHKSSKPLKLTNTNINQLDQWIEHLSKCEPLSEDDVARLCKMAVDVLQFEENVKPINVPVTICGDVHGQFHDLLELFKIGGPCPDTNYLFMGDYVDRGYYSVETVSYLVAMKVRYPHRITILRGNHESRQITQVYGFYDECLRKYGSANVWKMFTDLFDYFPVTALVDNKIFCLHGGLSPMIETIDQVRDLNRIQEVPHEGPMCDLLWSDPDDRGGWGISPRGAGFTFGQDISEQFNHTNDLSLIARAHQLVMEGYSWSHQQNVVTIFSAPNYCYRCGNQAAIMEVDENHNRQFLQYDPSVRPGEPTVTRKTPDYFL

SEQ ID NO: 10083 - protein, 507 aa, Oryza sativa
MAFASILQLALCFLCFSIFSYNHIKSKRKNTAIPVCWPLIGMLPDLLANRHRIHDWITSLLTASQLNFRFTGPPSSNMRLFITCDPANVRHVFTSNFSNYPKGPDFTEIFDIFGDGIFNVDGDSWRRQRAKAQLLTCRPRFRAFVSRCSRAKVEKALLPLLAHFAATGESCNLQDVFMRLTFDTTTMVVSGADTGCLAISLPEVAFARAMDDATRVLLVRHIFPLSWWKLARRLGIGYERTMAEALRACDHFVNETIEKRRAEKAKGEADGSADLLSSYINDDDEEENASSSFLRDTTMNLISAGRDASAMALSWFFYLLTKNPCVVSKILEELDSVNGITTPDGMVTFDPDELRPLVYLHAALSETLRLYPPVPLEHKGVLAADALPSGHDVRPGDKIVVSLFAMARMEAVWGSDCRKFRPERWISKDGKLRYVPSYKFMTFSSGPRTCLGKDMAFVQLKAVAAAVVKNFEIEAMPGHVVEPALSIVLHMKNGLMVRVKRRHVLNN

SEQ ID NO: 10084 - protein, 167 aa, Oryza sativa (japonica cultivar-group)
MEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 10085 - protein, 139 aa, Flavobacteria bacterium BBFL7
MATNRTFTMIKPDGVENGHIGAILEKITASGFRIVALKKTQMTKADAESFYAVHNERPFFGELVEFMTRGPIVAAILEKENAVVDFRTLIGATNPADAAEGTIRQLYATSMGENAVHGSDSDENAAIEGAFHFSGREMF

SEQ ID NO: 10086 - protein, 317 aa, Coccidioides immitis RS
MATEVTGTRFTLNTGVEIPALGLGTWQSAPGQVQAAVYHALKVGYRHIDAALCYQNEKEVGRGIAQAVREGIVRREDIFVTTKLWNTYHRRVEEGLETSLKDLGLEYVDLYLMHWPAPMNPNGNHPLFPKLPDGSRDIDWSRSHIDSYKDMEKLLASGKVKAIGVSNYSLKYLQQLLEHVSVVPAVNQIENHPLLPQQEIVDFCREKGIMVTAYSPLGSTGGPLMTSDAVVEVARRKGVSPSTILLSWHVARGSCVLSKSVTPSRIEANLHLLKLDEDDMKIIAKFTAESVSRNGFTRFVYPPFGIDFGFPDKTLKD

SEQ ID NO: 10087 - protein, 525 aa, Anaplasma marginale str. St. Maries
MRRWCADDSYLLWRVRYCRIGPVFLLAQIKCMSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 10088 - protein, 101 aa, Zea mays
PSHNDLSPVTTKAGGSVANTIRGLSVGFGIPTGIIGARGDDNQGLLFVNNMSFSGVASLRVKKGHTAQCNCLAQMSGSRKPTHCLCNQVSYGEMVACDNDF

SEQ ID NO: 10089 - protein, 577 aa, Debaryomyces hansenii CBS767
MTIPTPQVQGMSIPQQIPSHIPQQMMQQQGRSGISPSSGMGPASVSPHVIAQQMIGSTAQGDPTGDRGASSQAPNELINKIPLKELSSTHEWSEKLKNEGKDIPTDLKVYESIIGKDSDFLKKKMEQVGDSKKMLDMLVKDIKTYSEIKQLRMNAITLSSKGQFNNSIWGEGYQGYGNGITNTATRLLLPHHNKRYSAVPDVMFTEREINDRVLKRLRPSETQQLVPIRLEFDQERDKFKLRDTFLWDLNEDVLPLENFVALLIEDYKFIPPHHAQTILASIREQIRDFHRKPDKVMGELRVPIKIDVTINNTQLVDQFEWDILNFGESDPEDFARIMCDEMNLPGEFTTAIAHTIREQTQLFHKSLFLVGYSFDGSPVYEDEIRSHVLPSLRLLSHDNTAGFDSMVDDFFSILRNPATVPDFTPSLVKLTQLELERLDKEIERDSRRKRRHNLNDLTDASATSGSGLTSGRGTSSRRSALHMGRGGPVLPDLSDAPKTFRTPAPSSILPGGIDLGVPDIYGYNEVIVHRSQIKNPDYKPPPPTSEAELDTDNINNRVRYTNDRIMGRFLVSIKLPR

SEQ ID NO: 10090 - protein, 310 aa, Candida glabrata CBS 138
MSLKNSTATLKLNTGAEIPVVGLGTWRSAANDGYDSVLAALKLGYRHIDAAAIYGNEDQVGRAIKDSGVPRQEIFITTKLWGTEHRNPAKALDSSLKRLGLDYVDLYLMHWPVALKAHGSEEKDLLNIPKKPDGKTDIDIEDWDFIKTWELMQELPKTGKTKAIGVSNFSINNLKALKNSPKFNTVPAANQVEIHPLFPQTELIEYCKSENILIEAYSPFGSADAPVLKEPELHKLAEKYNISTAQLIISWSVQRGYVVLPKSVHAERIEANLKVLTLKDEDMETITNLSKVKGEKRLVQLDWSPFPTFE

SEQ ID NO: 10091 - protein, 314 aa, Cryptococcus neoformans var. neoformans JEC21
MGEQPEIDLDSVIDRLLEVRGNRPGKAVQLAEYEIKYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLQSMEQIRRVMRPTDVPDTGLLCDLLWSDPDKDITGWSENDRGVSFTFGPDVVSRFLQKHDMDLICRAHQVVEDGYEFFAKRQLVTLFSAPNYCGEFDNAGAMMSVDDTLLCSFQILKPAEKKPKYGGYGGSARR

SEQ ID NO: 10092 - protein, 405 aa, Ralstonia solanacearum
MHADTPLLSTIIGGIVLAFVLGTIAQRLRLPPLVGYLCAGVMAGPFTPGFVADQSLAPQLAELGVILLMFGVGLHFSMKELLAVKSIAIPGAIGQIALATLMGMGLAWLLGWAWGPGLVFGLALSVASTVVLLKALEDRGIEGSHEGHIAVGWLIVEDLVMVVALVLLPALAGVLGGAGSTAVGWWDLTEVLAVTLGKVVAFAALMLVVGRRVIPWMLERIVRTGSRELFRLGVLATALGVAYGATVLFGVSFALGAFFAGMVLAESEFSQRAAEESLPLRDAFAVLFFVSVGMLFDPRVLIDDTWAVLGTVLIVVLGKSLAAFAVVRAFGHPARTALTISASLAQIGEFSFILIGLGIGLEILPARARGLLLAAAILSILLNPLMFALIDRLKREVPAEPAPAD

SEQ ID NO: 10093 - protein, 510 aa, Citrus sinensis
MANIDIEGLLRDVPNDKRLPKTKIVCTLGPASRSVPMLEKLLRAGMNVARFNFSHGTHEYQQETLNNLRAAMHNTQILCAVMLDTKGPEIRTGFLKDGKPIQLKEGQEITVSTDYDFKGNEEMITMSYKKLPVDVKPGNTILCADGTITLTVLSCDPKSGTVRCRCENTAMLGERKNVNLPGVVVDLPTLTEKDKEDILRWGVPNNIDMIALSFVRKGSDLVTVRKVLGPHAKNIQLMSKVENQEGVVNFDDILRETDSFMVARGDLGMEIPVEKIFLAQKMMIYKCNLVGKPVVTATQMLESMIKSPRPTRAEATDVANAVLDGTDCVMLSGESAAGAYPEIAVKIMRRICIEAESSLDYRAVFKEMIRSTPLPMSPLESLASSAVRTANKARAKLIVVLTRGGTTAKLVAKYRPAVPILSVVVPVLTTDSFDWTCSDETPARHSLIYRGLIPILAEGSAKATDAESTEVILEGALKSAIEKGLCSPGDAVVALHRIGVASVIKICIVK

SEQ ID NO: 10094 - protein, 822 aa, Debaryomyces hansenii CBS767
MAVETHTVAGIVAQRNPLEYLKSSPYTIFLFQAVLVILLCQLIYYPIRKLQQPKVIAEVVTGIILGPSVMGHIPNFTKNCFPEESIPGLTLMANIGIILFLFIIGLEVDISFIKKNMKVAISVGMINMAIPFALGCGIAKGIYTTYRMDSTELPPMEFTTYMVFIAVAMCITAFPVLARILTELNLITDRVGTIVLAAGITNDLTGWILLALVVTLANASNAVNTVYILLLTVAWFLFLCFPVRLAMKFCLRRFTNDLISGEPSQILMLFILTSVFISAFFTDIIGVHPIFGAFMVGVIVPRTNGYVIKITEKLEDLVHIVLIPIYFALAGLNVNIGLLNRGIDWAYTIGIILLAMVGKIFGGFIAGKLNKLLWRESLAIGVLMSCKGIVEIVVLTVGLNAGIITQRVYSMFIVMTLVTTFLTTPLTLLVYPVEYRLRVEKFLQGEATLDGTPIIKEGSSDSGLITSGNSSNEFRSLENVDIDQLGHFRISKIVLLLRDVHSISHLMSFTHDISLLGDNSDDNYNIDIKAVHLREFTSRTSHLLEASYQNSYEEDSITNFNENELHKSSSLLTIMKMFNELLGNHFASRSVLSTFKNHIFTINDQISEPSELLICTINKNELARSFSNSNNINGEDSERVLYGKLFHSCNSHFGLFITNEKKKTSLNEIKEDKVCITNFFENEEPRSIFGIDSVNLILHHDNFLSASDLLSLHVVYKLAFNLLFVNIFINTSSSLSSGFEEKIRSLFLPNTKAHLSIHYTKEDSLKDDILKANTRSSNEMFVVPNNLAKNEEDEMFSGAVNQLIDISETEGFNVLVVKAASF

SEQ ID NO: 10095 - protein, 328 aa, Cryptococcus neoformans var. neoformans JEC21
MGEQPEIDLDSVIDRLLEVRGNRPGKAVQLAEYEIKYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLQSMEQIRRVMRPTDVPDTGLLCDLLWSDPDKDITGWSENDRGVSFTFGPDVVSRFLQKHDMDLICRAHQVVEDGYEFFAKRQLVTLFSAPNYCGEFDNAGAMMSVDDTLLCSFQILKPAEKKPKYGGYGGSARPVTPPRKGKSNKRKA

SEQ ID NO: 10096 - protein, 108 aa, Medicago truncatula
MGLVEKSPKNLHLHRHHLQHKQEFKGVPKGFMAIKVGLGEEQQRFVVPVMYFNHPLFIQLLKEAEEEYGFDQKGTITIPCHVEEFRNVRGLIDRDKNLHHQHVGCFGL

SEQ ID NO: 10097 - protein, 496 aa, Nitrosomonas sp. CNS332
MMRRTKIVATLGPASSNPDILRQMIEAGVDVVRINFSHGTKDEHIASAEQVRSLAHSLGRTVGVLADLQGPKIRIGKFAQGKITLKAGDEFILDAECELGNQERVGLDYRELPNDVEAGTVLLLDDGRIVLTVTKVRESEIYCEVLQGGILSNNKGINRKGGGLSAPALTAKDLQDIKTATILRADYLAVSFPRSGEDIRRARALMQEAQGHSLLMAKIERSEAILALDDILSASDAIMVARGDLAVEVGDAAVPALQKRMIRSAREANKLVITATQMMESMISNPIPTRAEVSDVANAVLDGTDAVMLSAESAAGQYPVEAVAAMARVCLEAEKEYTVNLSFRRSPDTQPVSIEDAIARATMYTAGSLKIRAIAALTQSGVTALFMSRRSSKVPIFALSPQEDTLSKVTLFRGVYPIKFGQGLCDPEIILSMAEDELLRRGAVRNEDLIIMTIGEPVGKAGGTNTMKLVRVGGSRGTTQITKEVTQQTFSDPLNL

SEQ ID NO: 10098 - protein, 95 aa, Zea mays
MGPLGPTVSFSIMVMAKLSGAAQQQPEDERERKEGGSGCGFRMPLHYPRYKKADYEAMPEWRVDCLLREYGLPADGDLDSKRRFAMGAFLWPDQH

SEQ ID NO: 10099 - protein, 496 aa, Nitrosomonas sp. OZK11
MMRRTKIVATLGPASSSPEVLGKMIKAGVDVVRINFSHGTQDEHIASVELVRSLARSLGRTVGVLADLQGPKIRIGKFEQGRIRLNAGDEFILDAECQLGNQERVGLDYRTLPNDVEAGAVLLLDDGRIVLTVTKVRGSEIFCEVLQGGVLSNNKGINRKGGGLSAPALTAKDLLDIKTAAVLRADYLAVSFPRSGEDIRRARALMQDAQGHSLLMAKIERSEAILALDDILEASDAIMVARGDLAVEVGDAAVPALQKRMIRSAREANKLVITATQMISPMISNPIPTRAEVSDVANAVLDGTDAVMLSAESAAGQYPVETVEAMARVCLEAEKEYTPNLGARRSPDTQSASIEDAVARAAMYTAASLKIQAIAALTQSGITALFMSRRSSKVPIFALSPQEDTLGKMTLFRGVYPIEFGQGLCDPEIILGLAEDELLKRGAVRDGDLIIMTIGEPVGKAGGTNTLKIVRVGSSKTIKQVMQEATQQPFSDPQNL

SEQ ID NO: 10100 - protein, 217 aa, Brucella melitensis 16M
MTDSSHQRSTAMSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 10101 - protein, 319 aa, Flavobacteria bacterium BBFL7
MSKKVLANDGVSQSGIDKLTAAGYEVITTNVAQAQLENYINKNDISVLLVRSATTARQDLIDNCPGLKIIGRGGVGMDNIDVEYAREKGLKVINTPAASSASVAELVFAHLYGGVRFLYDSNRNMPLEGDTNFKGLKKQYAKGSELRGKTLGIIGIGRIGQEVAKIAAGVGMNVLAHDAFASTAPTISWDLFDGQTVTVEIPLVSKEDLLSKSDFVSLHVPAQKDYVISEHEFNQMKKGAAIINAARGGVIDEVALVNALESEHISFAALDTFEKEPQPEMVLLMNSNLSLSPHIGAATNEAQDRIGTELADQIIEIMG

SEQ ID NO: 10102 - protein, 271 aa, Nostoc sp. PCC 7120
MVRPRKLFAQHWLKSEKALDAIVKAAECSTNDRILEIGPGTGILTRRLLPAVQSLVAVEIDRDLCELLAKQLGKKENFLLLQGDFLTIDLAANLGSFPKFQKPNKVVANIPYNITGPIIEKLLGTISNPNLEPFDSIVLLIQKEVAERLYAKSGSRTFGALSVRVQYLADCEFICDVPASAFHPPPKVDSAVVRLRPRQIEIPVNDPKRLENLVKLGFGAKRKMLRNNLQSVVDRDRLSQLLEQLNINPQARAEDISTQQWVKLANLLGVE

SEQ ID NO: 10103 - protein, 394 aa, Methanosarcina acetivorans C2A
MFSINSECILSKQSEDIPPFYVMEVLESAKELEAQGRHIIHLEVGEPDFPTAPHICEAACAAIGKGLTKYTHSQGLPALREAIAESYYRKFGVDLDPNQVIVTSGTSPGLLMVFMALLEKRDEVIMSNPHYACYPNFVKYLGGTPVFVYTSEANGFALEPETVRQCLSPNTKAILINSPSNPGGHVMSPDTLQGLAAIADEKGIPVVSDEIYQGLIYSGEEHSILEYTKNAFVLNGFSKLYAMTGWRLGYIICPPGCVRAIQKIHQNFFICANSFVQEAGIAALKGSQEHVVEMVQIYNMRRQYMLKRLLGMGLEVRKEPMGAFYVLADARKFGNDSLELSRSILNEAGVAVTPGVDFGNGAEGYLRFSYANSLENIAEGMDRLEAFLEKELDG

SEQ ID NO: 10104 - protein, 568 aa, Aspergillus parasiticus
MATQHKTQSSPVNAAWWKKASVYQIYPASFKDSNGDGIGDIPGIISELDYLKALGIDLVWLSPILQSPQVDMGYDVSDYYQIHPPYGTVEDVDALIQGLHQRGMRYVMDLVVNHTSDQHEWFKQSRSSSDNEYRDWYIWKKPKYDANGVRQPPNNWSAYFGGSAWQYDETTDEYYLHLFAPEQPDLNWENPKVRSAVHQIMRYWLDKGVSGFRMDVINMISKDQSFPDAPITDPKAQWQHGADVLLLRTTSSRIPARAGEGSEGIRCLFLGFDRGELAMAFQFEIMDIDHGPGGKFSPHKYRMSDLKHIVSKWQDFMYENEGWNALYLENHDQGRTISRFTSAGPEYRATAGKMLATFLGLQGGTPFVYQGQEIGLGNVPETWGIEQFRDIETLNYWNEIEREMAAYPNDTELHKVTLEQFRVKSRDNGRTPMQWTSGKFAGFTAAHNGPWIDVHDDYEDWNAASQVGNPNSVFQHWAKVLSLRKAHKRLFVYGSYKLIDEANNDLFTYLRVYGGQSALVLANFTGKEVSWVVPAETISILKNGAVLLESYQRHPSSATGWYNRCNAI

SEQ ID NO: 10105 - protein, 453 aa, Corynebacterium glutamicum ATCC 13032
MSNRHLQLIAIGGAIGTGLFMGSGKTISVAGPSVILVYAIIGFMLFFVMRAMGELLLANLNYKSLRDAVSDILGPGAGFVTGWTYWFCWIATGMADIVAITGYTQYWWPEIPLWLPGVLTIALLFALNLAAVRLFGEMEFWFAIIKIVAIVSLIVVGLFMVVTAFESPNGTTAQFNNLIEHGGFFPNGITGFLAGFQIAIFAFVGIELAGTAAAETENPTKTLPRAINSIPIRIVVFYVLALAVIMMVTPWDQVRADNSPFVQMFALAGIPAAAGIINFVVITSAASSANSGIFSTSRMLYGLSLEGAAPKRWSRLSKNLVPARGLTFSVICLIPAVGLLYAGGTVIEAFTLITTVSSVLFMVVWSYILVAYIVYRRNSPELHKKSIFKMPGGVVMAVVVLVFFAAMLVVLSLEPDTRAALIATPVWFIILGIGWLSIGGAKGAKHRSQITSH

SEQ ID NO: 10106 - protein, 179 aa, Arabidopsis thaliana
MKEDDALPTTTTTGTATGTAMANSKKESSDSVLFGRGRYKFWAFAAILLLAFWSMFTGTVTLRLSTGNLNRLSEDLGIPNYDNLDVLEMEEREKVVKHMWDVYTNSRRIKLPRFWQEAFVAAYEELTSDVPGVREAAIGEIAKMSARSITLDPPPSRSMSARDLGRNLKRILHKPAASS

SEQ ID NO: 10107 - protein, 474 aa, Clostridium perfringens str. 13
MQKTKMIFTIGPSSDSEEILREFIRIGMNAARLNFSHGDHASHKEKIELIKRLRKEEKSATAILLDIKGPKIRTYNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFEIAETGDNIMVAAGFPTSITGGTNMLKIEKI

SEQ ID NO: 10108 - protein, 248 aa, Corynebacterium diphtheriae
MTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 10109 - protein, 472 aa, Bifidobacterium adolescentis
MSQYVSGKTVPRADIAHFLAAYLRVNEDWLMGKDVPMEEHAAILPDFAGEQPDHVDDASEQPTEGRTMRTFTKSHKLDNVLYDVRGPVADEAARMEAAGTHILKLNIGNPAPFGFRTPDEVVYDMSQQLPDTEGYSPSKGLFSARKAIMQYAQLKNIPNVSIDDIYTGNGVSELINLSLSALLDNGDEVLVPSPDYPLWTACVNLAGGTAVHYVCDEDSEWYPDIDDMRSKITDKTKAIVIINPNNPTGALYPKEVLQQIVDLAREHQLMIFSDEIYDRLVMDGLEHISIASLAPDLFCVTFSGLSKSHMIAGWRVGWMVLSGNKRLAKDYIEGLNMLANMRMCSNVPAQSVVQTALGGHQSVKDYLVPGGRIYDQRELVYNMLNDIPGITAVKPKAAFYIFPKIDVKKFNIHSDEQFALDLLHDKHILISHGGAFNWQEPDHFRVVYLPRISMLKETIGEIGDFFSTYWQA

SEQ ID NO: 10110 - protein, 482 aa, Vibrio vulnificus YJ016
MTQPLRRTKIVTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 10111 - protein, 393 aa, Carnobacterium maltaromaticum
MTVLSEKFNQQTYKIEVSDIRRFDERVSVIEDMLKLTLGEPDFNTPEHVKLAGISAIENNDSHYTGMAGDLELRKAVATFMQKKYQVSFAPENEILVTVGATEALSASLLAVLNPGDKIIVPTPIYPGYEPLITLARAEPIYIDTTSNGFVLTPEIIEAAMLEHGDQVKAIILNYPSNPTGVTYNREEVKAIADAVKKYSIFVISDEIYSELTYGETHVSIAEFARDQTILINGLSKSHAMTGWRIGFILAPQELIGQIVKVHQYLVTSATTMAQKAAIAALTAGADDALPMKIEYMKRRDFLYEKMKNLGFEIARPNGAFYIFAKIPDGYTQNSMNFCVDLAEKNKLAIIPGSAFGAAGEGFVRLSYAASMEKLELAMERLTAYMATNKPTP

SEQ ID NO: 10112 - protein, 423 aa, Penicillium janthinellum
FVKNSGICETTPGVNQYSGYLSVGSNMNMWFWFFEARNNPQQAPLAAWFNGGPGCSSMIGLFQENGPCHFVNGDSTPSLNENSWNNYANMIYIDQPIGVGFSYGTDDVTSTVTAAPYVWNLLQAFYAQRPEYESRDFAIFTESYGGHYGPEFASYIEQQNAAIKAGSVTGQNVNIVALGVNNGWIDSTIQEKAYIDFSYNNSYQQIIDSSTRDSLLDAYNNQCLPALQQCSQSGSTSDCTNADSVCYQNIEGPISSSGDFDVYDIREPSNDPYPPKTYSTYLSDPTVVKAIGARTNYQECPNGPYNKFASTGDNPRSFLSTLSSVVQSGINVLVWAGDADWICNWLGNYEVANAVDFPGNAQFSALDLAPYTVNGVEKGQFKTVDNFSFLKVYGAGHEVPYYQPDTALQAFKQIIQKKPISST

SEQ ID NO: 10113 - protein, 608 aa, Myxococcus xanthus DK 1622
MSASPATHAPPFINALLGENKSALLLKLVEEMDASALHWLSGYTAGLAVRAPQTTVVPVTPVPVAAPAGHFTIIYGTQTGNSRLLAERLKHQVESAGLATRLFRASDYPVRELAKEKLLCVVISTQGDGDPPDDARGFSEFILGKRAPRMEGLRYAVLGLGDSSYPRFCEVGRRLDARFAELGASRLLERADCDVDFEPVAKGWLDQAYTLAREALTPQATVTATVVPLREPHATPAFTKEAPYTAEVLLNQRITARGALKDVRHLELSLAGSGLEYAPGDALGVWPHNPPELVASFLSELRLDGEAAVTREGRTLPLARWLSDELEITRLNRPFLERQATLSGSAALHEVLEPGRTEAFRALLAGHQVIDVLRAHKATWDATELVQSLRRLTPRLYSIASSPKRVGEEAHLTVAVVDYTVFDLRHFGAASYHLATRTAGTDTVRIFIEPNERFRLPQDGDKDVLMIGPGTGVAPFRAFVQERAETGAKGRNWLFFGEQHFRTQFLYQTEWQEALKKQTLHRLSLAFSRDRAQKVYVQHRLRESGRDVYEWLEGGAHLYVCGDAQRMAPDVHEALVDVVSTHGGKSREDAHAWLESLREQRRYLRDVY

SEQ ID NO: 10114 - protein, 484 aa, Nitrosospira sp. HBN8222A
MIRRTKIVATLGPASRDAKVLERMINAGVDVVRINFSHGTREEHIEGAELARSLAHAAGHAVGVLADLQGPKIRIGKFENNKILLKTGDQFILDAECELGNQERVGLDYKELPSDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGLNDPEIILNHAENELLRRGAVRNGDLIIMTIGEPVGKAGGTNTMKIVKVGEHRKQERKVES

SEQ ID NO: 10115 - protein, 625 aa, Oryza sativa
MAVMEEQQEGAAGVMRRRPKTKIVCTLGPASRSVEMIGRLLRAGMCVARFNFSHGSHEYHQETLDNLRAAMESTGILCAVMLDTKARDFVLGVLILATFYFLQDFCAVVFTVGRCSSLILGFSPPDYSAGQKTISVMFCWLKISLDDDKICVVHDQFSERLCSGFLNGIKPILDLLKIQGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGAPSVFAVHGLTIETVKFVIATAAYFAASAATSIKLDSRYVIC

SEQ ID NO: 10116 - protein, 484 aa, Nitrosospira sp. PJA1
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELASDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTKNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLIIMTIGEPVGKAGGTNTMKIVKVGEHRKQERKVES

SEQ ID NO: 10117 - protein, 259 aa, Arabidopsis thaliana
MGKDGEGDKKRETMAVMSLMKDQQNPIQQFQVKFKEIETGFKSWLSKQKLPVEAAVVTAMGGVQGAFIGGLMGTLSPEMPQAGIDPQAMASLKQTQALVGGPLVQARNFAAITGVNAGIACVMKRIRGKEDLESAVVAAFGSGVAYSLVSAGLQGQPMNAITTAAGFAVFQGVFFKLGERFSKPSVEDPYYTRGRSMLLKLGLEKYEKNFKKGLLADPTLPLLTDSALRDVSIPPGPRLLILDHIQRDPELKGKRGSRG

SEQ ID NO: 10118 - protein, 368 aa, Candida albicans SC5314
MTFVPRKTFPNYNIPLNNFKGHHQKALSKFGHLAPQLDMILEVRDSRAPISTTNVLFDKVLPSKKKLILYSKKDLSILKPRLLEKWHKSKNEQYMFVDCRSKRDGKKIINEIKKLYDSMETPPPLGLRTMIIGMPNVGKSSLVNTLRYVGLSDGENAVSTKIRKVARTGGQPGVTRSTSEIIRLSRDPEIMVYDTPGVFLPTTKNAETMLSLALVGCINESFIDPVILADYLLYVLNLQDPTGKLYTDYIDHPTNNVYELLESIDQKRNVLQIDKRFDECGLANHWISKWKQGKSSKYRGLFDVAAIHEINAKDFGNLTNAERERIGLSNVQQRLQERFGDDGTSTSKHRKRTAKDREFDMKNRLFKL

SEQ ID NO: 10119 - protein, 314 aa, Erythrobacter sp. NAP1
MPPVGFGLWKIPREDTAASVVEAVKAGYRHFDSAADYANEAETGQGLAQAMTDGLVARDELWITSKLWNTFHAPEHVEEACRKTLADLKLDTLDLYLIHFPIALEYVPIETRYPPEWLHDPDAAEPVMMPAKVPLHETWAAMEALVDKGLVKQIGVCNYNSALVHDLMTYARIKPAMLQIEAHPYLTQEKLIRCAKGYGIDVTAFSPLGAQSYFELGMADEGESLLGAAPVMVAAQAHGKTPAQVLLRWGVQRGTAVIPKTSKPERMRENLDIFDFELSSVEMAAISALNQDRRFNDPGVFTEAAFNTFHPIYD

SEQ ID NO: 10120 - protein, 484 aa, Nitrosospira sp. TCH716
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELPSDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLIIMTIGEPVGKAGGTNTMKIVKVGEHRKQERKVES

SEQ ID NO: 10121 - protein, 484 aa, Nitrosospira multiformis
MIRRTKIVATLGPASRDAKVLERMINAGVDVVRINFSHGTREEHIEGAELARSLARAAGHAVGVLADLQGPKIRIGKFENNKILLKTGDRFILDAECELGNQERVGLDYKELPNDVETGATLILDDGRIVLGVSEVKGSQVYCVVEQGGILSNNKGINRKGGGLSAPALTGKDVEDIRTAAALKADYLAVSFPRSGDDMRWARDVMREAGGKSLLMAKIERSEAILALDDILEASDAIMVARGDLAVEVGDAAVPALQKRMIRTARTKNKLVVTATQMMESMVSSPIPTRAEVTDVANAVLDGTDGVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLMIMTIGEPVGKAGGTNTMKIVKVGEHRKQERKVES

SEQ ID NO: 10122 - protein, 345 aa, Glycine max
  misc_feature (267)..(267): Xaa can be any naturally occurring amino acid
  unsure (1)..(345): unsure at all Xaa locations
MAAEVYYQAIGTLQSHSYLNNLNHHQKHQNNLVTLVSRDFISSNGLSTRRSNCTGQRNCSVIRSLASQTSVVDPVLSPSRSNASDTYKKSNEAALILIRHGESLWNEKNLFTGCVDVPLSKKGIDEAIEAGKRISSIPVDVIFTSALIRAQMTAMLAMTQHRRGKVPIMMHNESEQARSWSQVFSEDTKKQSIPVIAAWQLNERMYGELQGLNKQETADRYGKEQVHEWRRSYDVPPPNGEGLEMCAERAVAYFRDQIGPRLLSGKXVMISAHGNSLTSIIMYLDKLTSQEVISLELSTGIPMLYIFKEGRFIRRGSPIGPSEAGVYAYTRRLALYKQKLDNMFQ

SEQ ID NO: 10123 - protein, 635 aa, Erythrobacter sp. NAP1
MTDFLVLATILLGVGVIAVPIATRLGLGSVLGYLIAGMAISPVLGALGVDVIQLQHFAEFGVVMMLFLIGLELEPRKLWEMRSRLIGLGGGQVLVTTLLIASTAIFIVGDPWQTGLAIGMILALSSTAIILQTLDEKGLMKSEGGQSAFSVLLFQDIAVIPMLAILPLLALPDLGGAELAADVAHAGGGHAGEAGDHGGGAGSLMDGMPAWQSGLITLGAIAFVALAGNYLTRPVFRFIASAGLRELFTATALLFVTGIALLMTVVGLSPALGTFLAGVVLANSEYRHELESDIDPFKGLLLGLFFITVGAGINFSLLATQWGEVLMWTAVLVVTKLAVLWVLGGIFKISGTARWLFALSLAQAGEFGFVLLSFAVGNSVIPQDTADLLLLVVAMSMLITPLLFILYDKVILPRFDREREFDAIEESRDIIVAGRGRVGGIVDRMLETAGYRTTVIDYSSSQIERLGRFGMRVYYGDATRPDLLASAGIDSAKLLVVAIDDKEATNRLVSYVHKAYPHVHIIARAYDRNHVFELWSLGCRDIIRETYDSSLRMGRSAYEALGLTREKAEDLVRVFEDMDREMMVPMANVWDADTPPWENEEMIALVKKLRSEWDPLLRDQMDQIMGRDDLDEAAE

SEQ ID NO: 10124 - protein, 448 aa, Mycobacterium leprae
MDRQKEFVLRTLEERDIRFVRLWFTDVLGYLKSVAIAPAELEGAFEEGIGFDGSSIEGFARVSESDTVAHPDPSTFQILPWATTAGHHHSARMFCDITMPDGSSSWADPRHVLRRQLTKANDLGFSCYVHPEIEFFLLKAGPEDGSMPIPVPVDNAGYFDQAVHDSALNFRRHAIEALEFMGISVEFSHHEGAPGQQEIDLRFADALSMADNVMTFRYVIKEVAIENGARASFMPKPFAQHPGSAMHTHMSLFEGDVNAFHSDDDPLQLSDVGKSFIAGILEHASEISAVTNQWVNSYKRLVVGGEAPTTASWGAANRSALVRVPMYTPHKTSSRRVEVRSPDSACNPYLAFAVLLAAGLRGVEKGYVLGPQAEDNVWDLTPEERLAMGYRELPTSLDSALGAMEVSEFVAEALGEHVFDFFLRNKRAEWANYRSHVSLYELKTYLSL

SEQ ID NO: 10125 - protein, 460 aa, Absidia zychae
MFGKRALTSLLVTLGVALVCAPVTVQAHPMSHVLRRQDGNDTSSGNTTQLKYTSPKLCDPDVKQYSGYLDAANDEHYFFWFFESKNDPKNDPLTIWLNGGPGCSSLIGLWEELGPCQQNGSANPHSWHHSSNMLFFDQPDGVGFSYGKQTVSTTEDAAERAWTFLQAFYETFPQYSKLDVHYFGESYGGHYIPGFASHVVDMNKKVQSGEEKGVVVPLKSIGVGNGFIDAVIQYKSYPKMTCHSTYPAVLSEEECDKMQQIYENDCKPAAEQCAESDEDSDCVNANQQCGQIEGIYAQSGYSFYDIRQQGDDTPHPFVDELNKASVIKEVGARGHFSMCSDSVGTAFAQTGDGARSYIPAVEKLLKEGIPVLIYVGDADVICNWYGNLDVADSLKWDGSDAFSKTKLEAWKADGKEVGQFRSADKLTFVRVYEAGHEVPMYQPEAALSMFQTWISGKSFG

SEQ ID NO: 10126 - protein, 286 aa, Mycobacterium leprae
MSEQNVNVYGADPSTSSIQSIQRTKIRTKHLQKMKAEGHKWAMLTAYDYSTARVFDEAGIPVLLVGDSAANVVYGYDTTVPVSADELLPLVRGVVRGAGHALVVADLPFGSYEPGPTAALAVATRFMKEGGAHAVKLEGGQRVAEQIACLTAAGIPVMAHIGFTPQSVNSLGGFRVQGRGGDAEQTVADAVAVAEAGAFSVVMEMVPTELATQITGKLTIPTIGIGAGLNCDAQVLVWQDMAGLSSGKVARFVKQYADIAGELRRAAMQYAEEVASAVFPAEEHCF

SEQ ID NO: 10127 - protein, 280 aa, Triticum aestivum
PTRPPTRPPTRPIPKENADQWLKYLRNEYPAIAFKASTQHQREKLKQSNVSTNAASESLLNTSECLGADDLIKLLKNYCRNLNLKTSITVGIIGYPNVGKSSVINSLKRSRVCGVGATPGFTKVAQQITLDKNIKLLDCPGIVFAQQGQGDQNEAEITLRNCVKVELLEDPVTPVEVILSKCGIEQLRKTYNLSFFSNVHEFLVLLAQQRGKLKKGGIPDVDQAARHVLNDWNGGKIPFYSVPPSSKQSHIDAAVVNTFAQEFDVQSIAPSNLDSAMSID

SEQ ID NO: 10128 - protein, 373 aa, Haloquadratum walsbyi
MYSFSDRVESVSISGIREVFEAAGEDAINLGLGQPDFPAPAHARDAAVEAIQAGEADAYTENKGMMSLREAIAAKHQRDQNITVNPDEIIATAGGSEALHIVMEAHIDPGDEVLVPDPGFVSYDALTRLAGGTPVPVPLRDDLTLDPAAIEERITADTAAFVVNSPGNPTGAVSSQTDIREFARIADEYDVFCISDEVYEYTVFDGEFHSPLAFADRDNVVVVNSASKLYSMTGWRLGWVLGSTSRVERMLRVHQYTQACAAAPSQFAAEAALTGPQDVITEMTDSFERRRDLIVDGLTDIGLEVPTPRGAFYCMPKVPDGFVMECLERGVIIVPGDAFGANGSGYARLSYATDEESLREALDIMQQAYTAVS

SEQ ID NO: 10129 - protein, 250 aa, Bifidobacterium adolescentis
MNFDHLEATYFVQQLAWNLRAIHFDYKRCEIALMPSFTSLRSVQVAVESDNLKIRYGAQAVSVTSQGAFTGDVSADMIAHLGCSYVIVGHSERRKYHPEDDANIVDQVRAVLAAGMQPILCVGESYEERRKGIELDFAVGQVHDVTRDLSDEEAAKLIVAYEPVWAIGTGMVATPQSAQDAARAIRNDLSDTFGTRVGETVRILYGGSVSSKNAVELINEPDVDGFLIGGSALKVDELTRICKLTLETTA

SEQ ID NO: 10130 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 10131 - protein, 404 aa, Vibrio parahaemolyticus RIMD 2210633
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 10132 - protein, 161 aa, Pinus contorta
KLAYVALDYEQELETSKSSSSQEKNYELPDGQVITVGAERFRCAEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKTEYEESGPSIVHRKCF

SEQ ID NO: 10133 - protein, 251 aa, Triticum aestivum
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSQGDAVDLIIRPMGELIDLPM

SEQ ID NO: 10134 - protein, 468 aa, Corynebacterium glutamicum ATCC 13032
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 10135 - protein, 432 aa, Bacillus licheniformis ATCC 14580
MQHTQSEKLHEEALQHIVGGVNSPSRSYKAVGGGSPVAMERGSGAYFWDVDGNKYIDYLAAYGPIITGHAHPHITKAIQTAAENGVLYGTPTKHEVTFAKMLKEAIPALDKVRFVNSGTEAVMTTIRVARAYTGRTKIIKFAGCYHGHSDLVLVAAGSGPSTLGTPDSAGVPKSIANEVITVPFNDIDSYKEALDKWGNDIAAVLVEPIVGNFGIVEPKSGFLEQVNELTHNAGALVIYDEVITAFRFMYGGAQDLLGVKPDLTALGKIIGGGLPIGAYGGRKEIMEQVAPLGPAYQAGTMAGNPASILSGIACLEVLKEKGTYEKLDRLGAMLEEGILAHAETHGIDITVNRLKGALTVYFTNEKVENYEQAENTDGDMFAAFFKLMLERGINLAPSKYEAWFITTAHTEEDIKDTLKAVDDSFKQLKQRM

SEQ ID NO: 10136 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 10137 - protein, 484 aa, Nitrosospira sp. KAN8
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELPTDVETGATLILDAGRIVLGVSEVKGSQVYCVVEQGGILSNNKGINRKGGGLSAPALTAKDVEDIRTAAALKADYLAVSFPRSGDDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAVARATMFTAGGLKIRAIAALTQSGRTVLLMSRRSSTVPIFALSPQEDTQRKMTLFRGVYPVKFGGGSNDPEIILNHAENELLRRGAVRNGDLIIMTIGEPVGKAGGTNTMKIVKVGEHRKQERKVES

SEQ ID NO: 10138 - protein, 484 aa, Nitrosospira sp. PM2
MIRRTKIVATLGPASRDAKVLERMINAGVDVVRINFSHGTREEHIECAELARSLARAAGPAVGVLADLQGPKIRIGKFENNKILLKTGDQFILDAECALGNQERVGLDYKELPSDVETGATLILDDGRIVLGVSEVKGSQVYCVVEQGGILSNNKGINRKGGGLSAPALTGKDVEDIRTAAALKADYLAVSFPRSGDDMRWARDVMREAGGKSLLMAKIERSEAILALDDILEASDAIMVARGDLAVEVGDAVVPALQKRMIRTARARNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLMIMTIGEPVGKAGGTNTMKIVKVGEHRKQERKVDS

SEQ ID NO: 10139 - protein, 527 aa, Streptomyces coelicolor A3(2)
MAQTAREPARDGLPKGFRSAELGWPELHRIPHPPYRLPLLGDVVGASRRTPMQDSLRYARRLGPIFRRRAFGKEFVFVWGAALAADLADEARFAKHVGLGVANLRPVAGDGLFTAYNHEPNWQLAHDVLAPGFSREAMAGYHVMMLDVAARLTGHWDLAEASGRAVDVPGDMTKLTLETIARTGFGHDFGSFERSRLHPFVTAMVGTLGYAQRLNTVPAPLAPWLLRDASRRNAADIAHLNRTVDDLVRERRANGGTGGGTGSGSGSGDLLDRMLETAHPRTGERLSPQNVRRQVITFLVAGHETTSGALSFALHYLAQHPDVAARARAEVDRVWGDTEAPGYEQVAKLRYVRRVLDESLRLWPTAPGFAREAREDTVLGGTHPMRRGAWALVLTGMLHRDPEVWGADAERFDPDRFDAKAVRSRAPHTFKPFGTGARACIGRQFALHEATLVLGLLLRRYELRPEPGYRLRVTERLTLMPEGLRLHLVRRTAAAPAPGRRTAAPGAADDAGDTVSAPGCPVHRAGD

SEQ ID NO: 10140 - protein, 484 aa, Nitrosospira sp. GS832
MIRRTKIVATLGPASRDPKVLERMINAGVDVVRINFSHGTREEHIESAELARSLARAAGHAVGVLADLQGPKIRVGRFEKGNILLKIGDKFILDAECELGNQERVGLDYKELPNDVETGSTLILDDGRIVLGVSEVKGSKVYCVVEQGGILSNNKGINRKGGGLSAPALTAKDVEDIRTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVKFGGGSNDPEIILNHAENELLKRGVVRNGDLIIMTIGEPVGKAGGTNTMKIVKVGEHRKLERKPGS

SEQ ID NO: 10141 - protein, 610 aa, Colwellia psychrerythraea 34H
MLEMAVIYLAAAIIAVPIAKRVGLGSVLGYLLAGILIGPFLLGLVGDQTDVMHFAEFGVVMMLFLVGLELQPSRLWKLRHSIIGLGGLQVVVTTLLISAACYTILSLAWQTSLAIGLMLALSSTAIVLQTLNEKGWIKQEAGQNAFSVLLFQDIAVIPILALVPLLAFSDNISDSGSHGNLIEHFPVYIQTAISVGVIAAIILAGKYVSAPLFRYIAETRLRELFTVFALFLVIVIAVIMQKIGLSPALGTFLAGVVLAESEFRHELEVDIEPFKGLLLGLFFITVGASIDFPLLFEELGLVTLLVVSLIAIKAAVLFLLSILFKMEKKQKLLFTLALAQGGEFAFVLLSLTSSLQILTPEQSKITTLVVAISMLMAPVLLIFYEKVLDKEAENAREFDKPEDIEATKSVIIAGYGRFGQIVGRLLGSQGYHLSILDHSPTQIDLLKKFGNKVFYGDAARKDLLEASGAQEAQLLVIAIDDADKIIEIAQLAQKHYPNLQIVARAIDRHHAYELIRIGVKTIKRETFESALGLGVSALELLGNSQESAKRAGQLFSEHDRESMHVLSEVWGDDHSYGVAVKQRMELLKQVLVSDEEEQSKIQTCQKSPEA

SEQ ID NO: 10142 - protein, 484 aa, Nitrosospira sp. NRS527
MIRRTKIVATLGPASRDPKVLERMINAGVDVVRINFSHGTREEHIESAELARSLARAAGHAVGVLADLQGPKIRVGRFEKGNILLKIGDKFILDAECELGNQERVGLDYKELPNDVETGSTLILDDGRIVLGVSEVKGSKVYCVVEQGGILSNNKGINRKGGGLSAPALAAKDVEDIKTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVKFGGGSNDPEIILNHAENELLKRGVVRNGDLIIMTIGEPVGKAGGTNTMKIVKVGEHRRHERKPGS

SEQ ID NO: 10143 - protein, 484 aa, Nitrosospira sp. TYM9
MIRRTKIVATLGPASRDPKVLERMINAGVDVVRINFSHGTREEHIESAELARSLARAAGHAVGVLADLQGPKIRVGRFEKGNNLLKIGDKFILDAECELGNQERVGLDYKELPNDVETGSTLILDDGRIVLGVSEVKGSKVYCVVEQGGILSNNKGINRKGGGLSAPALTAKDVEDIKTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVRFGGGSNDPEIILNHAENELLKRGVVRNGDLIIMTIGEPVGKAGGTNTMKIVKVGEHRKLERKPGS

SEQ ID NO: 10144 - protein, 405 aa, Streptococcus mutans UA159
MMKEFNKSAKLEHVAYDIRGPVLEEADRMIANGEKILRLNTGNPAAFGLTAPDEVIRDLIMNARESEGYSDSKGIFSARKAIMQYCQLKNIPDVDVDDIYIGNGVSEMITMSMQGLLDDGDEVLVPMPDYPLWTAAVSLAGGQAVHYVCDESSNWYPDIDNIKSKITSNTKALVVINPNNPTGALYPKDVLEDIVEVARQNDLIIFADEIYDRLVMDGGEHVAIASLAPDLFCVSMNGLSKSHRIAGFRVGWMVLSGPKKHVKDYIEGLNMLSNMRLCSNVLAQQVIQTSLGGVQSIDELLLPGGRIYEQRNFIYKAMNEIPGITAVKPQAGLYIFPKIDRNMYRIDDDEQFVLNFLKQEKILLVHGRGFNWMEPDHFRIVYLPRVEELSKIQEKMTRFLGQYRK

SEQ ID NO: 10145 - protein, 149 aa, Brassica rapa
GTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGPYKGDAKLGDGAAESLSRQGLQVLENSLYMVSGL

SEQ ID NO: 10146 - protein, 629 aa, Gibberella zeae PH-1
MLDNSPPDRQWWKEAVVYQIYPASFLDSNADGLGDLPGIISKLDYIRSVGATAIWLSPIFKSPQHDMGYDISDYRDIHRPYGSIQDVEALIKGCHERDIKILLDLVVNHTSHEHEWFRESRSSKTSPKRDWYFWRDPKFDADGNHKPPNNWSSIFGGSAWTYDEPTGQYYLSLFLPEQPDLNWANEDMRQATYADMKFWLDKGADGFRIDSMNLMSKHPDLPDAPITRPDSEFQPGDKYFASGPRMHEYIREIREEVIDKYDCMTVGELGFTKDEASVASYVAKERHELNMLFTGDIVDMDFGANHKYERDDFRLSKLKTITSRWQGAMPKFDGWNTIYMDNHDSGRSLSRYGSDLPQFRKEAAKMLAIYLSTLSGTLFLLQGQEIGMANVPESWKIEDYIDVEGLNYYNSQLEKRGLGADMSDIMREMRLKARDNGRLPMQWTADKNAGFSKGEKPWMRVNDDFKEWNVAQQENDGDSVLAFWRQVLELREKERDVFVYGRFTNLPDYEDSEDIFAYTMTSFDGRSALVLLNFSDKEQKVEVKNGSWGKKLIGKNANEFGKEGVLLQAYEVVTTVVKMIVKVYLKPFVAELSSATSSIHLPFAYKSKKILTLTTDSAHEILWSMFLMP

SEQ ID NO: 10147 - protein, 183 aa, Triticum aestivum
  misc_feature (141)..(141): Xaa can be any naturally occurring amino acid
  unsure (1)..(183): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEDVKKEYXPYVRIIGFDNMRQVQCVSFIGFKPPGCKIRQGLNSSLTTGHI

SEQ ID NO: 10148 - protein, 242 aa, Glycine max
  misc_feature (98)..(98): Xaa can be any naturally occurring amino acid
  misc_feature (166)..(166): Xaa can be any naturally occurring amino acid
  unsure (1)..(242): unsure at all Xaa locations
MQMMETMHVVDDEICYRANDYLTVHKLFATRADLHQTVYTHAKVKAIELMVIDALVKANPFLQITSLIHQPSEFWKLDDSILKTIESSSQQELKESRXLIQRIRRRDLYQYCNEFSVPKERLDHFRSITPQDIVCSQTNGANLKEEDVVVSYVKIDLTRGRANPLXKEYGSKEKFRIPNDCISHLLPAYCEDVIVRVYSREREQVEAVSNAFENYQLKTFGRKKQVHDTPEKKKRPKYFPSL

SEQ ID NO: 10149 - protein, 621 aa, Coccidioides immitis RS
MKPATSTANWSKGETQRSLIGTLFGRPHRDATLDDVELLPSQPEEQELQSLPAFFFSFGEGSDPLQEGGLSWLRPCRESSTCDTDGQVHSMLRAYMIMEEEPGCLIRTFTAGKMLSALKDIPPGHLALGAAACFLLYQVYLYLTLGLARRKFIQQNGCRPPPAYPHKDPILGLDWALKGMKYSRSRTFLQGTQKRFREHGNTHSLNVIGKPAIATCDPENIKATLATKFQDFDLSTVRKRLFQPLFGKGIFTTDGAEWEHSRAMLRPNFVRSQVADLDMIERHLKNLFKEIPTDGSTVDLQDLFFDLTLDTATEFLFGESAYTLTKKDMGSGERFSDIFTYCTAVIGQWARLGIFLGIPDRRYHRYAAGVHEFADRYVQKALENYRAQQSGMITSDKTSNRYIFLDELVKSTQDPVELRSEALNILLAGRDTTASLLACLWNVLSKRPDVWSKLLNEVDALNKKRPSFEELKNMKFLRYCVNEALRLYPVVPGNTRVAVRDTFVPVGGGPDGKSPVFVPKGTLLNYSVYTMHRREDIYGPDAAEFKPERWEKLRPGWEYLPFNGGPRICLGQQLALTEASYTTVRLMQEFRHVESRDPNPWEELLTVTCASAHGAKVALRP

SEQ ID NO: 10150 - protein, 281 aa, endosymbiont of Riftia pachyptila
LIIPVPYWVSYPDMALLAGGVPVYVHADASQHFKITPAQLQAAITSLTKLVVINSPSNPTGIAYSRQELEALGEVLREHPKLLIATDDMYEHILWSDEPFCNILMACPDLANRTLVLNGVSKAYSMTGWRIGYAGGPANIIKAMKKIQSQSTSNPTSISQVAAQTALEGPQECIKEMLTSFKERHDYVLERLNTMPGISCLPADGTFYLFPNIEGALESIGGVSNDLELAEYLIEQAGVALVPGYRIRPRRPCQDIHRHQHDKSAKRPRPDRKRFELRDRL

SEQ ID NO: 10151 - protein, 509 aa, Bacillus cereus ATCC 10987
  misc_feature (489)..(489): Xaa can be any naturally occurring amino acid
  unsure (1)..(509): unsure at all Xaa locations
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSDGEPMTAHTTNPVPFIVTKNDVELREGGILGDIAPXMLTLLGVEQPKEMTGKTIIK

SEQ ID NO: 10152 - protein, 446 aa, Rhodococcus sp. RHA1
MDIARLNFSHGDHTDHEANYRRVRAAADNTGRAVGILADLQGPKIRLGRFADGAAVWTAGEQVRITVEECEGTHDRVSTTYTHLAQDARPGDRLLVDDGKIALTVIDIDGNDVVCRVTEGGPISNNKGVSLPGMNVSVPALSGKDIDDLEFALRLGVDLIALSFVRAPTDIDRVHEVMDRIGRRVPVIAKIEKPEAVDDIEAIVRAFDAVMVARGDLGVEVPLEHVPLVQKRIVQIARENARPVIVATQMLESMIDNSRPTRAEASDVANAVLDGADAVMLSGETSVGAYPIETVATMARILSAVEHQSTTVPDLTHIPRTHGGVLSFAARDIGERLNATALVAFTQSGDTARRLARLHTPLPLLAFTPVPQVRNELALTWGTETFLVDPVASTDEMIRQVDTALLRLGRYQRGDLVVIVAGSPPHTVGSTNLIHVHRIGEDDFTK

SEQ ID NO: 10153 - protein, 175 aa, Glycine max
  misc_feature (112)..(112): Xaa can be any naturally occurring amino acid
  misc_feature (122)..(122): Xaa can be any naturally occurring amino acid
  misc_feature (125)..(126): Xaa can be any naturally occurring amino acid
  unsure (1)..(175): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 10154 - protein, 240 aa, Bacillus cereus ATCC 10987
MVKLVLIRHGQSEWNVENRFTGWTDVDLSSKGLEEAREAGVMLKASGFSFDIAYTSVLRRAMRTLWITLEEMDLMWIPVYKTWKLNERHYGALQGLNKEETARKYGDEQVTLWRRSTNVRPPALTKDDERYEAAHPKYRDIKDYEFPLTEDLEDTEKRVVSYWNEEIAPNVKAGKQVIIAAHGNTIRALVKHLDQISDKDIENVNIPTGTPLVYELDNDLKPIGHYYLNREIETLEEKQV

SEQ ID NO: 10155 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 10156 - protein, 374 aa, Arabidopsis thaliana
MVVILFYLMPCWFVLFLGRVCRRRGVRRGTRPPPPPPPTNSSFFQSHFLYQIRRQFQLFSEEISFTEFSTPIDQLKIEMEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQVKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 10157 - protein, 245 aa, Bacillus cereus ATCC 10987
MIKLVLIRHGQSLWNLENRFTGWTDVDLSENGLSEAREAGAILKKNGYTFDVAYTSVLKRAIRTLWIVLHEMDLAWIPVHKCWKLNERHYGALQGLNKDETAKKYGEEQVHIWRRSIDVRPPALTEDDPRYEMNDPRYKALKKGELPLTECLVDTEKRVLAYWHSEIAPSLKSGEKVIISSHGNTIRSLVKYLDNLSSDGVVSLNIPTSIPLVYELDDNLRPIRHYYLSMDGEVPEGEIPKHISF

SEQ ID NO: 10158 - protein, 470 aa, Cytophaga hutchinsonii ATCC 33406
MVNKKTKIIATVGPACNTKEKLWELVQAGANIFRLNFSHGTHDVHQGVINAIRELRKEHNVNIAILQDLQGPKIRTDEVENNGVELVAGAQIVITKEKMLGTKDKISTSYKMLTSDVKKGDAILIDDGNIELKVLETGNGEVTCVVIYGGILKSRKGINLPNTIVSEPSLTDKDKEDLLFGLKNEVDWIALSFVRSAVDLNELKAIIAEHGKSCKVIAKVEKPEAVKDIDAIIEASDAIMVARGDLGVELQMEDVPMIQKMIIKKCNQLAKPVIVATQMMESMITNARPTRAEASDVANAIIDGTDTIMLSAETASGNYPVITVKAMTRICQAVEKEADIYNKSTLDDITNTSDSVIASACELADKVNAKAIIGLSQSGYSAFRIASHRPKASIYIATHDEQLMNQMNLVWGVQAFRFEKFTTTDESIEAVKKSLVEKGLLKKGDIYVTTASMPMADIQLANSLKLGIVE

SEQ ID NO: 10159 - protein, 765 aa, Sclerotinia sclerotiorum
MNRYDDGELEISLAPSANHRAQHRSSEASSNPRRDSQNGGNRRMESAPQKKTEQRVGAYSVVRTLGEGSFGKVKLAVHRVTQQQVALKIIARRKLISRDMAGRVEREIEYLQLLRHPHIIKLYTVIKTPHEIIMVSEYAGNELFDYIVQHGKMREDEARRFFQQIICAVEYCHRHKIVHRDLKPENLLLDENLNVKIADFGLSNIMTDGNFLKTSCGSPNYAAPEVINGKLYAGPEVDVWSCGVILYVLLVGRLPFDDEHIPSLFAKIARGQYNVPSYMGREAAALIKKMLAVNPVYRATIAEIRDDPWFTTNLPAYLQPPVEEFIDTGVDPAKAINPRAIAPHASPAIQEKLHVQVTEKISKTMGYGIKDVQEALAAEEPSAIKDAYLIVRENKLMQANPNLTDDKNQLLFQIPSPPTYDSTIPPSMPDSPSPLVKERPGNIPPTAPPFQPRPSPLLDAVSPRSSSSIGTDRSFVRPYVSKIGILPSSIPQYHKEFMETHKSGHQESTLSNSHSETIEPSPQTEAEKAETVRRLNPHSRSLAKLDEGKKPAGMTPVPVKKAKPTKWQFGIRSRNQPLEAIGCIYRALQKLGAEWLVGDEWTPGQSENNGNKRNDDNDDNDDPNGSGASLHRETSMNDNSKKNRFSGIDKKGNYKLPEDPWVLHVRWKKTDIRRHSIASLNSSTSSPAHPSSMPKDEGLDSIDGGVIMHLDIQLYEMEPGVYLVDFKCAGYETADGMMCEEKDVTSPFPFLDLASKLIIQLAEAD

SEQ ID NO: 10160 - protein, 483 aa, Cupriavidus necator
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 10161 - protein, 478 aa, Nitrosovibrio sp. RY3C
MIRRTKIVATLGPASSDPKTLERMIHAGVDVVRINFSHGSREEHIALAELTRSLARSAGPTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALKDILQASDAIMVARGDLAVEVGDAVVPALQKQMIRAARAANKLVVTATQMMESMITSPIPTRAEVSDVANAVLDGTDAVMLSAESAAGQYPVESVEAMARVCLEAEKEYLVTQELRRMPDTVPETIEEAIARATMFTAGSLKIRVIAALTHSGVTALLMSRRSTNVPIFALSPQEDTRRKTTLFRGVYPMKFGGGQSDPEIILNQAEDELLKRGAVHNGDLIVMTIGEPVGKAGGTNTMKIVKVGEYRKA

SEQ ID NO: 10162 - protein, 343 aa, Oryza sativa (japonica cultivar-group)
MEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVIEYQQLITQNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDR

SEQ ID NO: 10163 - protein, 478 aa, Nitrosovibrio sp. RY6A
MIRRTKIVATLGPASSDPKTLERMIHAGVDVVRINFSHGSREEHIALAELTRSLARSAGHTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALNDILQASDAIMVARGDLAVEVGDAVVPALQKQMIRAARAANKLVVTPTQMMESMITSPIPTRAELSDVANAVLDGTDAVMLSAESAAGQYPVESVEAMARVCLEAEKEYLVTQELRRMPDTVPETIEEAIARATMFTAGSLKIRAIAALTHSGVTALLMSRRSTNVPIFALSPQEDTRRKTTLFHGVYPMKFGGDQSDPEIILNQAEDELLKRGAVHIGDLIVMTIGEPVGKAGGTNAMKIVKVGEYRKA

SEQ ID NO: 10164 - protein, 345 aa, Arabidopsis thaliana
MASSSNYDGILLGMGNPLLDISAVVDDEFLTKYDIKLNNAILAEDKHLPMYDEMSSKFNVEYIAGGATQNSIKVAQWMLQIPGATSYMGSIGKDKYGEAMKKDATAAGVNVHYYEDESAPTGTCGVCVVGGERSLIANLSAANCYKVDHLKKPENWALVEKAKFYYIAGFFLTVSPESIQLVSEHAAANNKVFTMNLSAPFICEFFKDVQEKFLPYMDFVFGNETEARTFSRVHGWETEDVEQIAIKISQLPKATGTYKRTTVITQGADPVVVAEDGKVKKYPVIPLPKEKLVDTNGAGDAFVGGFMSQLVKEKSIEECVKAGCYASNVVIQRSGCTYPEKPDFN

SEQ ID NO: 10165 - protein, 478 aa, Nitrosovibrio sp. FJI82
MIRRTKIVATLGPASSDPKTLERMIHAGVDVVRINFSHGSREEHIALAELTRSLARSAGHTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALNDILQASDAIMVARGDLAVEVGDAVVPALQKQMIRAARAANKLVVTATQMMESMITSPIPTRAEVSDVANAVLDGTDAVMLSAESAAGQYPVESVEAMARVCLEAEKEYLVTQELRRVPDTVPETIEEAIARATMFTAGSLKIRAIAALTHSGVTALLMSRRSTNVPIFALSPQEDTRRKTTLFRGVYPMKFGGGQSDPEIILNQAEDELLKRGAVHNGDLIVMTIGEPVGKAGGTNTMKIVKVGEYRKA

SEQ ID NO: 10166 - protein, 258 aa, Saccharomyces cerevisiae
MSETELRKRQAQFTRELHGDDIGKKTGLSALMSKNNSAQKEAVQKYLRNWDGRTDKDAEERRLEDYNEATHSYYNVVTDFYEYGWGSSFHFSRFYKGESFAASIARHEHYLAYKAGIQRGDLVLDVGCGVGGPAREIARFTGCNVIGLNNNDYQIAKAKYYAKKYNLSDQMDFVKGDFMKMDFEENTFDKVYAIEATCHAPKLEGVYSEIYKVLKPGGTFAVYEWVMTDKYDENNPEHRKIAYEIELGDGIPKMFHVD

SEQ ID NO: 10167 - protein, 234 aa, Zea mays
TRKTWFDDKPNDGTAAHVISRGGPVERGQIDEEGIREGEDLHRGLKARQISMIAIGGSIGTGLVIGSGSGLAKGGPVGLLIAYVIMGAMCFGVMCSLGEMATYLPHKKGFGGYASRFVDPSMGFALGWNYLMKYLVVTPNNITAGAIVVRYWTDKVPIGAWITIYIGGCFLVNLLGIEVFGEVEFWASFIKIIVLAGLILLGIIIDLGGAVVDRIGFRYWRGQPFSHYIFQNDT

SEQ ID NO: 10168 - protein, 285 aa, Ralstonia metallidurans CH34
MSEAPDRSPSAPDWRIDADFLHLELGAGAAHAWAVEVVEETGSTNADLTQACRAAPWSDDACSVRVAYRQTAGRGRHGRPWRGQAGLTFSVAMPLALSPARLSGLSLAVGLALAEALEDVDPALGARVGLKWPNDLQIDGRKLSGILIESVPAGPERVWVVIGIGLNLVRDPAMEAALGRDLAGVAEAMTTFDPQRDPTRILAAIANRLARMREAFLVDGFAPMAARWSARDAFRDEPVRLLHDGVVQAEGLARGVDGEGYLLLHTPEGLQRIASGEVSLRGASA

SEQ ID NO: 10169 - protein, 178 aa, Triticum aestivum
  misc_feature (145)..(145): Xaa can be any naturally occurring amino acid
  misc_feature (151)..(151): Xaa can be any naturally occurring amino acid
  unsure (1)..(178): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYXRIIGFXNMRQVQSSVHAFSTGCKIGRLTVTTAI

SEQ ID NO: 10170 - protein, 479 aa, Acinetobacter baumannii
MTTARHSDTENSPDHLQRKLSNRHLQLIAIGGAIGTGLFMGSGKTISLAGPSILFIYMIIGGMFFFLMRAMGELLLANLHYKSFVDMAHDLIGPWAGYYLGWTYWLGWVLVGIADLSAVINYLSFWLPDGASFSPIQQAMISAGCVLFVMGLNLLTVRLFGEIEFWFALIKILAIIGLIGVGGYMIFSHFQAPQGAVASISNVWSHGGLFPKGTEGFLAGFQIAVFAFVGVELVGTTAAETKDPQKNLPKAINAIPVRIILFYVLALFIVMSVTPWDHIRADKSPFVELFLNAGIPVSAIIMNLVVLSSVMSSMNSGVFSTSRMLFGLSKDGQAPGAFGRLSKRAVPSNGLIFSCTFIMGGAVLQYFVPNTMEAFTLASSLCVILFISVWSLIMVCYLRYRKLRPELHEKSTFKMPGGIWMSYVVLAFMLFTLVILALEPDTLKALYVSPVWLIILGVTYHVLYKPRMKRLGRELVNDH

SEQ ID NO: 10171 - protein, 465 aa, Porphyromonas gingivalis W83
MEITDLAAEGNALCRIDDMVMFVPFAAPGDRCTVQVVKKKRNFMQGRIVSIESPSPIRKGPFCTHFTVCGGCKWQHIPYEIQLRAKEQQVTDALVRLGKVEVEEMQPILGSEQTEYYRNKLEFTFSNKRWLLPEEVQEVDGDFSPEVRYGLGFHIPGMFDKVLDIRECHLGAKVSDEIRLFIREYCMQDPERYPFFDLRNQEGLMRTLMIRTTSTGELMVVVVFFRDDVAAREALLAAVAERFPQITSLLYVINTKCNDTIGDQEVLLYHGREYIEEEMEGLKFKIGAKSFYQTNSRQAYQLYRIAREFAGLTGDELVYDLYTGTGTIANFVAGQAHRVIGIEYVPEAIEDARTNSLLNGIENTLFYAGDMKDILTNDFIEQHGRPDVVITDPPRAGMHESVIDAILFAAPRRIVYVSCNPATQARDLALLMADGRYRAVKSRPVDMFPHTHHVENVVLLVRNTE

SEQ ID NO: 10172 - protein, 555 aa, Bacillus subtilis
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWLRGDLFNRQPYRDFYIWKKPQENGSVPTNWESKFGGSAWELDEASGQYYLHLFDVTQADLNWENEEVRKHVYDMMHFWFEKEIDGFRLDVINLISKDQRFPNAEEGDGRSFYTDGPRVHEFLHEMNEKVFSHYDSMTVGEMSSTTVDHCIRYTNPDNKELDMTFSFHHLKVDYLTAEKWALAPFDFLKLKEILSDWQTGMHAGGGWNALFWCNHDQPRVVSRYGDDGAYRVKSAKMLATAIHMMQGTPYIYQGEELGMTNPKFTDISSYRDAESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTVAHMSPLFIV

SEQ ID NO: 10173 - protein, 499 aa, Gibberella zeae PH-1
MANPFQRPFQLENESLFHCTSLINGDFVSAKEGKTFNVVDPGSGKTWASCPDCTASDVDSAVASSYETFKTYSKTTPRFRAQTLMKWHNLILAAREDLARILVHETGKTLVEARGEIDYALTFVWWFSGEADRAHGTSMSCAIPGRRAVTIKQPIGVAAALVPWNFPIALALRKAAAALAAGCTMVVKPSPETPLTCVSIAHLALEAGFPRGALNVVTTSLENTPTVAEALCLDARVKKVSFTGSTRVGKIIASFCAPNLKKTTFELGGNCPFIVFDDADVGQAVSQLMPLKWRHAGQACITSNRVFVHSSIYDTFVEKVVQETRGLKLGHGMEEGSTMGALTTPRGLDKAEELYQDAISKGAKTVLGTGKREEGQGYFMAPTILTEMEDDMLMTHEEIFAPVLGFYRFESEEEVVQRANDTPLGLASYIFTKNVDRLWRLFENLDAGMIGLNAGNSSSAEAPFGGIKDSGHGKESGKDVAIDEFLITKTATLTIDGHY

SEQ ID NO: 10174 - protein, 271 aa, Zea mays
MADGKRGEDSAVALKTSPSSAVMAGGLRGVSNPLEEWSGRVKAIEAGFRAWMAKQPIQIEAAVTTAVGAVQGGALGGLMGSLTADGGSPFPIPQPPPNANPEAMASFKQAQALAGGPLVQARNFAVMTGANAGISCVMRRIRGKEDIQGSMAAAFGSGALFSIVSGMGTPNPVANAVTTGVAFAVFQGGFFMIGQKFSKPPSEDTYYSRTRSMLHKLGLEKYEKNFKRGLLNDQTLPLLTDSALRDVKIPPGPRLLILDQIKRDPELVRAK

SEQ ID NO: 10175 - protein, 141 aa, Glycine max
MLRTCRWRWSTLRFTQSKPVMATTSDFPSVTAFRYLVAAVSLQSLWSLSLGVADMYAILVRRGYRNVRIVRLFSIGDGITSTLTFSAACASAGITVLIGNDLNDCAQNHCSRFETATAMAFMSWFAASPSFILNFWTLASK

SEQ ID NO: 10176 - protein, 332 aa, Parvularcula bermudensis HTCC2503
MAPQFDVIAIGNAIVDLLAHVPDGFPEAHDVPRGGMVLIDSEKAAAMTRAMPGSEQVAGGSAGNSMVCLSRLGGAGGFVGKVANDELGDAYRRSMEEAGVQFIAAPLDQGPPTGRCHIAVTADAERSMATYLGAAGEVSEADIDDDMIRRAEMVFFEGYLFDGELPRSAFEKAAAIAHKAGKRAALTLSDVGVVERNRDELIRILEKHVDLIFANEDEARALFGHHETPAELAAEMAKLVPFGAITCSERGSIVYGPDQDATTVPAVAPVQLVDTTGAGDAYAGGFFYGFTRGKPLPSCATLGSVIASEVISHMGPRPVADIRQMAADRDLL

SEQ ID NO: 10177 - protein, 289 aa, Glycine max
YWHCCYTDNGLNGFYAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 10178 - protein, 151 aa, Prochlorococcus marinus str. MIT 9211
MVAERTFLAIKPDGVQRGLVGEILSRFERKGFKLIALKQLIPSRALAEQHYGVHRERPFFKGLVDFITSGPVIAMIWEGEGVILGARKLIGSTKPLDADPGTIRGDLAIDIGRNVIHGSDGPETASFEIGLWFESSELSDWNPSDQLWRVE

SEQ ID NO: 10179 - protein, 212 aa, Haemophilus somnus 129PT
MNQSLLSQFGTSEERVKRAIEAFKRGNGVLVLDDEDRENEGDLIFPAETITVEQMAKLIRYGSGIVCLCITDELCQQLDLSPMVQNNTSINQTAFTVSIEAAQGVSTGVSAQDRVTTIQAAIADNAKPQDLSRPGHVFPLRAKKGGVLARRGHTEAAVDLASWAGHKPAGVICEITNDDGSMARTPEIVEFGKKFNYPVVTIEDLVRYASNK

SEQ ID NO: 10180 - protein, 191 aa, Medicago sativa
FPFEKRSDSIPLSISQLPSVLKLFSIPEDSPQAKSMRETLEQCQAEPVAGESKTCANSIESMLEFVDKIIGSDSKHNVLTTSHPSPSAIPLQKYTILKVSHDISAPKWVSCHPLPYPYAIYYCHYIATGTRVFKVSLVGDVNGDKIEAVGMCHLDTSDWNPDHMIFRTLRIKPGKNVPVCHLLSINHLLWV

SEQ ID NO: 10181 - protein, 476 aa, Acinetobacter baumannii
MTMVHHSDEASSPDHLQRKLSNRHLQLIAIGGAIGTGLFMGSGKTISLAGPSILVIYMLIGGMFFFLMRALGELLLANLHYKSFVDMAYDLIGPWAGYYIGWTYWLGWVLVGIADLSAVINYLSFWLPEGASFSPMQQAMISAGCVLFVLGLNLLTVKLFGEVEFWFALIKILAIIGLIGVGGYMILTHFQAPHGDVVSISNVWSHGGLFPKGVSGFLAGFQIAVFAFIGVELIGTTAAETKDPQTNLPKAINAIPVRIILFYVLALFVVMSVTPWNHIRADKSPFVELFLNAGIPISAIIMNLVVLSSVMSSMNSGVFSTSRMLFGLSKDGQAPSVLGRLSKRAVPSNGLIFSCIFIMGGAVLQYFVPNTMEAFTLASSLCVILFISVWILIMACYLRYRKIRPELHAASTFKMPGGVLMAYAVIAFFLFTLVILALEPDTLKALYVSPVWLVVLSVTYYAFYKPRMRKLGQEIF

SEQ ID NO: 10182 - protein, 483 aa, Pseudomonas syringae pv. syringae B728a
MIPVILSGGSGSRLWPLSRKQFPKQFLALTGEHTLFQQTLERLVFEGMQEPIVVCNKDHRFIVNEQLAALNLETQAILMEPFGRNTAPAVALTAMKLVNEGNDGLMLVLPADHVIEDQKALQRALALATVAAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDSSTFACCPDNSIDYAVMEKTQRACVVPLSAGWSDVGCWSSLWEVNAKDANGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 10183 - protein, 335 aa, Burkholderia thailandensis E264
MRLQGGAKFPTGGRPACCRRARERPRDARGQQIWSDARADGHSPDERRCADGHVRPVSPAARGVVRAARKRRRAVCLLCPETFFAPFFPRGAFHIMSFPLPSKSAPADAFSDLPLLDVEPVPPRIAAALAALREGRAVVLQDDHDRENEADLIVAAERLTDETMALLIRECSGIVCLCLTDEKVRALALPPMAQLNESKNGTAFTVSIEARAGVTTGVSAADRVTTIRAAIADDAQPHDIVRPGHVFPLRAAPGGVLARRGHTEGTVDLAILAGLKPAGVLCELMNPDGTMTRGADVERFAAQHGLPMLTIAELVEFRERLASLRERDACCEGVA

SEQ ID NO: 10184 - protein, 482 aa, Staphylococcus epidermidis RP62A
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 10185 - protein, 267 aa, Schizosaccharomyces pombe
MSLKQITISTLRQWKLANKKFACITAYDASFSRLFAEQGMPVMLVGDSLGMTAQGHSTTLPVSVEDIAYHTKSVRRGAPNRLLMADLPFMSYSTWEDACKNAATVMRAGANIVKIEGGGNWIFEIVQRLTERSVPVAGHLGLTPQSVNIFGGYKIQGREQSAAARLIENAQQLEKFGAQLLVLECIPESLAEQITKTISIPTIGIGAGKHTDGQILVMHDALGITGGRPPKFAKNFLSGAGDIRTAIQRYIYEVEQGLYPAEEHSFQ

SEQ ID NO: 10186 - protein, 461 aa, Glycine max
MFSSGSLRRNLSWQFTRQASLDPRRNNQRFSFGRQSSLDPIRRSPCSGNAELTVPENLDSTMQLLFMACRGDVKGVEDLLNEGIDVNSIDLDGRTALHVAACEGHVEVARLLLSRKANLDARDRWGSTAAADAKYYGNTEIYYMLKARGAKVPKTRKTPMTVANPREVPEYELNPVELQVRKSDGISKGTYQVAKWNGTKVAVKILDKDSYSDPDTINAFKHELTLLERVRHPNVVQFVGAVTQNIPMMIVREYHSKGDLASYLQKKGRLSPSKVLRFALDIARGMNYLHECKPDPVIHCDLKPKNILLDNGGQLKIAGFGTVRFSLISPDEAKLVQPEPNIDLSSLYVAPEIYKDEVFDRSVDAYSFGLIIYEMIEGTHPFHPKSSEEAVRLMCLEGKRPAFKIKTKHYPPELKELIEECWDPTPVVRPTFSQVIARLDKIVANCSKQGWWKDTFKLPWK

SEQ ID NO: 10187 - protein, 466 aa, Yarrowia lipolytica CLIB122
MLRSAAARAVRAVRPRLSARYMATTALPQDPIPSGALGQKVPHVDESHQDLLFRTSHMVEDLETYDEDSPINTSDANTRIRAFTINFGPQHPAAHGVLRLILELSGEEIIRSDPHVGLLHRGTEKLIEYKTYMQALPYFDRLDYVSMMTNEQVFSLAVEKLLNVEVPLRGKYIRTMFGEITRVLNHLMSVCSHAMDVGALTPFLWGFEEREKLMEFYERVSGARLHAAYVRPGGVSQDLPAGLLDDIYMWATQFGDRLDEIEELLTDNRIWKLRTVNIGTVTAQDALNLGLSGPMLRGSGIPFDIRKNAPYDAYDKVDFDVPVGMNGDCYDRYLIRMAEFRQSLRIIEQCCNDMPAGAVKVEDFKINSPPRNLMKEDMEALIHHFLLYTKGYSVPPGETYTAIEAPKGEMGVYVVSDGSERPYKCKIRAPGFAHLGAFDHIARGHFLPDAVAIIGTMDLVFGEVDR

SEQ ID NO: 10188 - protein, 186 aa, endosymbiont of Riftia pachyptila
LHGIWPRRCRPAGHWLSRSPPGCVRRPCSTGSARASRWCASMPNTPAMIQAGATGLHASAGVNDAQRNQAESILRAVGLTRWVEDEAQIDAVTALSGSGPAYFFLVMEAMEAAAVELGLDSESARLLTLQTALGAARMAIESRDAPATLRQKVTSPGGNTEKALGILEEGGLRDLFKDALLGAKTR

SEQ ID NO: 10189 - protein, 369 aa, Saccharomyces cerevisiae
MDTDLDVPMQDAVTEQLTPTVSEDMDLNNNSSDNNAEEFSVDDLKPGSSGIADHKSSKPLELNNTNINQLDQWIEHLSKCEPLSEDDVARLCKMAVDVLQFEENVKPINVPVTICGDVHGQFHDLLELFKIGGPCPDTNYLFMGDYVDRGYYSVETVSYLVAMKVRYPHRITILRGNHESRQITQVYGFYDECLRKYGSANVWKMFTDLFDYFPITALVDNKIFCLHGGLSPMIETIDQVRELNRIQEVPHEGPMCDLLWSDPDDRGGWGISPRGAGFTFGQDVSEQFNHTNDLSLIARAHQLVMEGYAWSHQQNVVTIFSAPNYCYRCGNQAAIMEVDENHNRQFLQYDPSVRPGEPSVSRKTPDYFL

SEQ ID NO: 10190 - protein, 411 aa, Nostoc sp. PCC 7120
MPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 10191 - protein, 294 aa, Arabidopsis thaliana
MGRTETTKPAGELRGEKNPAKKGNSNSSSVDHCFTSASRAFTQKKLADLKSLFFSLASKSQSNDQYVSYPVFQEYFGLSGSLGERIFDMVTQHRKDDKMTFEDLVIAKSSIGLAATYEKGTDDEIAEFIYQTLDVNGNGVLRRSDLESFLVVILKSVFSTESSDAESSDYKEMVDALLDAATFSKSDDGSEKGMSFEDFRSWCPLVPTIRKFLGSLLIPPGPVRPGYQVPDLLYEDSVSSDRLLLKKEYAWHIGGALPHHELVEWKLLYRSSLHGQSFNTFLGHTSGMEGSNMA

SEQ ID NO: 10192 - protein, 267 aa, Synechococcus sp. WH 8102
MRPADLIRQKQNGRTITILTAWDSLSAALVEAAGADAVLVGDSLAMVALGHATTLPVTLDQMRHHTLAVSRGFAAAPSKQPLLICDLPFLSYQCGADLAVQAAGTLLKETPAAAVKLEGAEAEVLAVIDRLVRMGIPVMGHLGLTPQAVHRLGYRRQAEDPVSQERLLTQAIALEQAGCFALVLEHVPSALAREVRRRLLIPVIGIGAGDDCDGQIRVTADLLGLTEQQPPFSPALIPGQQLFVEALRTWIAAQTPTTTPPPATPDY

SEQ ID NO: 10193 - protein, 273 aa, Bacteroides fragilis NCTC 9343
MAGYISDDTRKVTTHRLIEMKQRGEKISMLTSYDYTMAQIVDGAGIDVILVGDSASNVMAGNVTTLPITLDQMIYHGKSVVRGVKRAMVVVDMPFGSYQGNEMEGLASAIRIMKESHADALKLEGGEEIIDTVKRILSAGIPVMGHLGLMPQSINKYGTYTVRAKDDAEAEKLIRDAHLLEEAGCFGLVLEKIPAALASRVASELTIPVIGIGAGGDVDGQVLVIQDMLGMNNGFRPRFLRRYADLYTVMTDAISHYVSDVKNCDFPNEKEQY

SEQ ID NO: 10194 - protein, 641 aa, Halobacterium sp. NRC-1
MSTVDRQLEELQDEIVSEIPADISVTDVKYEGPELVVYTRDPKQFAQDGDLVRRLASKLRKRITVRPDPAVLSSPKRARDRVLDVIPEEAGVTNLDFHEDTGEVVIEAEKPGMVIGRHGSTLREITQEAGWTPEVVRTPPIESSTVSNVRNFLKQERDERRDILETVGRQIHREEMQDDEYVRVTTLGCCREVGRASFVLSTPETRILVDCGDKPGSEDEVPYLQVQEALAGGANTIDAVILTHAHLDHSAFIPLLFKYGYDGPIYCTEPTRDLMGLLTLDYLDVAAKEGRAPPYDSEMVREAIKHCIPLEYGDVTDIAPDVKLTFHNAGHILGSAVSHFHIGDGLYNVAFSGDIHYDDTRLFNGAVNDFPRVETLVMESTYGGRNDYQTDQEDSERKLKRVINETYEDGGKVLIPAFAVGRSQEMMLVLEEAMREGEIPEMPIHLDGMIWEATAIHTTYPEYLRDDLRDRIFHSDSNPFLAPQFNHIDGGEEERQAVADDDQCIILSTSGMVSGGPIMSWLEHIAPDPDSTLTFVGYQAQGTLGRRIQSGRDKIPMPDSRSGGRTEHLQLNMGVETVDGFSGHADRQGLEDFVRTMNPRPEKVLCVHGDESSTQDLSSALYHEFNMRTFAPKNLETFRFV

SEQ ID NO: 10195 - protein, 325 aa, Methanosarcina acetivorans C2A
MGDKRSRIIKALKDAQKTPVSGEDLGLKLGISRTMVWKYIKSLQADGYEIESSPKRGYVLKSVPQLLYPDEIQMGLKTTLLGQKIHYFEEVSSTNSVAKEIAASEEEGSLVIAEVQKVGRGRMGREWISPHGGIWMSVILKPGIPLRHASRLTLVAGLAVANVIRDMGLDARIKWPNDVRINGKKVCGILTEAKAEVDRVDYVILGIGINVNMELKDIPESFRAGSTTLKVETGKHIRRVSFLQDLLFELEQQYIRFKTQPFSQILNDWLALSDTIGREVKVTTPSRIIEGKAVGVTPDGALIIRKSDDTKEEIIAGRCIYARPK

SEQ ID NO: 10196 - protein, 337 aa, Zea mays
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 10197 - protein, 141 aa, Nitrosomonas europaea ATCC 19718
MAVERTLSIIKPDAVAKNVIGQIYARFEAAGLKVVAARMAHLSRVEAENFYAIHRERPFFKDLVEFMISGPVMIQVLEGENAIARNRELMGATDPRKAEKGTIRADFAESIDANAVHGSDAPETAVVEIACFFPSLEIHSR

SEQ ID NO: 10198 - protein, 393 aa, Anthoceros formosae
MTMLAAKADPMTLSMGPHHPSMHGVLRLIVTLDGENVTDCEPILGYLHRGMEKIAENRTIVQYLPYVTRWDYLATMFTEAITVNAPEKLTNIQVPKRASYIRIIMLELSRIASHLLWLGPFMADIGAQTPFFYILREREMIYDLFEAATGMRMMHNFFRIGGVAVDLPYGWVDKCLDFCDYFSLKVDEYERLITYNSIFLKRVEGVGTISREEAINWGLSGLMLRASGVQWDLRKVDHYECYDELDWQVQSQTEGDSLARYLVRIGEMRESVKIIQQALKVIPGGPYENLEARRLNQGKDSEWNDFEYQFISKKPSPTFKLPKQEHYIRVEAPKGELGIYLIGDDSVFPWRWKIRPPGFINLQILPQLVKGMKLADIMTILGSIDIIMGEVDR

SEQ ID NO: 10199 - protein, 580 aa, Zea mays
MRPPAPKVPSAASSSSHSQREPRPENPLLLLPSSRFTKLSLGCPLLDRLLCGGLPAASVTEIAGESASGKTQLCLQLALLAPLSPLSASSLFLHSDLPFPLHRLRRLAPKSRPDILDHVLVAAAHSPTDLLSLLARAQRLLANPGRSPHRLPIRLILLDSIASLFRGDFDASPADLRRRSALFFQISAKLKELAYRHQCVVVVTNQVVDVVEGDAGNTVAWSSGRRLSPALGIAWANCVNTRLFLTREVEGNGTSGSARRWMKVAFAPHLPEQSCEFVIRRDGVFGVEPESPDSNFHVIHKFQFHNLWRDTLVMSLEVKNSLTGRIEVSAQNVWIGKGGAYTGEISAEQLVDIGCQWVILGHSERRHIIGENDEFIGKKAAYALSQNVKVIACIGELLEEREAGKTFDVCFRQKKAFADSISNWADVVIAYESVWAIVTGKVATPEQAQEVHAAALFKDKKPVKVIKKNSAAVTKFLDELAKIDFPGAKVVSEAVAKSGTSPLLPAITFILDKVAPFIPKEEPKAEPAAEATSREVAVEEKKEEARASCSDGGGTGAGRDTVGGGGGRGEEGRREEGRGG

SEQ ID NO: 10200 - protein, 354 aa, Aspergillus nidulans FGSC A4
MAASFVPRQAFPNYASIPRSYFLGHHRAGLNKMRNMLSSIDYVIECRDTRVPFTSVNPMFEEALGKTRRLIVYTKRDLGSEAGSREQKSLEKQIRSFNRGTPVFFVSPHHLDPRSKSRTNNRPDVNTILTHLREDAQGPDRLVGCRVMVVGMPNVGKSTLINNLRNRGVGKAKAVHTGDQPGITRKIGTPVKIIERDNGAHVYVLDTPGVFMPYVPDAENMLKLALCGCVKDSVISPVTLADYLLYHINLHDPTVYQRWSLPTNEVHPLLDSFARSTGLLAKGGIPNMDLAALHFIQKWRGGGLGRFILDDLQEERRRRESSDEDKASISITQALKAEKSARRQQATDPSVRQK

SEQ ID NO: 10201 - protein, 464 aa, Pyrococcus horikoshii OT3
MKALILAGGKGTRLWPLSREAMPKQFIKVFSDRSLFQKTVERALIFSKPKEIFVVTNKEYRFRVLDDLNELGLKVPEENILLEPVGKNTLPAIYWGLKVINDNYGDSVVAVLPSDHAIEVNESYMEAFKKAEKLAEKYLVTFGIKPTKPHTGYGYIKPGEKIEVEGKVLGYLVDEFKEKPDLETARKYVENGYYWNSGMFMFKVSVFMEEARKHSPDVVKAFEEGKSIEEIYELAPEISVDYGIMEKTNKAAVVPLNTYWNDLGSFDAVYEALEKDENGNAVHVTGFKAKYINVDSRNNLVLTERLTATVGVEDLVIIDTGDALLVAKRGETQKVKEVYKKLKEENDERAIVHRTAYRPWGSYTVLEEGERYKIKRLTVLPGKRLSLQIHYHRSEHWVVVRGTAKVKVGDKEFILRPGESTFIPAGVPHRLENPGKVILEVIETQIGEYLGEDDIVRLQDDYGR

SEQ ID NO: 10202 - protein, 390 aa, Rickettsiella grylli
MDHSFVFSIFVIFTGAAVLATIALYTHQSLLVAYILLGLILGPSCLKLVPNLSLARGIGDVGIIFLLFLVGLDLTPQEFYRSLRKTAIVTLVFSALFTTIGFAVGYLFSFTLLESLLIGASLIFSSTIIGLKLLPTLALHHKPIGETMISVLLLQDLLAIGMLLFVHGANMTGSKIADLGLTLITFPSLLAFAFVVQRYFISKLFIRFDRVQEYLFLVALGWCLGLAELSRALGLSAEIGAFLAGVSIAEGPIAVFIADNLKPLRDFCLIMFFFAIGASFDLRYLPEVFIPALLLAGLVLLIKPWLFQVLLQMSGEKKYIAREVGVRLGQASEFSLLIAYLAAETTPALIGGKANYLIQAVTILTFVGSSYWVVLRYPTPLALNEKMRVD

SEQ ID NO: 10203 - protein, 557 aa, Ustilago maydis 521
MSILLPTVHSSFEHLTPTHVAIASVLILGLLCLIAPDRYIFVSHRKGIKEVPGALPLIGNLLFLLDIAAKRRRFLDEFLRMQKSIGAGGMPWAATFPYLGGRVTSINRPEYIRWVQKTNFENYIKGSFFQKSMGDVMSLHGIFVADGEIWRKQRKMASHIFSVGNFRTHVQNTIHRDLAILNKLFRDASSKNTELNLPDLFFRFTLSSFSLMAFSADIKCLPSNVGDLSKVVEFAANFDYAQRVMDERFVDPLARFTELFSPQGRKMRRTIKELHSFCYEIIDLRLAARARGEAQAASGKGDKDLLALFMEQNLTRDELLPVVLNFLIAGRDTTAQALGWLFYELSKHPECIEKARQEIHEKLGSGSSFQSMAYDDLSSLVYVQACFLEALRLHPSVPKNIKLAVKDDVIRPYAQPCSDADVAPNAVPTTQKLPDLVIKKGETVTWQDHTMARMPELWGEDCEQFKPERFIEERKDGSIGIKTYSQYLFHAFNAGPRLCLGQTLATYEGCAVVAEILGNFDVVYDHKALKEDEPTYDDSLTLPIKNPYTIHVRARDD

SEQ ID NO: 10204 - protein, 369 aa, Oryza sativa
  misc_feature (17)..(17): Xaa can be any naturally occurring amino acid
  misc_feature (338)..(338): Xaa can be any naturally occurring amino acid
  unsure (1)..(369): unsure at all Xaa locations
SARACRRDRRAIISKEXEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAGDAFVGGFLSQLVQEKPIEECVRAGCYAAXCYHPKGLACTVPRRTPDFLLRCFSSVSCSPL

SEQ ID NO: 10205 - protein, 393 aa, Geobacillus stearothermophilus
MKLAKRVASLTPSATLAITEKAKELKAAGHDVIGLGAGEPDFNTPQHILDAAIKAMNEGHTKYTPSGGLPALKEEIIKKFARDQGLDYEPAEVIVCVGAKHALYTLFQVLLDEGDEVIIPTPYWVSYPEQVKLAGGVPVYVEGLEQNHFKITPEQLKQAITPRTKAVIINSPSNPTGMIYTAEELKALGEVCLAHGVLIVSDEIYEKLTYGGAKHVSIAELSPELKAQTVIINGVSKSHSMTGWRIGYAAGPKDIIKAMTDLASHSTSNPTSIAQYAAIAAYSGPQEPVEQMRQAFEQRLNIIYDKLVQIPGFTCVKPQGAFYLFPNAREAAAMAGCRTVDEFVAALLEEAKVALVPGSGFGAPDNVRLSYATSLDALETAVERIHRFMEARA

SEQ ID NO: 10206 - protein, 471 aa, Burkholderia thailandensis E264
MSKTVADVMQLAKDEDVKFVDFRFTDTRGKEQHVSVPVSAFGEDKFESGHAFDGSSIAGWKGIEASDMLLMPDPNAAFIDPFYEESTLVLTCDVVEPADGKGYERDPRSLAKRAEAYLKSTGIGDTAYFGPEPEFFIFDSVQWNTDMSGCFVKINSEEAPWSSAKEFEGGNTGHRPGVKGGYFPVAPVDQFQDMRSEMCLLLEQIGIPVEVHHHEVAGQGQNEIGTKFSTLLQRADWTQWSKYIIHNVAHSYGKTATFMPKPVVGDNGSGMHVHQSIWKDGQNLFAGNGYAGLSETALFYIGGIIKHARALNAITNPTTNSYKRLVPHFEAPVKLAYSARNRSASIRIPHVSNPKGRRIETRFPDPMANPYLCFSALMMAGLDGIQNKIHPGEAADKNLYDLPPEEDAKIPTVCAGLDQALEALDKDREFLTRGGVFTDAMIDAYLGLKEQELAKFRMTTHPIEFEMYYSL

SEQ ID NO: 10207 - protein, 493 aa, Picrophilus torridus DSM 9790
MKIYIDGEWRDSSSGETIKKYNPSTGEVLDTFPAATRNDVDAAIDSAEDAFKRWSDMTSMERSKILYKALELISKDKDQLTDLLIKENGKVKREAMDETEGVIDQLQYYTEFERKLTGDIVEGTSNKRKIFQYKVPYGIVIAITPWNFPAAMVIRKLAPALLTGNTVILKPSSDTPLTAEWLVKKFVDAGIPKGVLNLITGKGSEIGDYIVEHKKVSLITMTGSTSTGQRIMEKASKNMAKLILELGGKAPFMVWKDANIERALKSLVWAKYLNVGQSCIAAERLYIHEDIYDEFMKKFIEVSKRIKLGDPESSDMGPLINKSAVETTEKYVDIARSSGYKILLGGKKPELSGKYKNGYFYEPTIIENVPQDSPLFQEEIFGPVIGAESVSSVDELYEKANDSKYGLASYLFTEDPELIFEASEKIRFGELYVNMPGPEASQGYHTGFRLTGQAGEGSKYGISEYLKLKNVYVDYSRGNLSISTVNDDLFKNL

SEQ ID NO: 10208 - protein, 835 aa, Saccharomyces cerevisiae
MGEEHKPLLDASGVDPREEDKTATAILRRKKKDNMLLVDDAINDDNSVIAINSNTMDKLELFRGDTVLVKGKKRKDTVLIVLIDDELEDGACRINRVVRNNLRIRLGDLVTIHPCPDIKYATRISVLPIADTIEGITGNLFDVFLKPYFVEAYRPVRKGDHFVVRGGMRQVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLEALAAETHGYVGADIASLCSEAAMQQIREKMDLIDLDEDEIDAEVLDSLGVTMDNFRFALGNSNPSALRETVVESVNVTWDDVGGLDEIKEELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDENARLSILNAQLRKTPLEPGLELTAIAKATQGFSGADLLYIVQRAAKYAIKDSIEAHRQHEAEKEVKVEGEDVEMTDEGAKAEQEPEVDPVPYITKEHFAEAMKTAKRSVSDAELRRYEAYSQQMKASRGQFSNFNFNDAPLGTTATDNANSNNSAPSGAGAAFGSNAEEDDDLYS

SEQ ID NO: 10209 - protein, 111 aa, Zea mays
  misc_feature (51)..(51): Xaa can be any naturally occurring amino acid
  unsure (1)..(111): unsure at all Xaa locations
ARRGRVAEKNYPDLTSTTFFHSRWNYIISGPAKAMGRKAKRAVTTGRKIIXGTNPLASEPGTIRGDFDVHIGRNVIHGSDSLERATEEIALWIPEGPADWQSSQHPWIYEK

SEQ ID NO: 10210 - protein, 555 aa, Picrophilus torridus DSM 9790
MSRTKLIATIGPASESMEIIKKMANLGLSCIRINTAHIENGYITKVAKMVDDVNKSEGTYIGLMVDLKGPELRTGKFKDGSFKIDYNKKYKISYNKNDNPDILINYNISDFIDDKTLIAMSDGKLRFSVDSVNGDIINVTSLDSGSLRDNSRVNVPGKLLRLGSLTDRDRMFIEEGIKNNVNFYALSFVQSRENINELQDYLFERNCDAQLISKIETKSGYDNIDEIARASDFIMVARGDLGVEMPLKEVTIAQKKIIDESRKYATPTIVATQMLESMVNNDSPTRAEVSDITNAIIDGTDALMLSEETAIGRYPVEAIGYLSSISDYVDSMEIKYKEPESFAFDKVAFAISKGLKMISDYTNVDSIVAFTRSGFTARLVSSMRPGKMIYSVVSSDFLARSLNLLKSVVPVKIDESMKSKEIYDILVDINRSNKIRPGKKVLVVSGSPYFVFGGTNEIRLVTMGKFIGRGYPVGNSFSGYYEPDGSGDIIILDKYIKNFDYKKYKCVIIKGNVSDTIKNLFYENKILLLYNTEFDAELNEKTFLNIDGDTGIITA

SEQ ID NO: 10211 - protein, 458 aa, Bacillus cereus ATCC 14579
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 10212 - protein, 88 aa, Zea mays
  misc_feature (7)..(7): Xaa can be any naturally occurring amino acid
  misc_feature (14)..(14): Xaa can be any naturally occurring amino acid
  misc_feature (22)..(22): Xaa can be any naturally occurring amino acid
  misc_feature (49)..(49): Xaa can be any naturally occurring amino acid
  unsure (1)..(88): unsure at all Xaa locations
SGREWPXWGCEKSXFLWTYSAXETCYLLQGKVKVYPEGHGEEFVEIVAXDLVVFPKAMTCTWDVPRGRSQPLQLYSIRRRPTTAYVIL

SEQ ID NO: 10213 - protein, 343 aa, Thermus thermophilus HB27
MRALAKLAPEEGLTLVDRPVPEPGPGEILVRVEAASICGTDLHIWKWDAWARGRIRPPLVTGHEFSGVVEAVGPGVKRPQVGDHVSLESHVVCHACPACRTGNYHVCLNTKILGVDRDGGFAEYVVVPAENAWVNPKDLPFEVAAILEPFGNAVHTVYAGSGVSGKSVLITGAGPIGLMAAMVARASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLITHRLPLSRYREAFGLLASGQAVKVILDPKA

SEQ ID NO: 10214 - protein, 140 aa, Rickettsia typhi str. Wilmington
MTIQYTFSMIKPDVIKRNKIGQVNTYLENAGLKIVAQKMKFLTKYEAECFYDEHRARPFFNSLVEYITSGAVVLQVLKGEDAITLNRIIMGATNPAEAKEGTIRKDLGESIEANSIHGSDSENSAKREIKFFFSKSEIIE

SEQ ID NO: 10215 - protein, 183 aa, Brassica napus
MAEVLRPEMLDISNDTSSLASPELLHVLAVDDSIVDRKFIERLLRVSSCKVTVVDSATRALQYLGLDGDNSSVGFQDLKINLIMTDYSMPGMTGYELLKKIKESSAFREIPVVIMSSENILPRIDRCLEEGAEDFLLKPVKLADVKRLRDSLMKAEERVFKNIMHKRELEANDIYSQLKRAKI

SEQ ID NO: 10216 - protein, 245 aa, Enterococcus hirae
MNKNIKYSQNFLTNEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 10217 - protein, 152 aa, Debaryomyces hansenii CBS767
MSNNERTFIAIKPDGVQRGLINSILGRFENRGYKLVGIKLVQPTESLLREHYDDLQSKPFFPSLLSYMLSGPVLATVWEGKDVVKQGRAILGATNPLQSAPGTIRGDFAVDMGRNVCHGSDSVESAEKEIGLWFKKEELVDYKPALFGWIYE

SEQ ID NO: 10218 - protein, 551 aa, Zea mays
  misc_feature (359)..(359): Xaa can be any naturally occurring amino acid
  unsure (1)..(551): unsure at all Xaa locations
MAPAAAAAEAAGPSPRRRLAAAVLALALALACVLAQAAARPDKETREKFYGTLVANGTHNASGDGSIAEMFGRVLDKEFSDSDTPDAPDKSSFNNSVSDHQAVLETVAVITHDKKKNDSQHTNSPKPFQIGDMFGGQDETSDDLETVIDKEDNVFVMSNRKTKYPTLQLDLRLIKDLVIIIVSATGGGIMFSFMGQPVIVGYLLAGSLVGPGGLNFINEMVQVETFAQFGVVFLLFALGLEFSLTKLKVVGPVAVLGGLLQIVLFMFLCGLTAALCGAKSSEGVFVGAFLSMSSTAVVSKFLVEKGSTNTLHGQVTIGTLILQDCAVGLLAIRICSCYIYDDMVNCSSILKTDDSVIFXTNELYQLASVAFCLLLAWCSDYCGLSLELGSFLAGVMISTTDFAHHTMEQVEAIRNLFAALFLASIGMLIHVKFLWNHVDILLAAVILVIIVKSIVVAIVVKAFGYSMRTAFFAFVLLSRASHLHLVGGKMYLLLLGTTALSLVTTPLIFKLIPVVMHLGILMRWFPSENSMQSELPLQEKAVMLEAHNRSL

SEQ ID NO: 10219 - protein, 493 aa, Zea mays
MSADASAAMEKIRAAGLLKTQGLIAGQWVDAYDGKTIEVQNPATGEVLANVSFMGSRETSDAIASAHSTFYSWSKLTASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 10220 - protein, 326 aa, Bacillus anthracis str. 'Ames Ancestor'
MQSTIRKQLLQVFSEADGEFVSGQTISDKLGCSRTAVWKHMEDLRNEGYELEAVRRLGYRIASKPDKVTANEIQLGLQTKHIGRTVYFEESVESTQHIAAKLAYEGAEEGTIVVAEEQTAGRGRLSRKWHSPKGTGIWMSIILRPSIPVHHAPQLTLLAAVSVAQAIEKCTGVNVGIKWPNDILIQGKKAVGILTEMQADPDKINAVIMGIGINANQKQEHFDEEIQHIATSLAIESGKPIVRAELMQQIFLQLEKLYEEYLQNGFSVIKILWESYAVSIGKEINARTMRETITGVAKGITEDGVLLLEDHEGKVHHIHSADIEIK

SEQ ID NO: 10221 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAAITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 10222 - protein, 510 aa, Vibrio vulnificus YJ016
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 10223 - protein, 256 aa, Wigglesworthia glossinidia endosymbiont of Glossina brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 10224 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 10225 - protein, 335 aa, Moorella thermoacetica ATCC 39073
MAIKVGINGFGRIGRLVFRASLEKPELEVVAINDITDVKTNAHLLKYDSVHGRLNATVEAREGAMVVNGREIKVLAERDPAKLPWKDLGVDIVIESTGVFTDATKAAAHRQAGAKKVIITAPAKNEDITIVMGVNNDKYNPAQHHIVSNASCTTNCLAPIAKVLHDNFTIKRGLMTTAHSYTNDQRILDLTHKDLRRARAGALSIIPTTTGAAKAIGLVLPELKGKLNGMAMRVPTPNVSVVDLVAELEKPATVESINAAMKAAAEGPMKGILGYCEEPLVSRDFNGDPRSSIVDALSTMVIDGTLAKVVSWYDNEWAYSKRVVDLAAFMAAKGL

SEQ ID NO: 10226 - protein, 224 aa, Methanopyrus kandleri AV19
MRTVRRALRRGEPVFIFDSEDREGETDMVFWAPEVTPDHVAELRRTAGGLICVVIHPEHAREIRLPFLVDVYERADHPLLRATWPDDIPYDERSTFSITVNHRDTFTGVTDEDRALTVRKLAEFFTRNHEDPVREFGEEFRSPGHVHLLRPFDGLLEERRGHTELTATLLELVGLEPKVAVICEMLEPGGGALPREEAERVARERGAPFLTGEDILKAWKGGER

SEQ ID NO: 10227 - protein, 446 aa, Staphylococcus epidermidis RP62A
MPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 10228 - protein, 251 aa, Neisseria meningitidis Z2491
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 10229 - protein, 249 aa, Moorella thermoacetica ATCC 39073
MRRPIIAGNWKMHNTTEEARDLVTLLRPLVGTARAEVVVCPPFTAIAATVNAASGSNISVGAQDLFWEDKGAYTGEVSGPMLRDLGCRYVIIGHSERRQYFGETDATVNKKLLAAYRNELLPIVCVGETLAEREAGHTLEVVGRQVREGLKGLETGQARDLVVAYEPVWAIGTGKTATAADAQEVIAFIRKTLGEMYGETAAAIRIQYGGSVKPENIAELMAQPDIDGALVGGASLDAVSFAAIVNYDQ

SEQ ID NO: 10230 - protein, 513 aa, Moorella thermoacetica ATCC 39073
MAIAVNRPLMLMILDGFGLGPEGEGNAISQGRLPNYRRLLAGYPHTRLRASGEAVGLPAGQMGNSEVGHLNIGAGRIVYQELTRISKAIRDGSFFSNAALVGAVRAAREHGGALHLMGLVSDGGVHSHLDHLYALLDLAKREGLERVYIHAFLDGRDVPPASAAGYLEQVEDECRQKGIGAIATIMGRYYAMDRDRRWERTARAYRALVAGEGHQASSPSEAIRASYERDITDEFVEPAVITRDGRPLATVREGDSVVFFNFRADRARQLTRAFVDRDFDAFERPGGRLDIQFVCLTQYDVTIPAPVAFPPQVLQNVLGEVIAGAGLKQLRIAETEKYAHVTFFFNGGVEEPFPGEDRLLIPSPKVATYDQKPSMSAREVTDAVLERLDKYDFIVLNFANPDMVGHTGDLAAAIAAVETVDECIGRIVQAMAERRAPLLLTADHGNAEEMREPDGEPHTAHTSNLVPFILVDDRYRGASLREGALEDVAPTVLDILHIQQPAEMTGKSLIVKG

SEQ ID NO: 10231 - protein, 270 aa, endosymbiont of Riftia pachyptila
VLAIEKLLGVEVPLRAQYIRTMFDEITRILNHLMWLGTHALDVGAMTVFLYAFREREDLMDCYEPVSGARMHAAYYRPGGVYRDLPDQMPQYQQSQWTTGRDVGRRNEARQGSLLDFIGDFADRFPALVDEYETLLTDNRIWKQRTVGIGVVSPERALQLGFTGPMLRGSGVEWDLRKKQSYAAYDKVDFDIPVGVTGDSYDRYLVRIEELRQSNRIIKQCVEWLRNNPGPVMVDDHKIAPPSRSDMKGDMEGLMPPLQAIQRRLLPTSR

SEQ ID NO: 10232 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 10233 - protein, 548 aa, Listeria monocytogenes
MTKFAQKTIYQVYPKSFYDTTGDGTGDIPGITAKLDYLQKLGIEMIWLNPFYPSPQNDNGYDIADYTAVDPLFGTMDDVTTLIKEAKKRNIGIMIDLVLNHTSTEHPWFKKALAGDPFYRDFYYFRPAKADGSPPTNWVSKFGGNAWEKLPDSSEYYLHLYDVTQADLDWANPNVREALFAVVNFWIDKGVEGFRLDVLNVIAKPKFLEDDFEGDGRRFYTDGPGIHAYLKELHERTFGDKPIITVGEMSSTDIDNCIRYSNPDEKELSMVFHFHHLKVDYPDGEKWRLADVNFENLKSIFHTWQVAMSDENGWDALFWNNHDQPRALGRFASDKPEHYYHSATLLGATIHFMRGTPFVYMGEEIGMMNPKFPTIDDYVDVETLNHFDILQKNGLSEQEVMEIIKERSRDNSRTPMQWDDSQNAGFTTGTPWLKVADNANEINVQTALSNKTSIFYFYQKLIALRKEHPVIQTGDYTPYLTEEDSIIAYKRSNETTSLLSIHHFGSEKKKIQLPTEFLNAEVLLSNYERQRISSELELAPYETLTLIQ

SEQ ID NO: 10234 - protein, 405 aa, Halobacterium sp. NRC-1
MGPMETYVVTEPALVERLLVSDAAEFRKPEFQADAIDDLLGDGLLLSEGESWREQRGRANPAFSMARVAGFDADIAAHAADRVDDWPVGDTVDVEAAMTHITLDVILDVMLGVSLPEARVDAIGDALEPVGARFEPDPVRFAVPEWLPMPDDREYAAAVATLDDLVDDIVAAREGTASGGDGDDPMDLLSVLLRARDRGEQSLDRLRDEVMTTLLAGHDTTALTLTYTWFLLSEHPDVEARLHAELDGALDDGAQPTVAQLQDLDYLEWVLQESMRLYPPVYNVFRTPIEPVELAGSEVPAGAPIMLPQWAIHRSPDHWDDPEAFDPERWRPERRADRPRFAYFPFGGGPRHCIGKQLALLEAKLIVATVASDYRLRYEGDTPLSFVPSLTIHPEQEMRMRVEPR

SEQ ID NO: 10235 - protein, 557 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKVDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 10236 - protein, 267 aa, Zea mays
  misc_feature (242)..(242): Xaa can be any naturally occurring amino acid
  unsure (1)..(267): unsure at all Xaa locations
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEVVLAACYKALNDQHVLLEGTLLKPNMVTPGSDSKKVAPEXVIAEYTVRTLQRTVPAAVPAIVFLS

SEQ ID NO: 10237 - protein, 484 aa, Bacillus licheniformis ATCC 14580
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 10238 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 10239 - protein, 1034 aa, Flaveria pringlei
MERARRLAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFASGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 10240 - protein, 247 aa, Thermobifida fusca YX
MSTLVLLRHGESVWNAEGLFTGWVDVDLSPKGEEEARRGGRLLAEAGIRPDVVHTSLLKRAIRTANIALEEAGLHWIPVKRSWRLNERHYGALQGKNKAQTRAEFGDEQFMIWRRSYDTPPPPLAEDSEFSQHNDPRYATLPPELMPRTECLADVVRRMLPYWYDAIIPDLAAGRTVLVAAHGNSLRALVKHLDNIDDKSIAGLNIPTGIPLVYELNDDFTPRKTGGEYLDPEAAKEAIEAVKNQGK

SEQ ID NO: 10241 - protein, 235 aa, Flavobacteria bacterium BBFL7
MQIVKLHATTSTNDELKVRFRESETSHLMTIYSHSQTKGRGNRGSTWLSDSGKNLTFSVLVSDGIENLSPFQLNQIVSVAMVDWLTTDLNIQAKIKWPNDILSVQMKLAGILIENIYQNGHWSHSIVGIGLNVNQEEFKDLPRAISLKNLTGKTFKLEELLLQFLFHLDRALKNKEHTIGKYLNYLFKYRQRMNFEIEGKALIATVYGVTESGELLLEKEGQITAYDLKQVRWNY

SEQ ID NO: 10242 - protein, 655 aa, Arabidopsis thaliana
MSKCLENFLRQAFEDNSLAGAIGLGGSGGTSLISSAFRSLPIGIPKVIVSTVASGQTEPYVGTSDLVLIPSLVDVCGINSVSRVVFSNAGASFAGMVVGRLELFRSSPSDNGKCTVGITMFGVTTPCVNAVQEILTREGYETLVFHATGVGGRAMESLVKEGFIQGVMDITTTEVADHLVGGVMACDSSRFDITIEKGIPLVLSVGALDMVNFGGKDTIPSHFQTRKIHVHNEQVSLIRTTAEENKKFARFIADKLNKSTSKVRVCIPEKGLSALDAPGKPFCDPEATGALINELQGLIQTNDDRQVNIYSHHINDPEFAEALVASFLEICPKTYAQIKPSETTSTKPSTGEHDDGHVRSRLERIPYSPKEFPNAKPETLERTQAILGRLRDQIEKGIPIIGGGAGTGISAKFEEAGGIDLIVIYNSGRFRMAGRGSLAGLLPFADANAVVLEMANEVLPVVKAVPVLAGVCATDPFRRMDYFLKQLESIGFVGVQNFPTVGLFDGNFRQNLEETGMGYGLEVKMISEAHKMGLLTTPYAFNPKEGEEMAKAGADIIVAHMGLTTSGNIGAKTAVSVEESVVRVQAIADAARRFNPDIIVLCHGGPISGPEEAEFVLKRTQGCVHGFYGASSMERLPVEQAITNTVQKYKSISIK

SEQ ID NO: 10243 - protein, 392 aa, Carboxydothermus hydrogenoformans Z-2901
MFSERALQIGESPTLAIDKKAKELIKQGKKVINFGVGEPDFDTPEYIKEAAINALRQGKTKYTPVGGIPELRKKIAEYLTQRTGVNYEDQEVVVTCGAKHGLYNIFQVILNPGDEVIIPVPYWVSYVEQVKLAGGVPILVPTGENFKLAPDKLINYLNNRTKAIIINSPSNPTGVVYSFDELKSLGRLLKDREILIIADEIYERIYFSEKPISFVAANPELKEKTFIVNGFSKSHSMTGWRLGYVAASRQYAAKLIELQSHQTSNPTSFAQWGALAALTIEDDSVEKMVQEFKKRRDFVVSRLQELKLKVIEPAGAFYVFPRIDNCFGKKHSGKIINTSIDFAEIMLEYYLVAMVPGIAFGDDRFVRLSYALSLADLKEGLKRLETFLKNLE

SEQ ID NO: 10244 - protein, 281 aa, Lactococcus lactis subsp. lactis Il1403
MTLTDTYTLNNGIKIPKVGFGTWQSASGEEAYNAVKAALEAGYRHIDTAAVYKNEESVGQAIADSGIPREELFVTTKLWGVGTTEDAAKALDESLKKLGLDYVDLYLIHWPNPKAFRPDFETRNLAVWKAMEAGVKAGKIRAIGVSNFHPRHLKPLLKFAEIKPAVNQIMVNPSDQQEEIVSFNVDNNILTEAYSPLGTGKIFEVPELADLASKYNKSIAQVVLRWSLHKGYLPLPKSVTPARIKENAEIFDFDLSIEDIAFIDSLHGKAGLAKNPDEVDF

SEQ ID NO: 10245 - protein, 480 aa, Zymomonas mobilis subsp. mobilis ZM4
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAAGYAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKISNRTKEAAQDGWKALAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 10246 - protein, 222 aa, Zea mays
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCQWESVQAPWLIE

SEQ ID NO: 10247 - protein, 284 aa, Xanthomonas axonopodis pv. citri str. 306
MNTPASSSPSSSATTSIAFVGGGNMARSLIAGLIRQGTPAASIRVAEPVADLRAALARDFGVQVVEDARAAVDATTTWVLAVKPQVLPMVCAQLADLAQAQQPLLVSIAAGITATQLQRWSGGDIAVVRAMPNTPALLGAGVTGLYANARVSAAQRQQATQLLDSAGVTVWIDDEAQMDAVTAVSGSGPAYVFLLAEAMEAAAQAQGLPAAAARTLVLQTLLGAARMLTESGEAPEVLRRRVTSPNGTTHAAIETFQAGGFEALTAQAIAAATERGRSLSAAND

SEQ ID NO: 10248 - protein, 411 aa, Nostoc sp. PCC 7120
MGLGINLFGHNPPFIQTAISEQLQQGMHIGVQNTLAGEVAQLISELTGAERVTFSNTGTEAVMTAVRIARAATKRPKIAIFTNSYHGHFDSVLVRATMTEYAKKAARRIIAAKSGSFIGRLAQPIQALFTANLNPKAVPAAPGIPNSAAADVLILEYGNEHSLKLIRKHRRELAAVLVEPVQSRCPELQPREFLQQLRQITQELGIVLIFDEMVTGFRIHPGGAQAHFGVKADIATYSKIVGGGLPLSVIAGKASYMNYIDGGQWQFGDDSTPQVPTTFFAGTFCKHPLALAAARATLQHLKISGIELHNELNQRTTQLVNDLNTHMTQQGIAIKFTSFGSFFAVAASQSAVPPMAINLLSYHLITKGIHLRQGDKGGFLSTAHTEEDINLIKKAFIDSINELRNEGFINN

SEQ ID NO: 10249 - protein, 647 aa, Saccharomyces cerevisiae
MEAGRSADEVLYHNQSSVKLGELERYVITYELYQGDSIPADITLDSLWVKIKNTTKLSYKPAYLLGPFILYCDVRAKDYESSYKIICSADKPVFQSNLQAQQKFIAELSLHHIKPRYVWIVDIVSQILFNKETKVTFEIVVGNSKASLKRKIRCNDSLPDKACNILHTGLSVHRLTTADIWKVPRPIDMSQKSHLVILTHGFQSNVSADMEYLMEEIYKAQMNNPNERLVIKGYMKNACETEKGIKFLGVGLANYIIDELYDDSVGKISFIGHSLGGLTQTFAICYIKTKYPYFFKKVEPINFISLASPLLGIATSTPNYVKMSLSMGIIGTTGQELGLKDGNYGDKPLLYLLSEESLISVLARFKRRTLYANAVNDGIVPLYSSSLLFLDYSQLLQKLGGQTTAPCDPLFQPEVSPIGELPNHSDVANDDDGINASSWNTFWKSKENNCDKKSKRLMNASVIKSMKSVLLSPCPDAKFFSDPDARVATIIHDKIYTEKNLPPPSPTLYEGTAAKEGETRKTRKEMEEIIARRWHKGMHWRKVVVLLKPDAHNNIIVRRRFSNAYGWPVVDHLVTAHFQRDDPIASPMQDKQFAEEDINMATGGVEPNKFYSWLTKIEDPSVYHGGIVSTASQLASSWISKHSSVTD

SEQ ID NO: 10250 - protein, 583 aa, Aspergillus nidulans FGSC A4
MEEQYAALASKITSLATSHQKPRYLVAVAGAPGSGKTTLATAVAAQINRSGLLSHKSTNQSDDNSQTNEIAKRALVLSMDGFHLPRSELDTLPNKERTEAYVRRGAPWTFDIPAFLEFMRTLRLWADSGSPSSSSEETAGVLYAPTFSHSTKDPIPNSIVIDHTTSIVIIEGNYLLLDKPQWRDIAPLVDYRVFVDVDLAEARERLAQRHVEAGIEQTLEEGFLRVDRNDAINGALVKGHVVDGVDIVLRKKETNPSFVLRAVKDVAFEDRVIPPLKDPWDVRVQVAQTGICGSDVHYWQRGRIGDFILESPIVLGHESSGIVTEIGSAVKNLKVGQKVAIEPGVPCRHCDYCRSGSYNLCPDTVFAATPPHDGTLQKYYITQADYCYPLPYHMGLEEGAMVEPVAVAVQITKVGNVRPNQTVVVFGCGPIGLLCQAVSKAYACKKVIGVDISQSRLDFAQAFGADGVFLPPPRPEGVEETAWSEKVAALIKEKFGLGEGPDVVLEATGAQSCIQTGVHLVKKGGTYVQAGMGKENVVFPITTACIRDLTIRGSIRYSTGCYPVAVDLIASGKIDVRAGGGGL

SEQ ID NO: 10251 - protein, 444 aa, Bacillus cereus
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEFEWDIFRTQVHQWERDQYMSLY

SEQ ID NO: 10252 - protein, 499 aa, Cryptococcus neoformans var. neoformans JEC21
MSIVVSLPVLCTPPHTHDGPGPVLEETGPHLLQAAPPAGPRRLLRPHLHRRQRPQPPPARRRQAQEQRTRPPPPRPRLAPQPCARPQQRPARQNTPPSPAAVPTTQNIIAAPSQPSKSFLASSPPPPSAMPVSPAGTTRARSSSPPPSSSPAAASHLSRDSASSLSPGFALTQTVSRGSLGAGGAGFQILDVDNMIQRLLEAGYSGKVTKSPPLKNAEITSVCAAAREVFLSQPTLIELSPPVKIVGDVHGQYADLLRMFEMCGFPPAANYLFLGDYVDRGKQSLETILLLLCYKIKYPENFFLLRGNHECANVTRVYGFYDECKRRTNIKIWKTFIDVFNTLPIASIVASKIFCVHGGLSPSLKSMDDIRRIQRPTDVPDYGLLNDLVWSDPSDTALDWEDNERGVSFCYGKSVINAFLATHDMDLICRAHMVVEDGYEFYNDRTLVTVFSAPNYCGEFDNFGAVMSVSEDLLCSFELLKPLDGAALKKEMTKSKRKS

SEQ ID NO: 10253 - protein, 365 aa, Mycobacterium marinum
MKTTDVRVRRAITAIAAGRPVVVTHDHAAQGYLVFAAEAATSSLVAFTVRHTAGYVRVALPGAECARLNLPPMCHHNPTHRVSVDVRATGTGISARDRARTIAALASAGSQAADFLRPGHVAPLLAEPHGVLAKCEPAEAAVDLARLAGHRPAAALCEIVSRRNPTLMAHGAELVEFAVEHGLAVVSIAELLAYRQRTEPQVIRLTETTLPTWAGNSRVIGFRDLGPANPGGEHLAVIIGAPDSGVPVALHVHIECLTGDVFGSTGCRCGGELNGALSAMSAQGSGVVLYLRPPGPPRACGLFASDEETPADFMSETVTWMLRDLGVYAIKLSDDMPGFGLVMFGAIREAGAAAGPADTPLAAAG

SEQ ID NO: 10254 - protein, 322 aa, Deinococcus radiodurans
PVPLPPVGGCPVTLWRMPARLLPLLTDRPQSGDDLGRALDLGRVTVNTLARRLQEDGVPVLISRAGYALEPGTPAPGLVPLRGQFGRALRYQGTVTSTQDEVRFWADSERGPAPHGAVVVAERQTAGRGRRGRVWDTTHGTLAFSVLLREALSLADLVRMPLAAGVALHAACTALGVPCGLKWPNDLLTPDGRKLAGILLEADLRGEEARRAVLGIGINVGTAPEGAAHLHESVPDLTRAAVLGEVLFQLEHWLAQPAPAIIATWKATSLTLGRPVRVTTARGTVEGVARDLDEQGNLLVETAAGLETVSAGDVQLVGQLKT

SEQ ID NO: 10255 - protein, 234 aa, Nitrosomonas europaea ATCC 19718
MNEIQEPIRLVLLRHGQSIWNQDRHFTGWGDIVLSPQGEQEALRAGHLLKQAGFTFDACFCSELQRASDTLAIVQSVMGLNHLSTYRTWRLNERHYGALEGMRPWAAIRKFGIWSTMKSQIRFDAAPPLLMPDDPRAPVNQPRYAAVDRTQLPLAESMQQTLERVRPLWQETILPEIRQGKRLLIVSHQNLLKTLVMQLEGLTGAQIMRLSITTGHPLCYELDHSLVPVKRYYL

SEQ ID NO: 10256 - protein, 334 aa, Arabidopsis thaliana
MRSYRFSDYLHMSVSFSNDMDLFCGEDSGVFSGESTVDFSSSEVDSWPGDSIACFIEDERTFVPGHDYLSRFQTRSLDASAREDSVAWILKVQAYYNFQPLSAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDLRVPFSGSLSPMLQSILSNIKEASFLEYWPSSIAAAAILCVANELPSLSSVVNPHESPETWCDGLSKEKIVRCYRLMKAMAIENNRLNTPKVIAKLRVSVRASSTLTRPSDESSSPCKRRKLSGYSWVGDETSTSN

SEQ ID NO: 10257 - protein, 283 aa, Pyrococcus horikoshii OT3
MREITPKRIREMKGKEKITMITAYDYPSALLADKAGFDIVFIGDSLGMVVYGEPSTLNVTMEQMIFHTRAVAKAVKRALVLADMPFGSYEVSVEEGIKNAIKLVQAGADAVKIEGGYDHRKLVKKLVRIGIPVMGHTGLTPQRYLRLGGYRIMGGTEEEVEEILRDAKALEKAGAFAIVLEFVLADVAKLVTEEVSIPTIGIGSGPYVDGQVLVWHDVLGLYESSPPFAKRYANLKEEILRAISTFREEVKEGKFPGREHYWEFQDKEEFKRIKDNVMKKLNL

SEQ ID NO: 10258 - protein, 396 aa, Flavobacteria bacterium BBFL7
MPAISHKGAIMPSSPVRKLVPFAEAAKKRGIHIYPLNIGQPDIKTPNQAIQAVKDTDMEILAYSHSAGNESYRTKLATHYNKLDMGLTVDDIIVSTGGSEALLFTMGSICDYGDEVIIPEPFYANYNGFATASGVTVKPISTNIENNFSLPSISDFEKLITDKTKAILICNPGNPTGYLYTQDEMNQLAALVKKHDLFLVADEVYREFAYDGRKHLSVMNMTGLEQHAIMIDSVSKRYSMCGARIGCMVSKNKEVMATAMKFAQARLSPPTFAQIAAEAALDTPQAYFDEVIGEYIERRNILIEGLKNIPGVQVANPGGAFYCVAQLPVDDTDAFAQWMLESFELDNETIMVAPAAGFYSSPGVGKNQIRIAYVLEKESLIKAVQILAEALKVYQA

SEQ ID NO: 10259 - protein, 323 aa, Methanosarcina barkeri str. fusaro
MKIVVSDSIFLPEEYRKKLDALGDLKVFESMPSSIEEFISRVRDADIVLVGRYGFSGKAFNASRNLQMLSVWQTGYDHIDLKAATEKGVIVSNVPDYAFDSVAEMVFALALNLLRKVHVADIRLREGNFDWRHYFGSQIMGKTMGVIGTGSIGSRVIQIAHGFNMNVISVTGHPSEEKARSLGVKFVDLDTLLAEADIVTLHVPLTPSTEKMIGAKELAKMKKSAILINTARGKVVDEAALIEALKEKKIRGAGLDVFEKEPLPANDPLKALENVVLTPHIAFLTEESLEECTYVCVQNVERFIEGKPQNIVNPEVLTILRLP

SEQ ID NO: 10260 - protein, 525 aa, Methanosarcina barkeri str. fusaro
MTQARRPLMLIIFDGWGYREAKEGNAVMTARTPNLDRLEKECPWCFLKASGEAVGLPKGMMGNSEVGHLTIGAGRIVNQDLTRINISIKNGDFFKNPVFLNAISNVKANASSLHLMGLASCGGIHSYMPHLHALLKLVQEKDLKKVYIHAFLDGRDEPPKAALGDIKKLDAFCKEHGNAKIATVSGRYYAMDRDKRWDRTKLAYDALTRGVAPYTAPNAETAVSNAYSRGETDEFVKPTIITEQVITEQVITEQAEKPVATVQDNDSVIFFNFRADRARQITWAFVKDDFDGFMREKRPEVYFVCMTQYDETLEVPIAFPPIKLENVLGEVLSKHGLIQLRIAETEKYAHVTYFLNGGEEKRYKDEDRCLIPSPKIATYDLKPEMSAYEITDEVIRRIQSGKYDVIVLNFANMDMVGHTGIFEAAVKAVEAVDKCIGRIVEVLKEKGGVALITADHGNAEEMIDLKTGEPHTAHTSNPVKCIYFGNSEIKALRNGKLCDVAPTILELLGIPKPQEMTGKSLLVKD

SEQ ID NO: 10261 - protein, 1140 aa, Schizosaccharomyces pombe
MTTELTNVSLEEAITEKTSENRRKRDSDVLQTEEVDLSNVKRIRASRNQDNRPERQSRLQRSSSLIEQVRGNEDGENDVLNQTRETNSNFDNRVGVIECIHLVNFMCHDSLKINFGPRINFVIGHNGSGKSAILTGLTICLGAKASNTNRAPNMKSLVKQGKNYARISVTISNRGFEAYQPEIYGKSITIERTIRREGSSEYRLRSFNGTVISTKRDELDNICDHMGLQIDNPMNILTQDTARQFLGNSSPKEKYQLFMKGIQLKQLEENYSLIEQSLINTKNVLGNKKTGVSYLAKKEEEYKLLWEQSRETENLHNLLEQKKGEMVWAQVVEVEKELLLAEKEFQHAEVKLSEAKENLESIVTNQSDIDGKISSKEEVIGRAKGETDTTKSKFEDIVKTFDGYRSEMNDVDIQKRDIQNSINAAKSCLDVYREQLNTERARENNLGGSQIEKRANESNNLQREIADLSEQIVELESKRNDLHSALLEMGGNLTSLLTKKDSIANKISDQSEHLKVLEDVQRDKVSAFGKNMPQLLKLITRETRFQHPPKGPMGKYMTVKEQKWHLIIERILGNVINGFIVRSHHDQLILKELMRQSNCHATVVVGKYDPFDYSSGEPDSQYPTVLKIIKFDDDEVLHTLINHLGIEKMLLIEDRREAEAYMKRGIANVTQCYALDPRNRGYGFRIVSTQRSSGISKVTPWNRPPRIGFSSSTSIEAEKKILDDLKKQYNFASNQLNEAKIEQAKFKRDEQLLVEKIEGIKKRILLKRREVNSLESQELSVLDTEKIQTLERRISETEKELESYAGQLQDAKNEEHRIRDNQRPVIEEIRIYREKIQTETQRLSSLQTELSRLRDEKRNSEVDIERHRQTVESCTNILREKEAKKVQCAQVVADYTAKANTRCERVPVQLSPAELDNEIERLQMQIAEWRNRTGVSVEQAAEDYLNAKEKHDQAKVLVARLTQLLQALEETLRRRNEMWTKFRKLITLRTKELFELYLSQRNFTGKLVIKHQEEFLEPRVYPANRNLATAHNRHEKSKVSVQGLSGGEKSFATICMLLSIWEAMSCPLRCLDEFDVFMDAVNRLVSIKMMVDSAKDSSDKQFIFITPQDMGQIGLDKDVVVFRLSDPVVSSSALPPSTAP

SEQ ID NO: 10262 - protein, 315 aa, Erythrobacter sp. NAP1
MSEFGHDTTADEVLEGKDLSGKTVFITGGNSGLGQETGRAMAAKGAHVILAGRDQGKLDEAVSAIRSEVPDANLETITCDLASLDSVHAAGAEANERFDKIDLLINNAGVMACPKMHTDDGFEMQLGTNHLGHFALTKHLMPLVEAGTDKRIVNLSSRGHHIAPVDFDDPNFESTDYVPFLSYGRSKTANVLFTVGLEKRFGDKGIHSYAVHPGGIQTNLGRHMSEEESAALVERVTENDPGFSWKTIPQGAATQTWAATADELEGKGGLYCEDCNVAEVDDASPNSGVRTYALDPVAADKLWAMSEEMTGVTFA

SEQ ID NO: 10263 - protein, 242 aa, Erythrobacter sp. NAP1
MHGTRAMLSEARAIDRAAQRHMKVEVALAPPYTLIHPIHREAEQIAVGAQDCHHEEGGAHTGDISAAMVADAGAKFVILGHSERRQNHGEKDAVVRAKAESALAAGLRIILCCGESEETRDAGKAVAFVSKQLKASLPKTIEDVAEKLTVAYEPIWAIGTGKTATVEDIAEMHAEIRALLVKMYGEEAGAEVRILYGGSVKPENAGEILSTAEVGGALVGGASLAADSFMGIALAAGEADEG

SEQ ID NO: 10264 - protein, 381 aa, Yarrowia lipolytica CLIB122
MSTEGKTITCKAAVAWEAGKPLTLEDVEVAPPQAHEVRVKVTYTGVCHTDAYTLSGSDPEGIFPSVLGHEGAGIVESIGEGVTSVKPGDSVILLYTAECKECKFCKSGKTNLCQKVRATQGKGVLPDGTTRFKCKGKDLYSYMGCSSFSQYTVVADVSLVAVDPSAPQDRTCLLGCGVTTGYGAATVTANVQKGDNVAVFGAGCVGLAVVMGAKERGAAKIIVIDINGNKEAWAYKFGATDFVNPTKLPEGTTIVDKLVEMTDGGCDFTFDCTGNVTVMRQALEACHKGWGESIIIGVAAAGQEIATRPFQLVTGRVWKGSAFGGVKGRTQLPEIVKRYKDGSFEIDNFITHSKPLKDINSAFTDLHKGDCIRTVVDMWQV

SEQ ID NO: 10265 - protein, 954 aa, Pseudomonas syringae pv. syringae B728a
MTDRIELTTANEFIARHIGPRAADELAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKASQQFFASSHCHPQTLDVLRTRAEPLGITVVVADEHELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHQLTAILAEGLSTLGLNAEQAFFFDSLTLHTGDRTAALHAAARARHINLREIDDQRLGLSLDETTSQSAVETLWAIFANDGQSLPDFAALADSVQSRLPAGLLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKAVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGSNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIENYQEA

SEQ ID NO: 10266 - protein, 891 aa, Saccharomyces cerevisiae
MITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDEGGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVPQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLQDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 10267 - protein, 572 aa, Frankia sp. EAN1pec
MNESEPFAEQPLRETAAEGGDTGTSQDPLWFKRAVFYEVLVRGFADSNGDGTGDLAGLVSKLDYLEWLGVDCLWLLPIYSSPLRDGGYDISDYFQILPEFGDLGDFINLVDEAHRRGLRIIADLVMNHTSDEHPWFQASRSDPDGPYGDFYVWSDTDEKYPDARIIFVDTEKSNWTWDPVRGQYYWHRFFSHQPDLNYDNPDVQEAMLEVLRFWLDLGLDGFRLDAVPYLYVREGTNGENLPETHEYLRRVRKEIDAKYADRVMLAEANQWPSDVVQYFGNDDECHMAFHFPLMPRIFMAVRRESRYPISEILAQTPEIPPNCQWGIFLRNHDELTLEMVTDEERDYMYAEYAKDPRMKANIGIRRRLAPLLDNSRDQMELFTALLLSLPGSPVLYYGDEIGMGDNIYLGDRDGVRTPMQWSPDRNAGFSTTDPARLYLPVIMDPVYGYQALNVEAEQRMPTSFLSWTRRMIEVRKRHPVFGLGTYEELGASNPSVFAYVREFGDDRVLCVANLSRFAQPVELDLRRFAGLVPVELLGRVHFPPVGELPYLLTLPGHGHYWFALSNPGEFTQ

SEQ ID NO: 10268 - protein, 130 aa, Vibrio cholerae
MEAILNKNMKILIVDDFSTMRRIVKNLLRDLGFNNTQEADDGLTALPMLKKGDFDFVVTDWNMPGMQGIDLLKNIRADEELKHLPVLMITAEAKREQIIEAAQAGVNGYIVKPFTAATLKEKLDKIFERL

SEQ ID NO: 10269 - protein, 427 aa, Neisseria meningitidis Z2491
MNRNEILFDRAKAVIPGGVNSPVRAFGSVGGVPRFIKKAEGAYVWDENGTRYTDYVGSWGPAIVGHAHPEVIEAVREAALGGLSFGAPTEGEIAIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNDIACVILEPFVGNMNLVRPSEAFVKALRELTEKHGAVLIYDEVMTGFRVALGGAQSLHGITPDLTTMGKVIGGGMPLAAFGGRKDIMECISPLGGVYQAGTLSGNPIAVAAGLKTLEIIRREGFYENLTARTEQLVQGFRTAADAAGIEFTADSVGGMFGLYFAAHAPRNYADMARSNIEGFKQFFHGMLDRGIAFGPSAYEAGFVSAAHTPELIDETVAVAVEVFKAMAA

SEQ ID NO: 10270 - protein, 738 aa, Glycine max
MKGAVLVAIAASIGNFLQGWDNATIAGAIVYIKKDLALQTTMEGLVVAMSLIGATVITTCSGPIADWLGRRPMMIISSVLYFLGGLVMLWSPNVYVLCLARLLDGFGIGLAVTLVPVYISETAPSEIRGSLNTLPQFSGSGGMFLSYCMVFGMSLSPAPSWRLMLGVLSIPSLLYFALTIFFLPESPRWLVSKGRMLEAKKVLQRLRGREDVSGEMALLVEGLGIGGDTSIEEYIIGPADKVADGHEHATEKDKIRLYGSQAGLSWLAKPVTGQSSIGLASRHGSIINQSMPLMDPLVTLFGSIHEKLPETGAGGSMRSTLFPNFGSMFSTAEPHVKNEQWDEESLQREGEDYMSDAADGDSDDNLHSPLISRQTTSLEKDLPPPPPSHGSILGSMRRHSSLMQGSGEQGGSTGIGGGWQLAWKWTDKDEDGKHQGGFKRIYLHEEGVSASRRGSIVSIPGEGEFVQAAALVSQPALYSKELIDGHPVGPAMVHPSETASKGPSWKALLEPGVKHALVVGVGIQILQQFSGINGVLYYTPQILEEAGVEVLLSDIGIGSESASFLISAFTTFLMLPCIGVAMKLMDVSGRRQLLLTTIPVLIVSLIILVIGSLVNFGNVAHAAISTVCVVVYFCCFAMGYEPIPNILCSEIFPTRVRGLCIAICALVFWIGDIIITYSLPVMLGSLGLGGVFAIYAVVCFISWIFVFLKVPETKGMPLEVISEFFSVGAKQAASAKNE

SEQ ID NO: 10271 - protein, 130 aa, Zea mays
EAHSSACYDVLVDVPFPLQKEMMAFLANTEKHKDIEACDEVISASIKKIHEHRRRRAFFLGFSQSPVEFINALIASQSKDLKLVAGEANRNIEKERRADFYNQPWVEDAVIRYLNRKPANEGLGGGAGGS

SEQ ID NO: 10272 - protein, 633 aa, Caulobacter crescentus CB15
MENILTQTLVYLGAAVVSVPIAKRLGLGSVLGYLIAGVLIGPFALSLVGDQADVMKFAEFGVVILLFLIGLEVQPSTLWDMRKAIFGLGGAQVVGTALAIAAVALGLGLPWQTALAVGLVLAMSSTAIVLQTLDEKGLRQGPVGRAAFGVLLLQDLAVIPLFALLPLLAISAPQHAAEAGGHGGSLVATLPVWAQTLSVFAAVAAVVGGGRYLVRPLFRFIAKARLREIFTASALLIVVAVASLMQTVGLSPALGAFLAGVVLAESEFRRELETDIEPFRGLLLGLFFMTVGAGVDLPLVARQPLTLVGLVLGLMVLKFLVMYGIARLFGAQKRGALAVATALAQGGEFAFVLLTFTVGAGVIGAQLAALLTAAIAVSMALTPVAMILYERVAALMDAAIPDVTPDTGDFDEGEPDIIIAGFGRFGQVTGRLLAANGFKSTVLDTDIEQIELLRRFGRRVHYGDATRLDLLRQAGADRARMLIVALDDREKTVELVETARKAFPNLTILARAWDRRHAYDLLSNGADAVERETFESALTLGATALQKLGFRAHRAHRAAAFFRRHDRRVFEELRPMWGQEEAYILASRDAAKTMDRLLDADLHRMRPGDVGGAWDTASLDEELRERAQQEGAN

SEQ ID NO: 10273 - protein, 484 aa, Chlamydophila pneumoniae CWL029
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 10274 - protein, 962 aa, Shewanella oneidensis MR-1
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVLENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPASEAVNHELFGALFQYSNRFGQITDFTDLFAELRAKNVIVTVAADIMSLVLLKSPGSMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFADILAAGLQAKGVSLVNNTWFDTISIKGLDVAAVNARALAAEMNLRFDADGIVGVSLDETTIRTDIDALFEVILGAGHGLDVAALDAQIVAQGSQSIPASLVREDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEETVREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSKGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 10275 - protein, 412 aa, Salmonella typhimurium LT2
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQGFSVAVFGAGPVGLLTIACARLLGAEQIFVVDHHAWRLRFAEERYGAIPINFDDENDPAEKIIEQTAGHRGVDAVIDAVGFEAKGSLTETVLTNLKLEGSSGKALRQCIAAVRRGGVVSVPGVYAGFIHGFLFGDAFDKGLTFKMGQTHVHAWLGELLPLIEKGLLKPEEIVTHYMPFEEAARGYEIFEKREEECRKVILVPGATSAQAAQKQATGVVNPMPGGVV

SEQ ID NO: 10276 - protein, 639 aa, Arabidopsis thaliana
MLRTNSCVLVDEPLNDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQIVFDTMKSSYIVYRKIEKNGHNSFADVSKSENFFCLEKLIIQCGAGNNLRLDCVSHPSPPPPHRSMAPPIFVPPSTSHKGQGP

SEQ ID NO: 10277 - protein, 584 aa, Arabidopsis thaliana
MEAQYRNHDGDTSFSSLRVYLNSLSDTPSRFSRRAVSVSTSYDEMSRVRAVSGEQMRRTLRWYDLIGLGIGGMIGAGVFVTTGRASRLYAGPSIVVSYAIAGLCALLSAFCYTEFAVHLPVAGGAFSYIRITFGEFPAFITGANLIMDYVLSNAAVSRGFTAYLGSAFGISTSEWRFIVSGLPNGFNEIDPIAVIVVLAVTFVICYSTRESSKVNMVLTALHIAFIVFVIVMGFSKGDVKNLTRPDNPENPSGFFPFGVSGVFNGAAMVYLSYIGYDAVSTMAEEVKDPVKDIPMGISGSVAIVIVLYCLMAISMSMLLPYDLIDAEAPYSAAFSKSEGWEWVTRVVGIGASFGILTSLIVAMLGQARYMCVIGRSRVVPIWFAKVHPKTSTPVNASAFLGIFTAVLALFTDLNVLLNLVSIGTLFVFYMVANAVIFRRYVTVGYTEPWPTLSFLCLFSITSILFTLVWQLAPSGPPKWFILGASTVTAIAIVQIFHCVVPQARIPEFWGVPLMPWTPCVSIFLNIFLLGSLDAPSYIRFGFFSGLVVLVYVFYSVHASYDAEGDGSLDFKDVESLERINRVLS

SEQ ID NO: 10278 - protein, 331 aa, Geobacter metallireducens GS-15
MALRVAINGFGRIGRSVLRAAIKEKGIEFVAINDLTDAKTLAHLLKYDSVHGPFPGKVEAGNGEIIVNGKPIKILAVRNPEELPWKKEKIDVVLESTGLFTSREKAELHLKAGAKKIIISAPATNEDITIVMGVNSNLYDPKKHNIISNASCTTNCLAPVAKVLHETFGIEKGLVTTVHSYTNDQQILDLPHKDLRRARAAAMSMIPTSTGAAKAVALVLPELKGKLDGMAIRVPTPNVSVVDLVVTLSKKADADKVNAALKKASKGSLKGVLGFSEEPLVSIDFNGNPLSSIVDAGCTKVIEGNMVKVLSWYDNETGFSHRVVDLMKLIA

SEQ ID NO: 10279 - protein, 337 aa, Agaricus bisporus
MVNVGINGFGRIGRLVLRNALQMQILTVVAVNDPFLDVEYMAYLFKYDSVHGRYQGKVETKDGKLIIDGHKIAAFAEREPANIKWADCGAEYIVESTGVFKTEELAKEHLKGGAKKVVITAPGSGVPTYVVGVNLDKYDPKEVVISNASCTTNCLAVLAKVINDKFGIVEGLMTTVHATTATQKTVDAPAKKDWRSGRSVTNNIIPASTGAAKAVTKAIPDLEGKLTGLAFRVPTLDVSVVDLVVRLEKETSYDDVKKAMRDAADGKHPGIEKGIVDYTEEDVVSTDFVGSNYSMIFDAKAGIALNSRFMKLVAWYDNEWGYARRVCDEVVYVAKKN

SEQ ID NO: 10280 - protein, 393 aa, Staphylococcus epidermidis ATCC 12228
MQFDTIELAIEALRNGESIIVVDDEDRENEGDLVAVTEWMDDNTINFMAKEGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTDYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 10281 - protein, 499 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETSLPRVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 10282 - protein, 432 aa, Staphylococcus epidermidis RP62A
MTLSSYATSKLTEEKVFKDPIHRFIHVQDQLIWDLIKTKEFQRLRRIKQLGTLYLSFHTAEHSRFGHSLGVYEIVRRMIDETFIGQDAWDNTDRPLALCAALLHDLGHGPFSHSFEKIFNTDHEAFTQAIITGNTEVNGVLSRVSDNFPKQVADVINKTHDNKLVISMISSQIDADRMDYLQRDAYFTGVTYGSFDMERILRLMRPSKEEVLIKDSGMHAVENFIMSRYQMYWQIYFHPVSRGGEVLLNNCLKRAKQLYNEGYEFKMYPKDFIPFFEGTMTIEQYVELDEAVVLYYLKKWIHENDPILSDLSRRFINRDLFKYIPFDGSIITISELQELFEAGGINPDYYFVSEAFSDLPYDYDRPGSNRKPIHLLKSNGGITEISNQSLVINSITGINREDHKLYYPKEMILKIKDYQIKGSIINLLNELN

SEQ ID NO: 10283 - protein, 593 aa, Sinorhizobium meliloti 1021
MAAESHGIDLLPVIALLGAAVVAAPLFKRIGLGSVLGYLAAGIAIGPFGLRLLQEPSSILHVAELGVVMFLFIIGLEMRPSRLWGLRREIFGLGIVQVALCALLLTGVGVLTGFPVAPSFVAGAGFVLTSTAIVMQLLEERREMAAPKGQRIVSILLVEDMAIVPLLALVAFLAPIVPGSVAASGAIDWLSIAIGLVTIAGLVLAGRYLLNPLFGLIAGVEAREVMTAAALMVVLGSAYVMQLGGLSMAMGAFLAGVLLSESTFRHQLEADVEPFRGILLGLFFLAVGMSLDLGVIARNWAMILFYVAAYMVVKAIVIYLVARLFRASNWEAIERAVFMAQGGEFAFVLYAAALGTGIISSEENAILTAIIIVSMMVTPLLIAALRLVERNIPLSTDGVERPENLSGNVLIIGFGRVGQIVSQVLLTRGHVISIIDTDVEMINTAREFDFKVYYGDGKRLDILHAAGAERASAIVVCVDKADDATKIVELIKAEFPLIPVLARASDRRHALDLITAGADFHIRETFESSLVLGQKALEALGADLPEVAEIIEKVRQRDEKRLELELVGGLYAGRPLFSGKLEPVEAVPPGGSA

SEQ ID NO: 10284 - protein, 326 aa, Triticum aestivum
  misc_feature (21)..(21): Xaa can be any naturally occurring amino acid
  unsure (1)..(326): unsure at all Xaa locations
RKKFHLLCNRSGKLKPNSGPXRKRKVNVLGSQCQAKVIVKLHNEQWEFTGVKHEHNHPLCPSPSLTTSRPDHKYLSSEEKLFLRVLQQSRVNPRKAMNIFQRMRSNFGNVSSSNEKDMSNSQCVDQWRKENSDVETALKRFKELELRNLGFSYTMQKDEDNIVRSLFWTDARSKVDYEIFGDFISFSTTYSTNRHNMPFTPIIGVNSHGRILVFGCALLQDQKAETFKWMFQTFLHVMGGKLPRTVITDQDEGMATAIAEVMPQVRHRLCKFSVMRKAQEMLGAFMAARSNMNAELHGLVDNSVTEKEFEEGWDVLTGRYDAVQMS

SEQ ID NO: 10285 - protein, 531 aa, Streptococcus mutans
WHKATVYQIYPKSFMDTNGDGIGDLKGITSKLDYLQKLGVMAIWLSPVYDSPMDDNGYDIANYEAIADIFGNMADMDNLLTQAKMRGIKIIMDLVVNHTSDEHAWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMVFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 10286 - protein, 515 aa, Leifsonia xyli subsp. xyli str. CTCB07
MTTSHDPADELENRLEHLGDVSQAVQDFASEQEGYRKSLSARQVQMIAIGGAIGTGLFLGAGGRLQQSGPLLVFVYAVCGFFAFLVLRALGELVLHRPSSGSFVSYAREFFGEKMAYVAGWMYFLNWAMTAIVDSTAVALYVKYWSLFSSVPQWLLALIALVIVVSLNLISVKVFGEMEFWFALIKVGALATFLVVGIVVLAAGWPTDLGPTGIPMLAENGWLLPNGIATIAMAIVLVQGVVFAYAAVELVGIAAGETEHPEKIMPRAINSVVFRIAVFYCGSVLLLALLLPASAYSGSESPFVTFFSHFGGPQLSAVVGSIMNFVVLTAALSSLNAGMYSTGRILHSMAQTGAAPRFTSRMSKQGVPYGGILLTAAIGVFGVFLNLVVPAQAFNIVLNVAALGIVTSWAMIVLCQMRLRRWSLRGTMKRPAFSLIGAPFTAYLTLAFLLAVLVLMTFDYPTGTWTVASLVVIAPLLVIGWFAQRGRILAIAARREGHTGAYPVIAARPLRRERE

SEQ ID NO: 10287 - protein, 350 aa, Staphylococcus epidermidis ATCC 12228
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKEIGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 10288 - protein, 326 aa, Bradyrhizobium japonicum USDA 110
MSRVSEQPVDRITIPLLQRWKQDGRRLVMTTAYDAVAAPIPDPSIDISLVGDSGGNVCLGFENTPPVSVAMMNHHLEAAVRSKPRALLVADMSFLSFHVSVEETIRNAGGFLQRGAAAARLEGGGKRIEMVRAIVDCEIPVMGHLGLVPQSVNVMGGFKVQGRKVDEALRLLDDAHRLQEASCFALVLEGTPAELTARVSDSLTIPTIGIGSGPDCSEQVLCFMTCWAKPKVIAPNSFPPIRKAFSSSMMRFRAGQRMSAVARSPARKSPIGFPKALGRQLPTGRHPPQIITSVAELRRTLAKSRSANQRAGLCRRWAISTMATWR

SEQ ID NO: 10289 - protein, 318 aa, Synechocystis sp. PCC 6803
MKWKVLVTCPPMLHTLEHCQTRFEQEQLDVVAPTITQQLSEAELCEQIADFDGVIAGDDPFTARVLTIGKQGKLKALAKWGIGVDAIDLAAAKQLGILTSNTPNVFGDEVADVAIGYLILLARELHCIDQAVRQGEWLKIRGHSLRGKTAGIIGVGSIGQAIAVRLQSMGLKLLGYDPHPISADFCEQTGLHPVPLQDVLQQADCLFLACNLTPDNFHLLNADTFDQMKPGVWLINVARGGLVDQAALIETLQTGKVAKAALDVFEQEPLAADSPLTQLPQVILGSHNGSNTREAVLKVNQLAIDNLVRDLQRATSGD

SEQ ID NO: 10290 - protein, 424 aa, Thermus thermophilus HB8
MERPISEAYFQEAKRHIPGGVSSPVRAFKAVGGTPPFLVRGEGAYVWDADGNRYLDYVMSWGPLILGHAHPKVLARVRETLERGLTFGAPSPLEVALAKKVKRAYPFVDLVRFVNSGTEATMSALRLARGYTGRPYIVKFRGNYHGHADGLLVEAGSGALTLGVPSSAGVPEEYAKLTLVLEYNDPEGLREVLKRRGEEIAAIIFEPVVGNAGVLVPTEDFLKALHEAKAYGVLLIADEVMTGFRLAFGGATELLGLKPDLVTLGKILGGGLPAAAYAGRREIMEKVAPLGPVYQAGTLSGNPLAMAAGLATLELLEENPGYYAYLEDLGARLEAGLKEVLKEKGLPHTVNRVGSMITVFFTEGPVVTFQDARRTDTELFKRFFHGLLDRGIYWPPSNFEAAFLSVAHREEDVEKTLEALRKAL

SEQ ID NO: 10291 - protein, 585 aa, Triticum aestivum
TAQESKVKLVEDLNLKRKRKKNVIEKTNCQAKIIVKLIKGEWVIAAVQNEHNHPLSPSRSFTRFLTSQKHMSPEERSFSRVLQQSRVPPGEILKILRRMSGFFRELPSKEKQALILQSAEQWRKANIDVEKTLNHLEELQLQDPCFFYTVQKDEDGMLRSIFWTDARSRMDYEIFGDFVSFDTTFSTNRHNMPFVPITGMNNRGRTIVLGCALLQDRKAETYKWMLETFLQEMGGGQIPRSVITSQDEAMAKAIAEVMPQARHRFCRWNGKAQEKMAAFVAARGNMKAELDILVDSSLTETEFEQGWSALIQRHDASENEYLQLLWEMRKTWAPVYFMQDFFPFVVSARGSQGAFSLFKENVLPKDKIENLIEKYEEMQDKIKKTDEEDALEAATEPSCFSLQPIERHASRVYTRQIFLKVQKELLHSTAFKVQEIERGALYRLDKASNYENPEYDRDSFEVSVESGVTDTYTCQCAKFARDGILCCHVFRLFTQFGIDEIPEKYIVARWTDGFREEQLERREEGRLVAAARREEDAARYAALMSKAAGIGREICGDGAKCDAFMLELDRIREKMATMAMANDHV

SEQ ID NO: 10292 - protein, 299 aa, Picrophilus torridus DSM 9790
MKGKILICDPVDGIMIEKLSKDFDIDNSPDITRDELLKKIGDYDIIIVRSRTKIDRDIIDNAKRLKIIARAGIGTDSIDVDYAQEKGIKIVYAPGSSTESVVELTVAFAVIAARQIIKGVENTRKNDFTKLKGIELSGKTLGIIGYGRIGRAIANAFSVFNVRSIAYDAYPVDFTGAEQVTLEDLLRNSDIISINITLRKDSPPVLNEKELSMLRDNAIVINTSRANAIEPRAFLKILKEKNIFYISDVFWHEPARFDYEFEMLKLPNVIITPHLGAQTREAQKRIAIMTADNIIKEWS

SEQ ID NO: 10293 - protein, 244 aa, Campylobacter upsaliensis RM3195
MSSIYILANGAMASALAYGLRDFYEIYIVGRETQKLEYLKKEGFKTLLYNEFDLENKNVILAFKPYALNEMSQILKGEARILISVLANTSLKELECIRAQNIARIMPNIAAKYKASTTPFILKNELFKEEIIQILTSFGNAYELSSEKQMPSAMALSGCAPAFLSLVAEALANGGVYRGLDKELSLKLTQGLFESFSTLLAHEHPALIKESVCSPAGVSIKGVKVLEERAIRAAFMEAVYISSK

SEQ ID NO: 10294 - protein, 393 aa, Triticum aestivum
  misc_feature (133)..(133): Xaa can be any naturally occurring amino acid
  misc_feature (162)..(162): Xaa can be any naturally occurring amino acid
  misc_feature (173)..(173): Xaa can be any naturally occurring amino acid
  misc_feature (207)..(207): Xaa can be any naturally occurring amino acid
  unsure (1)..(393): unsure at all Xaa locations
MASATLLKSSFLPKKAEWGTTRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVXPGIKVDKGLVPLVGSNDESWCQGLDGLAXSREAAYYQQGXAASAKWRTVVSIPNGPSELAVKEAALGVLPRYAXAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 10295 - protein, 122 aa, Glycine max
NGKTSLQQFKNVVAIVDPPRAGLHPTVIKALRTHPGLRRLVYISCNPETLVANAIELCTPSPLKIEKGNKDNRGWRNMSSAGLARHRAKSMPISEAFHPVKAMAVDLFPHTPHCELVMLLER

SEQ ID NO: 10296 - protein, 583 aa, Bacillus sp. KSM-1876
MLREAIYHRPKNNFAYAYDKETIHIRLRAKKGDLTKAYLIFGDPYQWTDEGWKNDTKPMVFEGSDELFEYWFVEVKPEFRRLRYGFELHSDDQCLVYGEDGFKEKDPKNAHFYFVFLFLNGNDVFTAPEWVKDTIWYQIFPERFPNGNPSLNPEGTLPWGSVEPKWDTFFGGDLEGIINNIEYLKELGINGIYLTPIFKARTNHKYDTVDYMEIDPQFGDKQTFKKLIEVCHDNGIRVMLDAVFNHSGFYFEQFQDVLEHQEKSKFRDWFHLREFPVIPLPEPNYDTFAFTHQMPKLNTANPEVKEYLLNVGRYWVEEFDIDGWRLDVANEVDHQFWREFRNTIKSIKPDVYILGEVWHDSMPWLQGDQFDAVMNYPFTQAVVEFIPKNEIDSKQFEQQLTKLLTSYPQNVNEVAFNLLGSHDTPRILTICEGNKDKLKLLLLLQFSFIGTPCIYYGDEIGLTGGNDPGCRKCMVWDESDQDSELLNFFRSLIALRRNYPAFGNKGLVEVMETNRETNHIIYAKKSSQETIVIAINNSSEKIKVDLPHEFNDRKSIDIWNNEPFPKMSEVELNPWGFAIIKLT

SEQ ID NO: 10297 - protein, 315 aa, Prochlorococcus marinus subsp. marinus str. CCMP1375
MTWSINSIPSQEGRTVFVTGANSGLGFDTAQALLEKGATVILGCRTLEKAERSRQKLLDETDCGKIDVLEIDLADLEKVNEALDKIAVKYKKLDLLINNAGVMAPPQTFSKQGFELQFAVNHLSHMALTLKLLPLIAKQPGSRVVTVSSGAQYMGKINLDDLQGGEGYDRWSSYSQSKLANVMFALELSKRLQQSNLDIASLSAHPGLARTNLQSTSVKLNGSWQEAIAYKLMDPMFQSSRMGALPQLLAATDPTAKTGEQYGPRFNFRGYPKICRIAPSALNSDEREQLWQLSEKLIGDAVDISKGKELLSTKK

SEQ ID NO: 10298 - protein, 154 aa, Glycine max
  misc_feature (33)..(33): Xaa can be any naturally occurring amino acid
  misc_feature (126)..(126): Xaa can be any naturally occurring amino acid
  misc_feature (137)..(137): Xaa can be any naturally occurring amino acid
  unsure (1)..(154): unsure at all Xaa locations
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHIRSPGYYYGRYWTMWXAAMFGCTDASXELKELQEAYDCISNGYI

SEQ ID NO: 10299 - protein, 251 aa, Geobacter metallireducens GS-15
MRTPIIAGNWKLFKKSSEAQDFVAELIPLVQKTTDVEIVIAPVFTVLSAVKRAIADCNIMLSAQDCFWEEEGAFTGEISPGMLVDAGCSHVIIGHSERRQYFGETDETVNRKIKAAITAGLTVLFCIGETLAEREADKTFEVLRTQIENGLAGLARGDLAKIVIAYEPVWAIGTGKTATDEQAQIAHAFIRKVVGELFTVQIAETIRILYGGSVKPENVRGLMNQPDIDGALVGGASLKADSFGAIVNYKA

SEQ ID NO: 10300 - protein, 338 aa, Agaricus bisporus
MVKVGINGFGRIGRIVLRNALQFQDIEVVAVNDPFIDLEYMAYMFKYDSVHGRFKGTVEVKNGSFVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 10301 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 10302 - protein, 738 aa, Arabidopsis thaliana
MKVQRLFLVAIFCLSYMQLVKGQTLPRCPEKCGNVTLEYPFGFSPGCWRAEDPSFNLSCVNENLFYKGLEVVEISHSSQLRVLYPASYICYNSKGKFAKGTYYWSNLGNLTLSGNNTITALGCNSYAFVSSNGTRRNSVGCISACDALSHEANGECNGEGCCQNPVPAGNNWLIVRSYRFDNDTSVQPISEGQCIYAFLVENGKFKYNASDKYSYLQNRNVGFPVVLDWSIRGETCGQVGEKKCGVNGICSNSASGIGYTCKCKGGFQGNPYLQNGCQDINECTTANPIHKHNCSGDSTCENKLGHFRCNCRSRYELNTTTNTCKPKGNPEYVEWTTIVLGTTIGFLVILLAISCIEHKMKNTKDTELRQQFFEQNGGGMLMQRLSGAGPSNVDVKIFTEEGMKEATDGYDENRILGQGGQGTVYKGILPDNSIVAIKKARLGDNSQVEQFINEVLVLSQINHRNVVKLLGCCLETEVPLLVYEFISSGTLFDHLHGSMFDSSLTWEHRLRMAVEIAGTLAYLHSSASIPIIHRDIKTANILLDENLTAKVADFGASRLIPMDKEDLATMVQGTLGYLDPEYYNTGLLNEKSDVYSFGVVLMELLSGQKALCFERPQTSKHIVSYFASATKENRLHEIIDGQVMNENNQREIQKAARIAVECTRLTGEERPGMKEVAAELEALRVTKTKHKWSDEYPEQEDTEHLVGVQKLSAQGETSSSIGYDSIRNVAILDIEAGR

SEQ ID NO: 10303 - protein, 377 aa, Isatis tinctoria
MADGEDIQPLVCDNGTGMVKAGFAGDDAPRAVFPSIVGRPRHTGVTVWMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEILFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 10304 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVAVY

SEQ ID NO: 10305 - protein, 206 aa, Erythrobacter sp. NAP1
MVARRQTAGKGRQGREWFDGEGNFMGSTVVPIRDGDPPPASLSFVAALAVADAIHQSVEGTVRAELKWPNDVLVNRAKASGILLEMVERSVVVGIGVNLARAPSLPDRETAALADFGRAPTVEVFADELASRFARYVTIWRDNGLGAVLRAFLDASIHQSGDRVRVHDADGSLIEGAFAGLDPSDGALKLNLADGSERVIRAGDIT

SEQ ID NO: 10306 - protein, 162 aa, Triticum aestivum
  misc_feature (64)..(64): Xaa can be any naturally occurring amino acid
  misc_feature (74)..(74): Xaa can be any naturally occurring amino acid
  misc_feature (88)..(88): Xaa can be any naturally occurring amino acid
  misc_feature (100)..(100): Xaa can be any naturally occurring amino acid
  misc_feature (125)..(126): Xaa can be any naturally occurring amino acid
  misc_feature (128)..(128): Xaa can be any naturally occurring amino acid
  misc_feature (132)..(132): Xaa can be any naturally occurring amino acid
  unsure (1)..(162): unsure at all Xaa locations
MASEQTFIMIKPDGVQRGLIGEVISRFEKKGFYLKGLKLQNVEKSFAEQHYADLSSKPFFAGLXVEYIVSGPVXVAMVWEGKSVVSTXGRKIMGATNPWXLDPGTIRGDLPSDIRQELTMGSDQXXRXEEGXPLWSPGRIADGRSNQHNGSMRLNCHDGFQV

SEQ ID NO: 10307 - protein, 342 aa, Campylobacter upsaliensis RM3195
MNFINIEQAIKDLKEGKMLVMVDAEDRENEGDIIFPAQFSTKEKVNFAIKEARGVLCVALDETLAKKFELPLMVPKNTSSHETAFTITVDAKKATTGVSAYERDMTIKIFADDTACANDFIRPGHINPLIAKKGGVLERTGHTEGSVDLCHLAGLKGACVICEIVKDNGDMARREDLLEFCEKFKLNMITVSDLIEYRLKNESLITLKKQQASFLAGFKAQKFIFEDHNQIQHIAFCFNQPRKSENIKFHISGSDFELLTSNKFSQLLEQIQFLSQNGGIIIFMQGEKSNAAQFKNYGIGAQILRFFKVEEVHLMSQNCDKDFIALKGFGLDIKTCQFKNLL

SEQ ID NO: 10308 - protein, 469 aa, Shewanella sp. ANA-3
MSVESVLKQLEELEVKFVDLRFTDTKGKEQHVSIPAHQVDADFFEDGKMFDGSSIAGWKGINESDMVLMPDPTTFVLDPFTEETTALIRCDILEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVSRTTHPLEFEMYYSL

SEQ ID NO: 10309 - protein, 250 aa, Thermus thermophilus HB8
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQAIRKALSERYGEAFASRVRILYGGSVNPKNFADLLSMPNVDGGLVGGASLELESFLALLRIAG

SEQ ID NO: 10310 - protein, 360 aa, Eremothecium gossypii
MSEWKVDPDNRRRLLQLQKLGGNKKCADCGAPNPQWASPKFGIFICLECAGIHRGLGVHISFVRSITMDQFKPEELERMEHGGNAQFHEYLAKHGVDQKLPQKAKYDNPVAASYKEKLTCVCEGKDWVEPDLSGAGGATLDRGSSEQASPGTATPNGGAEKLESRRATGPADEQKLRNENYFATLGKKNQTKPEHLPPSQGGRYQGFGNTPTPTNPNQARQGGTTADLSLDNLQKDPWGTLTKGWGLFSTAVTKSVEEVNESVIKPGVQHLQSSELSAEAQRAAQQFGQKFQETSSSGISAFSRWTKNLQQQYVQQSPGAPDQDSQYSRLFDSLESRSKDHSQLRAQKKGGEADTEWDDF

SEQ ID NO: 10311 - protein, 464 aa, Glycine max
MANTLYNGATCRIPLRDESLAFSRHVSRSLSFLPITRAGKQSYAFAVKASSHSDFDVDLSLSPRVNAVKPSKTVAISDHATALVQAGVPVIRLAAGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVKSFREIDGVKISEPQGAFYLFLDFSFYYGREAEGFGKIEDSESLCRYLLDVGQVALVPGSAFGDDTCIRISYAESLTTLQAAVERVKRALIPLSSAALV

SEQ ID NO: 10312 - protein, 174 aa, Rhizobium etli
ARKPSIVPIVEPECLMDGKPGDHNIDRCAEVTESTLQIVFEELAEARVSLEGMILKPNMVIDGKNARKASVAEVAERTVQVLKRTVPSAVPGIAFLSGGQTTEEATAHLSAINGFDLPWLVTFSYGRALQDSALKAWNGKPENVAAGQREFTHRAEMNSLAAKGSWKKDLEQAA

SEQ ID NO: 10313 - protein, 492 aa, Campylobacter upsaliensis RM3195
MKQKCILIITDGIGYNPNTAFNAFNAAKKPTYDKLFKEVPNSLLKTSGLAVGLPEGQMGNSEVGHMCIGSGRIIYQNLVKINQAIEKNMLKNNANLKALLQKCKRVHIIGLYSDGGVHSLHTHFNALLTICKDEGKEVFAHAISDGRDVSPKSGLKLIRDLESFCEAKKIHFASLAGRFYAMDRDKRWERVEAYYKALLGEAKGVKKMSAYVEENYQKNIFDEFIEPVISEEFEGLNEEDGLIFINFRNDRMKQLVELLSAENFTPLKQKKRFEKLLTMSVYDDKFNIPVLFEKEELQNTLTEVISNAGLSQLHTAETEKYAHVTFFFNGGKEDLLENETRVLIPSPKIKTYDEKPQMSAFEVCEVVKEGIKKGEDFIVVNFANGDMVGHTGDFNAAVSAVEAVDTCLGEIIKEARRQNYAFIITSDHGNCEAMQDEKGNLLTNHTTFNVFVFIEAQICKQIKPNMGLSNVAASVLKILNLEIPKEMNEALF

SEQ ID NO: 10314 - protein, 489 aa, Thermobifida fusca YX
MTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 10315 - protein, 279 aa, Zea mays
  misc_feature (14)..(14): Xaa can be any naturally occurring amino acid
  misc_feature (233)..(233): Xaa can be any naturally occurring amino acid
  misc_feature (257)..(257): Xaa can be any naturally occurring amino acid
  unsure (1)..(279): unsure at all Xaa locations
FLASMSSLEVGFSXLFVEMANEAKNLVLFTEKGQFGTLARMLQVDPPPKAVKVTMSKRVPLVGDELKAYEEEQERIKKEEVLKASISKEKELKASHESNAKASDPMVVDASSSRKSSNAGSHVGGNVDILIDGFVSPVTSIAPMFPFFENTADWDDFGEVINPDDYMMKQDEMDNNMMLGAGDGMDGKLDESSARLLLDSAPSKVISNEMTVQVKCSLAYMDFEGRSDGRSVXSVIAHVAPLKLVLVHGSAEATEHXKMHCAKNSDLHVYAPQIEENID

SEQ ID NO: 10316 - protein, 586 aa, Alkaliphilus metalliredigenes QYMF
MKKTKIVCTIGPASESKEVFTELVKQGLNVARLNFSHGNHEEHGERIKMIKEVRRELEQSVAILLDTKGPEIRTGKFKDPEVLLAEGQVFTVTTRDVVGDQNMCSVSYEGLARDVKPGDEILIDDGLVGLRVQKIIQGTDVECIVENAGIVKNHKGVNVPGVQINLPAITEKDEGDIVFGIQMDIDFIAASFVRKASDVLAIKRILEENNADHIQIISKIENQEGMDNLDEIIEVSDGIMVARGDLGVEIPTEDVPLAQKEMILKCNKVGKPVITATQMLDSMMRNPRPTRAEVTDVANAIFDGTDAIMLSGETAAGKYPIESVKTMARIALRTEGAIDYRSLLNKKAQERELTITDAISHATCSTASDLQASAILIATSSGHTARMVSRFKPQAPIIAATTSERVMRKLSLTWGAYCLLVDEFQSTDDIIDATVEHALEKEYIKRGDLIVMTAGVPVGIAGTTNLLKVHIVGDVLVNGTGVGKIPATGKVVVIHQHDELGQETFNEGDILVVSCTDKDLIPLMEKAGAMIVEEGGITSHAAIVGLNLHKPTVVGAIGATEKLKTGDIVTVDTIRGLIYSGKTRVL

SEQ ID NO: 10317 - protein, 477 aa, Symbiobacterium thermophilum IAM 14863
MYIGGEWREAVSGRRFEVTNPATGEVIATVPDAGREDARAAIEAAHAAFGEWSSLPAHVRARYMRRLYDLIVQNVDRLARVLTEENGKPLAEAKGEVFNGAEYLNWYAEETRRIYGETIPSSSRRTRIWVLRQPVGVVGAITPWNFPSSMVTRKIAPALAAGCTVVLKPAEQTPLSALLIAELIHEAGLPAGVVNVVTTLDPAAVGQEFLENRLVRKISFTGSTEVGKHLMQGAAAQMKRVSMELGGNAPFIVFEDADLDAAVQGVVISKFRNAGQTCICANRIYVQESIAPAFTERLVEAVRGLRVGHGLEEGINVGPLIDEAAYVKVEGHVSDARGKGARVLTGGHRLTGPGFDRGFFYAPTLLDQVSDEMRIVHEETFGPVAPILTFRTEEEVIRRANDTNYGLAAYIFTRNLGRTVRVSEALEYGMVAVNDSLLAVPQAPFGGVKESGLGREGGHHGLDDYLEYKYLSVVLDG

SEQ ID NO: 10318 - protein, 278 aa, Staphylococcus epidermidis ATCC 12228
METVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 10319 - protein, 511 aa, Yarrowia lipolytica CLIB122
MKWMRHSSDKISNLKRPTDKTVHCRTYEQTSRRYIANNPRHTMSAVNIPVNENEVSVSSSPITSYGSPVSGSFQGKPRQRRYSYTAARTNKLKPFSTGDIKILLLENVNQTAIDILEGQGYQVETHKSSLDEEELIEKIRDVQVVGIRSKTKLNSRVLKEAKNLIAIGCFCIGTNQVDLEYAANNGIAVFNSPFSNSRSVAELVICEIIMLSRQLGDRNIEMHAGTWNKVSAKCWEIRGKTLGIVGYGHIGSQLSVLAESMGMNVIYYDVIMIMGLGTAKQVPTLAELLAQADYVSLHVPELPETMNLMSKAQFDGMKNGSYLINNARGKVIDIPELISAMKSGKLAGAAVDVFPKEPAKNGSNEFGSHLNEWTNELLTLPNLIMSPHIGGSTEEAQSAIGIEVGTALTKYINEGSSVGAVNFPEVNLNVVNHAEEHDHVRILYVHKNVPGVLLSVNEIFASHNIEKQYSESRGDIAYLMADIADVDQADIKTLYEKLEQTPFKISTRLLY

SEQ ID NO: 10320 - protein, 141 aa, Arabidopsis thaliana
  misc_feature (42)..(42): Xaa can be any naturally occurring amino acid
  unsure (1)..(141): unsure at all Xaa locations
PSVRGKEEEITRRGKCASYMHSSAVVVTSPTQATMVAPFTGXKSSAAFPVTRMTNKDIASIAIIGGRVSRTKGRPPNEKNKEETVSYLPDLSDAELTKEVDYLVRNKWIPCVEYELEHGSVSREHGNTPGYYEGRNWTMGK

SEQ ID NO: 10321 - protein, 176 aa, Triticum aestivum
  misc_feature (60)..(60): Xaa can be any naturally occurring amino acid
  misc_feature (70)..(70): Xaa can be any naturally occurring amino acid
  misc_feature (118)..(118): Xaa can be any naturally occurring amino acid
  misc_feature (145)..(145): Xaa can be any naturally occurring amino acid
  misc_feature (150)..(150): Xaa can be any naturally occurring amino acid
  misc_feature (165)..(165): Xaa can be any naturally occurring amino acid
  unsure (1)..(176): unsure at all Xaa locations
MAPTVMASSATSVAPFQGLKSTAGLPVSRRSNGASLGSVSNGGRIRCMQVWPIEGIKKFXETLSYLPPLXSTEALLKAGGTTWIRSKWVPCLEFSKVGFIFREHNASPRGTNDGRYWXTMWELPMFGCTDATQVINEVEESRRSXPDAYXRYRFANRQVQCVSFXASSNGLQDPEG

SEQ ID NO: 10322 - protein, 521 aa, Thermus thermophilus HB8
MWRVLVSDDMRLGEVRYPGVILDYRPGIGREELLEIIPAYDALITRSRTRVDAELLQRGKRLKVVGRGGVGVDNVDLEAASRLGILVVNVPEANTRSAAELAFGLLLAAARGIALSDRKLRQGEWDRKFLGLELKGKTLGIVGLGRIGSQVARFAKGFEMRVLAYDPYIPKARAESLGVELLENLEDLLRQSHFLTVHTPLTEETRGMIGRRELYLLPRGAVVVNAARGGIIDEKALLEVLEEGHLFAVGLDVFAEEPPPKDHPLIHHPRVVHTAHLGANTLEAQERVGEAILERVVRTLEGDLSYALNTGFDPEALEALKGFLPLGEALGKLLAQITRGRPEALEVRFLGQFEKDPEPIASAVAKGLLARVLGEGAVNLVSARPLLKDRGIHLTTLRSEEAGEYTRLVEARLSTDQEERRARGVVIGGRPRLVGIDDYALEVVPEGYMLVCVNYDRPGVVGQVGTLLGEAGVNIAGMQLGRDVPGGRALFVLTVDQKPSPEVLEALRALPVLERVDLVEL

SEQ ID NO: 10323 - protein, 340 aa, Staphylococcus epidermidis RP62A
MKAAVVTKDHRVSIEEKRLRELKPGEALVKTEYCGVCHTDLHVKNADFGDVTGVTLGHEGIGRVIEVADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKVQLRQLSEINDIFDEMEKGTITGRMVIDMKSSH

SEQ ID NO: 10324 - protein, 441 aa, Candidatus Kuenenia stuttgartiensis
MAVINRAKDDKVKLVQLQFTDINGSVKAVTIPIEKFPESLEKGLWFDGSSIEGFTRICESDMFLKPDAGTYALLPWETVAVTARLFCDVYMPDGSPFEGDPRYILKRAIKNARDMNFEYNVGPELEFFLFKPKNDGAVAPTPHDVGSYFDFSPRDLAGNVRADIIFTLEKMGINVEMSHHEVAPGQHEIDFKYAEALRTAENALTFKQVVKSIAHKHDLYATFMPKPIFGICGSGMHCHQSLFDIRTNTNIFFDENDTYKLSRNAKHFIAGQLEHVRAMSAILSPTVNSYKRLVPGYEAPVYICWGQKNRSALIRVPRYSPGREQATRAELRCPDPSNNPYLALAVMLEAGLDGIKRKLELPKATEENVYEFNKDELAYRNIATLPGSLGEALHELKQSALMKRALGSHTYQIYLHSKFSEWDEYRIQVTEWEQKKYLETT

SEQ ID NO: 10325 - protein, 329 aa, Oryza sativa
MSPRREQAEEQQQQGWREEAVSGASLRQVDLERGANGWASPPGDLFHLRARGYFSGGGGGGGGGGGGGRRGKAPSAAEWLLRPAGVDWLRSHSRLDHVLARDDIPVAAAFRRARLRKDPSAHFLLAVNLQVPGRPDAYSAVFYFAAEAAIPAESLLGRFVHGDDAYRNARFKIVNRIVKGPWLVRATVGNYAACLLGRALTCRYHGGDGYLEIDVDIASSAIASAILHLALGAVTSVTIDMGFLVESQSEEELPERLFGAVRIAQMEMGAAKYVETAPDDVVPEAGRAGAGFRVHSAKVANDSRHQERAAGKVGRSMSCQERESGGGGK

SEQ ID NO: 10326 - protein, 302 aa, Synechococcus sp. WH 8102
MAFQGHQARKRFGQHWLKDQTVLDRIVAAADLQPSDRVLEVGPGRGALTERLLSSPAAAVQAVELDRDLVDGLRERFAGDPRFSLRQGDVLELPLQLEDGVAASKVVANIPYNITGPLLDRLVGRLDRPVEPPYQRLVLLVQKQVAERIRARPGHSSFSALSVRMQLLARCTTVCPVPPRCFQPPPKVQSEVIQIDPLPADKRLPSDIARRVESLLRQAFLARRKMLRNTLASLAPEPQLQALAAAAGFQLHQRPQELAPQVWVALARGLNQGIDAASADGHDHGDGSGQGESSPGGARDQI

SEQ ID NO: 10327 - protein, 250 aa, Oryza sativa
MHKLGRGSRDKVQQFMTITGASEKVALQALKASDWHLEGAFDFFYSQPQISLTNSRHLEDLYNRYKEPDVDMIMVEGVSQFCTDLQVDPQDIVMLVISWHMKAATMCEFTRQEFIGGLQSIGVDSIEKLREKLPSLRAEIKDDHKFREIYNFAFAWAREKGQKSLALETALGMWQLLFAERHWPLIDHWCQFLQVRHNKAISRDTWSQLLEFVKTIDPQLSNYDEEGAWPYLIDEFVEYLTENGFVQLRK

SEQ ID NO: 10328 - protein, 246 aa, Aspergillus nidulans FGSC A4
MVRIFITGSSDGIGQAAAKVLSEQGHSVVLHARNADRAASAQEAVPGAEAVLVGDLSSIAETKALAEEANKLPPFDTVIHNAGIGYGATASQEITADKISAVFAVNTLAPYILTCLMHKPKARLLYMSSDSHYGGDESLRNITQSHSYGNTKLHDVMLANAFSRRWGNAIQVVSMHPGWVRTKMGGVMAPGALDRPARVLADWAIGKGDLARLKSGTFFTTSGPESAHPGADNVQKQEELLRICLR

SEQ ID NO: 10329 - protein, 257 aa, Bacillus subtilis
MRTKKRTKEMLPIFDQKKVAFIGAGSMAEGMISGIVRANKIPKQNICVTNRSNTERLAELELQYGIKGASPNQICIEDMDVLILAMKPKDAESALSSLKTRIQPHQLILSVLAGITTSFIEQSLLNQQPVVRVMPNTSSMIGASATAIALGKYVSEDLQKLAEALLGCMGEVYTIQENQMDIFTGIAGSGPAYFYYLMEFIEKTGEEAGLDKQLSRSIGAQTLLGAAKMLMETGEQPEVLRDNITSPNGTTAAGLQA

SEQ ID NO: 10330 - protein, 382 aa, Oceanospirillum sp. MED92
MDYPSSKLPSVGLTIFSQMTALANQQKAINLSQGFPDFDGPKPLLDAVGRFIAEGKNQYAPMAGLPELCQAVSDKVFRCYGRKLEAESEVTITSGATEAIFAAISATVNAGDEVIVFDPAYDSYEPAVTLNGGTTVHIPLLPPQFAIDFQRLQDAITLRTRMIIFNSPHNPTGSVMSSEDLLQLEQLLEGTNILLLSDEVYEHIIFDNQVHQSFNRSPMLAERSFIVSSFGKTYHVTGWKVGYCVAPEALMKEFRKVHQYLTFSTSTPMQAAIAEYMQSDAEHDQNLPVFYQQKRDLMNERLSSSRFGIMPSPGTYFQLLDYTAISDLSDQEFVLWLLKEAGVATIPLSPFYKDGTQTGMVRLCFAKSSDTLEKAAEQLCRI

SEQ ID NO: 10331 - protein, 274 aa, Mycobacterium leprae
MGSDLLKPPLDPAALRAELIGTGLRWRQLDVVTQTGSTNADLLARAASGIDIDGAVLIAEHQTAGRGRHGRGWSASPRTQITMSIGVSIADVPVATWAWLSLATGVAVLDTVAPLIDVTGVDAGLKWPNDVLAGPPGSKGKLAGILAEVVRPVIVVGVGLNVTQAPKEVDGPGATSLLDLGVPAPDREQLVCWLLRELDARVGQWRSADPQLMADYRARSPIIGSRVRAELPGGKDVVGTVRGIDDQGRLCLKTEGPTKGQTVVISAGDVVHLR

SEQ ID NO: 10332 - protein, 744 aa, Haloquadratum walsbyi
MSGQTPHGGHHPGPPRFLSCSDCIVDPIFVDTEHGFDRDNLAPTISGQPNKDPENYDSDAFSWRVITRPPQSTATIEHALSPYDHRERYDHGLHNTAEFNPDEPGTYTIELKAPDTTHELTIHVFDSPGKHQKADDIADNASPPRISLDGYYDAEIESFVIESHPALAPNSEARDSDLIVEFLPHDASELDAEDINITEAKAQIPIRALSSPTNVYAAPFDGQCVGVRDQICLDPETKTVSLPNRPPDWLDNAVIYEIFTRSFAGTPGETTFETLSKRVSYLNSLGIDVVWLTPIVPAWSPTVDRAPGGPHGYSATNYFDIADDLGTLAEFETFVEECHDHDIRVCFDLVINHCGWPHTFFQDTVAKLDTDSDSDDISTFPDITSWNTNSKYFDWFDRQQRGNKHDAAPAQTSFFDVRYQPNLNFGNVALREHILASIEFWARRVDGFRCDIAWGVPHSFWVEVRERVRAQNSEFFLLDEAIPRKARFAASEFDCHFDTSGFMRSVHAVAQGKRSPTDLLADIAARRNDGFPQHTHLLNATENHDEARLTYQAMLAQRPAAEKIQRAAMAAAVMLPGIPMIYYGQERLITKHGQRREAAYPDDPTQSDDIESDPYKRAFINWSTLPTEHFAFYQRLIALYHDSPVFGVKSKLTRVAHRSETPTDVLVFARNAGMNEPKRVIIINFAEESRHVDLRTVVDTTDQFTGNDISVDTTPSEDIVTVNVETVAVLKTPSLLGQNVPPQS

SEQ ID NO: 10333 - protein, 101 aa, Arabidopsis thaliana
MGIKFSQGPSNTTIHNRSHQDGEDQRNETATKINHDKPQNQSSSFQIPLHYPKYTKSDYEKMPEWQLDRLLREYGLPVIGDSYEKRKFAIGAFLWSSENEH

SEQ ID NO: 10334 - protein, 316 aa, Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 10335 - protein, 217 aa, Shewanella oneidensis MR-1
MNQSLLAPFGTAIERVEAGLNALRQGLGVLVVDDEDRENEGDLIFAAESLTNAQMAMLIRECSGIVCLCLPDEKVKALALPPMVENNSSQYGTAFTVSIEAKVGVTTGVSAADRVTTIKTAIADHAKPSDLARPGHVYPLRAQPGGVLTRRGHTEGTIDLMQLAGLKPAGVLCEVTNPDGTMARLPEIIAFGALHNMPVLTIEDIVVYRKSLLANVG

SEQ ID NO: 10336 - protein, 243 aa, Crocosphaera watsonii WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 10337 - protein, 292 aa, Rhodococcus sp. RHA1
MTKWTASDIVDQSGRTFVVTGANSGLGEVAARALGKAGAHVVLACRNTHKGEVVARSIGDNAEVRRLDLSDLASVREFAAGVESVDVLVNNAGVMAVPQRTTADGFEMQIGTNHLGHFALTGLLLDKITDRVATMSSAAHQAGTIHLDDLNWERRKYNRWSAYGQSKLANLLFTYELQRRLSAAGSPVKAVAAHPGYASTNLQAHTESVQDKLMAVGNRIFAQSAEMGALPMLYAATAPDVIGGSYIGPDGLFEQRGHPKVVGSNKKSRDEHTAGALWSLSEDLTGVEFTFR

SEQ ID NO: 10338 - protein, 328 aa, Burkholderia thailandensis E264
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRRTRDGFEMQMGTNHLGHFALTGLLLPALRASHRARVVTMSSGFNRLGKIRLDNMLAERGYNKYRAYCDSKLANLMFTLELQRRFDHAGLSMRSIAAHPGYAATNLQFAGPVMENSSLGSFAMRLSNRLVAQPADVGALPAIHAATAVDIEGGAYIGPAHLCETRGYPANARIPHQARDVRMGKRLWEKSEQLTGVRYLDTPPPGSRRGASRYDATFRAL

SEQ ID NO: 10339 - protein, 101 aa, Brassica napus
  misc_feature (22)..(22): Xaa can be any naturally occurring amino acid
  misc_feature (43)..(43): Xaa can be any naturally occurring amino acid
  misc_feature (54)..(54): Xaa can be any naturally occurring amino acid
  misc_feature (68)..(68): Xaa can be any naturally occurring amino acid
  misc_feature (83)..(83): Xaa can be any naturally occurring amino acid
  misc_feature (85)..(85): Xaa can be any naturally occurring amino acid
  misc_feature (90)..(91): Xaa can be any naturally occurring amino acid
  unsure (1)..(101): unsure at all Xaa locations
KSVASAPSPSEGRKKKKEERSXDSAKTWIIVGSVVGGLILLGXLVCLVMRCRSXKKDEKIREMERAGXAGEALRMTQVGETRXPXATTTXXQPMLETEYAA

SEQ ID NO: 10340 - protein, 403 aa, Erythrobacter sp. NAP1
MSVQIEESPTTDGEVITNYTLNFGPQHPAAHGVLRMVMELDGEVIERVDPHVGLLHRGTEKLIEQKTYLQALPYFDRLDYCSPLCQEHSYVLAIEKLLNIEVPERAQYLRVLFAELTRICNHMLNIGAHVMDVGAMTPNLWVFELREDCLNFFERASGARMHSAWFRPGGVHQDVPEKLLVDIGDWLDNRFFQLFDDAMSLVMDNRIFKQRNVDIAVVSRDDAVAWGFSGPMIRAAGIPWDLRKSQPYDVYDRMEFDIPVGTNSDCYDRFMVRVQEVRESAKIIKQCLRDMPEGPIASTDGKVSPPKRGEMKQSMESLIHHFKLYTEGFHVPAGEVYVATESPKGEFGVYLVSDGTNKPYRCKIRPTAFSHLQAMDMMSKGHMLADATAILGAIDVVFGECDR

SEQ ID NO: 10341 - protein, 91 aa, Zea mays
  misc_feature (18)..(18): Xaa can be any naturally occurring amino acid
  unsure (1)..(91): unsure at all Xaa locations
GFYLKALILVYLERPFAXKQLAYLASKPFFHGLLDYIISGPVVAIVWEGKSVVTTGRKIIGATNPLASEPGTIRGDFAVHIVRNVIHCSDT

SEQ ID NO: 10342 - protein, 209 aa, Parvularcula bermudensis HTCC2503
MSFVSVEEAAKAVAAGRFVIICDDEGRENEGDLMIAAEFADADAVNFCTIHGRGLICCAVEPAIADRLGLQLMVPQKDNRSGFGTAFTVSVEAREGVTTGISAADRARTIEVLCDPKSTPEDLVSPGHMFPLRAHPEGTLGRGGQTEASVDLARIAGCRPAGVICEVMNEDGTMARRDDLMKVAAKHDIPMVTVEAIKAYRKAKKVEAA

SEQ ID NO: 10343 - protein, 369 aa, Thermoplasma volcanium GSS1
MVMEEWTEVNFGPQHPSMHGVLRLKVKLDGEIVKDVEPIIGYLHRNAEKICELQFYCDNMIYFDRMDYVAAMNMEIGYLEAAEKLLDVEPPGRAKWIRVMMGELNRIASHLVWLGAFGLDLGMLTPFFYCFKEREKILKIFTEVSGSRQQLNYMSIGGVYQDVTDEALDHIKQFITEFPKELNMIANLFVKNDIFLSRTKGVGILSKEMAIDYGVTGPMLRASGVEYDVRKAEPYLVYDKVNFDIPVSFKGDNLARFLVRIEEMRQSVKIIDQTIQKLPAGPYFNQKAKKPLMIRLRGQGEVYARTESPKGEFGVYIVGDGSLRPYRVRVRSPTFKNLSVLPALAKGQMIADLISIGGSIDLVFGEVDR

SEQ ID NO: 10344 - protein, 457 aa, Prochlorococcus marinus str. NATL2A
MVLTPLVSALNTHDVEVAETLIGVINFLMIFVAARTLAEILVRLSLPTIVGELLAGVLIGASGLHLLLPPSAHAELNQGFVSVISTLASVPKEAVPDIYFETFPSLQAVATLGLYALLFLTGLESELEELVAVGAQAFTVAMAGVILPFAFGTFGLMFIFQVDIIPAIFAGASMTATSIGITASVFGELGYLKTREGQIVIGAAVLDDILGIVILAVVVALATGGSLQIAPIVKLVLAATVFVFAAIALSRTAAPAFDWLLERLKAPGAVVVASFVILVLSCFVATAIGLEAALGAFAAGLILSSSKNNHAIQQSVLPLVSLFATIFFVLVGAGMDLSVINPLDPQSRSALIVAGFLFIVAIVGKIAAGWCFVIDKPTNRLVVGLGMMPRGEVGLIFLGLGTSAGLLTPSLEAAILLMVIGTTFLAPVLLRVVLKDKPPSGGNSIPDEIAADPVGLV

SEQ ID NO: 10345 - protein, 839 aa, Prochlorococcus marinus str. NATL2A
MSSSQSLDLRLPTPGCYADPVRAGMDADAVFDGMTEHLFFTLGKLATSASLRDLYMALSFAVRDRLMSRYLTSQETIRARPQKTVAYLSAEFLIGPQLNNNLLNLGIKKEAEEALKRFGIESLNEILEVEEEPGLGNGGLGRLAACYMESLASLQVPAVGYGIRYEFGIFNQLIRDGWQVEVTDKWLKGGWPWELPQPDEACLVGFGGQTESYTDDNGNYRSRWIPSEHAIGVPHDVPVLGYRVNSCDRLRLWRADATESFDFYAFNIGDYYGAVEEKVASETLSKVLYPNDGTDEGRRLRLKQQHFFVSCSLQDMLRSLEKRSIAVEEFPNHWTVQLNDTHPAIAVAELMRLLIDQHRLDWDKAWEITNRSVAYTNHTLLPEALEKWDLSLFKNLLPRHLELIYEINRRFLQQVRLKYPGNDLILRKLSIIDEEGGKAIRMAHLATIGAHHVNGVAALHSDLIKRQLLPEFAQLWPEKFTNVTNGVTPRRWVALANPELSKLLDKEIGPNWITNMDLLLELEKKENDSNFLDLFASAKLSGKRKLAGYIHRQTGVLVDPSSLFDVQVKRIHQYKRQHLNALQVIAQYLRIKNGITKNIAPRTVIFGGKAAPGYFMAKLMIRFINGIADVVNADPDMDGLLRVVFLPDYNVKLGEQVYPATDLSEQISTAGKEASGTGNMKFAMNGALTIGTLDGANVEIRDRVGAENFFLFGKTESEIMELRDQGYSPNSFIAESNELQETLKLIEVGHFSNGDSELFRPIINILTGNDPFFVMADFDDYLRAQDEVSKAWKKSKKWNRMALLNTARSGFFSSDRSIREYCQSIWKVKPLPVEISCEK

SEQ ID NO: 10346 - protein, 260 aa, Arabidopsis thaliana
MAEKEVVSASTLESKITEDHHDIWIRGAMEKSRSSNISVLKDRFIAAEDSALVSKDVAQKDIEILLRRVKTATALLTYLKSKATTVAAADLANLSLETDQLQDTIDEHDGTYVTEMLQHVETVTGVMESLARRAFIAESEAAIEKGKVVLSQEEIQRKVGQLENMSVKLEDMEKFALGTSSILCEMRQRVDDLVEETSRQKQRATENELELSRVRRDFESLKSYVTSLISVRETLVSSEKQFQTIERLFERCVLCTFHIF

SEQ ID NO: 10347 - protein, 539 aa, Yarrowia lipolytica CLIB122
MTPSSNLSLATNLRNASVLFSDLCLYQSAKWCIEALDGLQLDPQNPDSLAQARMDFYSQLGTETDKYLLGKMYFDTKEYDRCAYHLKDCKGSIPNFLRLYAQYMAGEKRREEEGQGVLASTDGVTTNNQLVSIIQECTKLLARFPQDPYLLYLYGVVMSKQNNYKEAIEVLVRSLVIQPYNWSCWMEILTCMSHIDGLDSIVKRLPKQLVTTKMFIVVCHQVFCQPLDLVQNFIEELETIFPQFHYLTIQKALLNYHNLGYAEAEQIFDHVINLDPHRLDDMDAYSNILYVMEKRSKLSFLAQLASCTDKFRPETCCIIANYYSLRTDHEKAITYYRRALTLNRNCLSAWTLMGHEFVELKNSHAAIESYRRAVDTNQNDYRAWYGLGQAYEVLDMHYYSLYYYQRATALKPMDPRMWQALSNCFEKLKRYDEAIKGYKRSLAVQDNDPTVFYRIAALYEKTGDQRMASKYMEACLGTELAEGVTDETAKARIWLARYEFDQGNFSSALRYAMEYTHGSPQDLEEARAIVKTIQEREAA

SEQ ID NO: 10348 - protein, 569 aa, Glycine max
MVKKSKKSKSKRVSLKKKYKVIRKVREHNRKKTKEAKKLRLSGKKKVEKDPGIPNDWPFKEQELKALEARRAKAIEELEQKKAERKERARKRKLGLLEDEDNSKLSDMDILKESNDFATVGKTRDSSDRAFYKDLVKVIEASDVLLEVLDARDPLGTRCVDIEKMVMKSGPDKRLVLLLNKIDLVPKEALPGPPLKKWLKYLREELPTVAFKCSTQQQRSNLSDCLGADTLLKLLKNYSRSHEIKKSITVGLIGLPNVGKSSLINSLKRSHVVNVGSTPGLTRSMQEVQLDKNVKLLDCPGVVMLKSQEYDASVALKNCKRIEKLDDPISPVKEIFKLCPPEQLVTHYKIGTFKFGDVDDFLLKIATVRGKLKKGGIVDINAAARIVLHDWNEGKIIYYTMPPNRDQGEPAEVKIVSEFSKEFNIDEVYKSESSYIGSLKSVDDLNAVEVPSSRPLNLDETMLEDETQIKPAEQGEGPGNLAVVDESMEDDVGKNKGNSEAGMQNEKLYAADGMLNTKMRRAEKKKRKKAKKAVASSDPVDGDYDFKVDYFQKGASMDDAEESKSERVT

SEQ ID NO: 10349 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 10350 - protein, 138 aa, Streptococcus agalactiae NEM316
MEQTFFMIKPDGVKRGFIGEVISRIERRGFSIDRLEVRHADADILKRHYAELTDRPFFPTLVDYMTSGPVIIEVISGEEVISTWRTMMGSTNPKDALPGTIRGDFAQAPSPNQATCNIVHGSDSPESATREIAIWFNN

SEQ ID NO: 10351 - protein, 440 aa, Chlamydophila pneumoniae CWL029
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAQDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 10352 - protein, 443 aa, Pyrococcus horikoshii OT3
MVRKVNIIKGNEGQGKRIKFVQLIFVDINGMPKGMEVPITRLEEAIEEGIAFDGSSVPGFQGIEDSDLVFKADPSTYVEVPWDNVARVYGYIYKDGKPYEADPRGVLRRTLERLEKLGIKVYIGPEPEFYLFKKNGSWELEIPDVGGYFDILTLDKAKDIKREIAEYMPYFGLTPEVLHHEVGKAQHEIDFRHDEALKTADNIVSFKYIVKAVAEMHGLYATFMPKPIYGMPGNGMHLHISLWKDGENIFKGEEGLSETALYFIGGLLKHAKALAAVTNPTVNSYKRLVPGYEAPVYISWGYKNRSALIRVPAFWGNGARIEYRCPDPSANSYLAFAAILMAGLDGIKHKIEPFAYVEENVYEMDEKRREEIGIDMLPENLGEALDELERDKVVKEALGGAYRNFVGYKRKEWEEYLDYLEAKNLPKDTKNVTEWELERYFFI

SEQ ID NO: 10353 - protein, 304 aa, Kineococcus radiotolerans SRS30216
MPTAGPYAPRLGMRAVTRRTSVSAMTVPTILLNDGREIPQLGFGVFQIEPGDTAQAVKTALDLGYRHIDTAQMYGNEAEVAQGIADSGVPRDEIWVTSKLNNGFHEPDAARKAVDDSVEKLRGPIDLYLIHWPLPTLYGGDFVSTWKVLEEARAAGKLRSIGVSNFQVNHLQRLAQEATVVPAVNQIEVHPYFGNEEVRRHCGEHQIGVEAWSPIAQGKVLDDPTVTAVANRLGKSPAQVVLRWHVERGDIVFPKSVTPSRMEENFALFDFELTEEDLALISALDKGEAGRTGPNPDTFDYVPS

SEQ ID NO: 10354 - protein, 98 aa, Glycine max
  misc_feature (39)..(39): Xaa can be any naturally occurring amino acid
  misc_feature (53)..(53): Xaa can be any naturally occurring amino acid
  misc_feature (74)..(74): Xaa can be any naturally occurring amino acid
  unsure (1)..(98): unsure at all Xaa locations
CLHHGLVDTDTSMVLAAYEYYRHDGVVRNVIDMYVGELXMIRFKHVLKVDQAXLDTVTPDIIGRVKIVISAYPXSFATLLRVDTFTFCANVQIDNRAY

SEQ ID NO: 10355 - protein, 231 aa, Chlamydophila pneumoniae CWL029
MEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGAIFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 10356 - protein, 278 aa, Platismatia glauca
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 10357 - protein, 485 aa, Prochlorococcus marinus str. NATL2A
MNITDHSIIPVILSGGSGTRLWPLSRESYPKQFLALDSRTKKTLLQKTYERLLGLEGLENPILICNEDHRFIVAEQFREINTDPQAIILEPVGRNTAPAIAVAALQAISLGKDPLLLILAADHLIENNVEFQRVIQSAKIYANQGSLVTFGIVPTSAETGYGYIETKEFPTKENQKIGLEINKFIEKPNKDIAEKLIKDSRYTWNSGMFLFKASTIISELKKFAPEILNYCKIALEKDIEDLDFLRLETESFKQCPKISIDVAVMEKTNLGIVLPLNVGWNDIGSWKSLWDISKKNNDGNYINGRIIAEKSKNCYLKSEQRLIVGIGIENLIVVDTNDAILVANRDQSQNIGNIVKNLTSTAFPEGKMHKKIYRPWGNYTTIVEGNRWLVKLIEVKPNASLSLQMHHHRAEHWVVVNGTALIEKNGEQQLLSENESTFIPLGCKHRLSNPGKMRLELIEVQSGTYLDEEDIIRFEDSYGRIKNQN

SEQ ID NO: 10358 - protein, 338 aa, Geobacter metallireducens GS-15
MSGELPRPDAIGSKEIDRKILEIFRSRDGGVVSGEELSRSLDVSRTAVWKHIKTLNGLGYRIEAVPSRGYRLVSTPDILTPAELSVGLNVARIGTSLVFVGETDSTNTLAYRLAEDGAVEGTVVIADAQNRGRGRLGRQWESPAGVNLYCSIILRPPIMPLHAPQLTFLSAVAVAEAIERSAGLAPVIKWPNDVLVNGFKVAGMLNEMSAETERIDFLVLGIGVNINMQRDQFPTDLRHPASSLAIEAGHEVSRLSFARALLESLDVHYSQYRSEGYAPLRQAWLGRSAVMGRRVRVSGNQGDMTGTVEGIDEIGALLLRTAHGTLERVLAGDVTIEG

SEQ ID NO: 10359 - protein, 1032 aa, Oryza sativa
  misc_feature (267)..(267): Xaa can be any naturally occurring amino acid
  misc_feature (335)..(335): Xaa can be any naturally occurring amino acid
  unsure (1)..(1032): unsure at all Xaa locations
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLDVVVADAKDFDYXAGDVCGVLVQYPGTEGEVLDYAEFVRDAHAHGVKVVMATDLLALTSLRPPGEIGADIAVGSAQRFGVXPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 10360 - protein, 335 aa, Parvularcula bermudensis HTCC2503
MTVKVGINGFGRIGRLALRSMLEHGRTDIEVVAINDLGPVETNAHLLQYDSVHGRLPMTVSTGDGKLTVDGKSIAVFAERDPKALPWGDHGVDVVMECTGIFTDRDKAAQHLAAGAKRVLISAPGKDADKTIVYGVNHDVLTADDHVVSNASCTTNCLSPVAKVLNDAIGIEKGMMTTIHSYTGDQPTLDTMHKDLYRARAAAMSMIPTSTGAAKAVGLVLPELNGKLDGFAMRVPTPNVSVVDLKFIAARDTSVEEINAAIREAADGPMKGILGYTLVKNVSTDFNHDSHSSIFHMDQTKVMDGSLVSVLSWYDNEWGFSTRMADTALAMAKFI

SEQ ID NO: 10361 - protein, 363 aa, Arabidopsis thaliana
MSLDKVLKTRLLKIQGNHKGFNLLNPAFVDFDICLDLITKEIPTFANQKAIFRTHSQKERVERVRAILSGRSIKNNRRTETTKPAGELRGEKNPAKKGNSNSSSVDHCFTSASRAFTQKKLADLKSLFFSLASKSQSNDQYVSYPVFQEYFGLSGSLGERIFDMVTQHRKDDKMTFEDLVIAKATYEKGTDDEIAEFIYQTLDVNGNGVLRRSDLESFLVVILKSVFSTESSDAESSDYKEMVDALLDAATFSKSDDGSEKGMSFEDFRSWCPLVPTIRKFLGSLLIPPGPVRPGYQVPDLLYEDSVSSDRLLLKKEYAWHIGGALPHHELVEWKLLYRSSLHGQSFNTFLGHTSGMEGSNMA

SEQ ID NO: 10362 - protein, 693 aa, Cryptococcus neoformans var. grubii
MGKGKNHDRKANPGFGKVKSKTGTSTGEFTLKRVKGENFYRDAKSASRVKMLNGGKAVRDRDGKIVEAAAFQKGEKEAEPGRVKPDRRWFGNTRVISQSALDHFRTALKEQKADPYSVLLKRNKLPMGFGSRKNRKQRPHIVETEPFGNTFGPKAQRKRPRLDIGKGNGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVEGGWHGEEGATFVLTAIAKKSGKLLKGGEPDQEAAAKMVLNDWIRGKVPFFVAPPTKPESGADAHVSSATTEKVQEQEQKELAEEKETKEMLEEQERSLGKVLGIKRVKGVEQPISKIVTMTKFLGDDARRYVEEEEVDVDDVDKEMAEEDEDEDEDDDDDVEESGEDQEEEELAWDDVFPEEAAGVDAADGEEVEEDDEEEEGDEDDEDVPSAKQLGKRKAIDSDEEEQTAIKAKRMTTNKQKASNFYTHANVKNRNRDRKVPKNPGKRSRGDDEPTGKKAKKRR

SEQ ID NO: 10363 - protein, 855 aa, Schizosaccharomyces pombe
MKRTRSEKTLSFLNPSRASSNTHLSREGTNRSSNVTRTVSGRKSNHGSSLTDTGESDQLSLKSFGAIRQPSQHRSSLFSRMLGSTSHIFGIREDMDNESSEEERDGIPRVEGNAADPFSWIPDGKNVWDSPPKYIRVLSHNKKEKSLDHLFLAQELYCKPTLAATHDRYYEPRATDFPNLAHESSEPSSSRHTADAQSITNASVHLHNSSSPLNRTPSVISDTLAVAITSNSSSNSSNNAIWAMKFSRDGRYLAVGGQDRILRIWAVLDSEHARSVASETCSSDPNNPKLNLKAPVFSEAPIREYAGHTADILDLSWSRNNFLLSSSMDKTARLWHPVRKDCLCCFEHSDFVTSIAFHPKDDRFFLSGSLDCKLRLWSIKEKAVSFWNELPELITAVAFSPDGGLAIAGTFVGLCLFYDTRGLRFRTQMSIRSSRGKNAKGSKVTGIQTRTQMIDNIAGDTEMLVTTNDSRIRIYNLRDKSLELKFKGHANAQSQNRAYFDDDGNYVICGSEDHQVFIWDLPPQHMHKTKKKKHEHFKASVRPITAAVFAPTKTKQLLTLSGDPVYLAAISARRSSVISNASIETGPSLRNLKSLSHSYLPIEIMKGHIIVCGDLDGRIRVFRQDSVFAARKLIEKKNIERKNSETLSNSSFFPQALKAHMNSISSPKRHFSLRHKKNASQITNNENNGNDDIKKGDEPEEEHVGLRKNSTQEKNANLDPNEALKRADMMMLQEGASSMVYYSLTNLDNPGATVNEAAKTAATIEQNEHEIQTSVDPISNVKAILPNADDVSSKNSSTEDQLECLRCGNSLFNVFSRSFVFEGAKFSIVCSHCNRKLLKSGSDDGSETHEMSTLP

SEQ ID NO: 10364 - protein, 172 aa, Brassica napus
MALFSAALPLLLLFLSVSSPSVSGNTAQSVECSAVIMTLTKCLPFVTIGSQVEKPETACCSVLKTVLDTKAECLCEGLKSSAAAGINLNLTKAGTLPDACQLKAPPMPACALFAKPPASAPAPVPAARPLNGSGPSSNSAPAPSPSHSNHGSSISVLSLAISGALVIMFARI

SEQ ID NO: 10365 - protein, 416 aa, Coccidioides immitis RS
MFDTVCSLPLSSDLFSQAIHPTEPLVSIGLSSGHVQTFHLPAPSENGKAGYGHIDTVWRTRRHKGSCRCVGFGIDGETLYSAGTDGWVKAARTETGRVEWKFAVPRIGDKSGFQVDSPCLIHALSPQTLLLATDSGALHLFDLRDRSTEVSARPQQTHHPHDDYVSSLTPLPPSETSTSGYSKQWITTGGTTIAVTDLRRGILVRSEDQGEELISSSYVTGLKAGGTSKGEKLVVGGASGVLTLWEKGAWDDQDERIIVDRSLDGGESLEVIANVPDELGKGKVVAVGQSDGRVQFVQLGPNKVISELSHDDLEGVVGLGFDVQGRMISGGGTVVKVWHEAISDEEGNDDESDEEDIENGEGLGKKRKGGNGSSDEEEDSDDDMAGKDKGKRKKRKRGKGKDRSGGVHVMAFKGLD

SEQ ID NO: 10366 - protein, 299 aa, Glycine max
  misc_feature (113)..(113): Xaa can be any naturally occurring amino acid
  misc_feature (146)..(146): Xaa can be any naturally occurring amino acid
  unsure (1)..(299): unsure at all Xaa locations
MHASSKMGEKYKPWIIFLHLLVITCSCNRSCRARGLIETEDKFFKATSNDHHETEHAHAHSHVDHIDPSVMVFFTIEDLKVGKTMPIHFPKRDPATSPKLWPREEADSLPFSXTNSQTLLKIFSVSQNSPQARPWKIPLRECETKXIKGEVKFCATSLESMLDFTQSILGFTSDLKVLSTSHQTKSSVTFQNYTMLENIIEIPASKMVACHTMPYPYTVFYCHSQESENKIYRVPLAGENGDRVDAMVVCHMDTSQWGHGHVSFQVLKVKPGTTSVCHFFPADHLIWVPKLQPQGFATM

SEQ ID NO: 10367 - protein, 527 aa, Oryza sativa
MHSTNLLLEEPIRMASILEPSKPSFFPAMTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 10368 - protein, 462 aa, Xanthomonas axonopodis pv. citri str. 306
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 10369 - protein, 636 aa, Neisseria polysaccharea
MLTPTQQVGLILQHLKTRILDIYTPEQRAGIEKSEDWRQFSRRMDTHFPKLMNELDSVYGNNEALLPMLEMLLAQAWQSYSQRSASLKNIDIERENNPDWILSNKQVGGVCYVDLFAGDLKGLKDKIPYFQELGLTYLHLMPLFKCPEGKSDGGYAVSSYRDVNPALGTIDDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTSWVNYVRSHDDIGWTFADEDAAYLGISGYDHRQFLNRFFVNRFDGSFARGVPFQYNPNTGDCRVSGTSAALAGLAQNDPHAVSRIKLLYSIALSTGGLPLIYLGDEVGTPNDDGWAQDGNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 10370 - protein, 790 aa, Escherichia coli
MFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLESGNPWEFKRHNTRYKVVFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDGTLGRNWRTDLSLLNELQQHCDFPMVNHAVHQANVENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 10371 - protein, 636 aa, Neisseria meningitidis
MLTPTQQVGLILQYLKTRILDIYTPEQRAGIEKSEDWRQFSRRMDTHFPKLMNELDSVYGNNEALLPMLEMLLAQAWQSYSQRSASLKNIDIERENNPDWILSNKQVGGVCYVDLFAGDLKGLKDKIHYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMMFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPNTGDCRVSGTSAALAGLAQNDPHAVSRIKLLYSIALSTGGLPLIYLGDEVGTPNDDGWVQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 10372 - protein, 229 aa, Oryza sativa
  misc_feature (66)..(66): Xaa can be any naturally occurring amino acid
  misc_feature (183)..(183): Xaa can be any naturally occurring amino acid
  unsure (1)..(229): unsure at all Xaa locations
EKLLSLYRVPTFTSVDDFLQKVATLRGKLKKGGIVDVEAAARIVLHDWNEGKIPYFTVPPKRDAVXDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRQEKSPRRRSARPNXKFSVLTDMDPDYDFKVDYQMKDAPAEDGNDGGDEEPKEADPMTGVD

SEQ ID NO: 10373 - protein, 500 aa, Streptococcus agalactiae NEM316
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGSDFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGLVESGDNIVIVAGVPVGTGGTNTMRVRTVK

SEQ ID NO: 10374 - protein, 278 aa, Sphaerophorus globosus
VEHGDVKVVAVNDPFIDPEYAAYMLKYDSTHGQFKGTIKVEGKDLIVNGQKVKFYTEKDPANIPWSETGAYYIVESTGVFTTTEKAKAHLKGGAKKVVISAPSADAPMFVMGVNEETYKSDIEVISNASCTTNCLAPLAKVMHDNFTIVEGLMTTIHSYTATQKTVDGPSAKDWRGGRTAAQNIIPSSTGAAKAVGKVIPSLNGKLTGMSMRVPTSNVSVVDLTCRIEKPASYALIKETIKKASEGELKGIMSYSEDDLVSSDLNGDNHSSIFDAKAG

SEQ ID NO: 10375 - protein, 275 aa, Stereocaulon cumulatum
  misc_feature (1)..(1): Xaa can be any naturally occurring amino acid
  misc_feature (5)..(5): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(19): Xaa can be any naturally occurring amino acid
  misc_feature (30)..(30): Xaa can be any naturally occurring amino acid
  unsure (1)..(275): unsure at all Xaa locations
XEHKXVKVVAVNXPXIEPXYAAYMLKYDSXHGQFKGTIEVEGSDLIVNGQRVKFYTEKDPANIPWKDTGAYYIVESTGVFTTTDKAKAHLKGGAKKVVISAPSADAPMYVMGVNQETYKSDVEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRIEKSVSYDEIKEVMKKASNGELKGIMSYSEDDLVSTDLNGDNHSCIFDA

SEQ ID NO: 10376 - protein, 141 aa, Chlamydia trachomatis D/UW-3/CX
MEQTLSIIKPDSVGKAHIGEIIAIFEKSGLRIAAMKMVHLSVKEAEGFYVVHKERPFFQELVDFMISGPVVVMVLQGENAVDRNRELMGATNPKEAAEGSIRALFGESIGVNAVHGSDSLENAAIEVSYFFAKTEIVNSVA

SEQ ID NO: 10377 - protein, 479 aa, Pseudomonas aeruginosa
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALGLQAEHGDAAVLVVMPADHLIRNEEAFREAVGHAARLAVAGHLVTFGVVPDAAETGFGYIELGDRLDEQGAAKVRRFVEKPDEETRRRYVESGGFLWNSGMFCFTASTLVDELAQHAPALLEQARACLAASAAVKMADGIQHELAGEGFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 10378 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 10379 - protein, 272 aa, Pseudomonas syringae pv. syringae B728a
MSKTRIAFVGAGNMAASLIGGLRAQGVEAALISASAPGAETRERIANDHGIQVFADNADAIKGVDVVVLAVKPQMMKTVCQALKSGLEPHQLIVSVAAGITCASLTQWLGEQPVVRCMPNTPSLLRQGASGLYATDNVTPEQREQAEALLAAVGIAVWVEQEKHMDAVTAVSGSGPAYFFLMMEAMTAAGVKLGLPEDIAKKLTLQTALGSALIATGSDAGAGELRRRVTSPGGTTEAAIKAFQAGGFEALVETALTAADHRAAELAEQLGK

SEQ ID NO: 10380 - protein, 408 aa, Candidatus Kuenenia stuttgartiensis
MQFNSIQEVIEDLRNGKMTILIDDESRENEGDLILAAEKVTPEAINFILTHARGILCLAINAKRAEELDFYPMVSNNTSSFQTPFTVSVDAAREISTGVSSKDRATTILTAIDDNATAEDFVRPGHIFPLKAHNGGVLVRAGHTEGAVDLTRIAGLKNAAVICEIMREDGNMAKLPDLKKFAEKNNLKICTIADIIKYRHEQERLIEKRVTAKLPTIYGEFILHLYRSFVDEYLHLALCLEVGSKDINTPSPMQNEPILVRVHDECLTSDVFGSLRCDCGEQLHNALKIIKENGKGVLLYMRQEGRGIGLENKLHAYHLQDKGLDTVEANEKLGLPVDKRDYGIGAQILRDLGITKMRLLSNNPKKFAALAGYGLEIVERVPIVVEPNAENQKYLRTKKEKLGHMIET

SEQ ID NO: 10381 - protein, 404 aa, Sinorhizobium meliloti
MTEVTELMRPEGEALNTKEVLLNLGPQHPSTHGVLRLVLQLDGEYVERVDPHIGYLHRGTEKLAESFTYTQIFPLTDRLDYLCPPSNNLAFALAVEKLLGIEAPIRAQYIRVMMAELARISGHLLITGALPMDLGAMTALLYAMREREMIMDLLEMITGARMHTSYCRVGGVREDLPDGFLPKIREFCEIFPNRIRDYERLIENNRVFLSRTQGVGVISATDAIDLGLSGPNLRASGVDWDIRRDEPYEIYDRLDFDVITREEGDCYSRWLCRVDEMRESIRLIEQCMEQMPEGAFQVDIPTIAFPVDKERVHCSMEALIQHFDLSAYGFDVPAGEVYSVIEAPKGELGFYIISDGSPKPFRMKVRAPSFVNLQALFGVTNARYLADMIAVLGSLDPVMAEVDK

SEQ ID NO: 10382 - protein, 447 aa, Candidatus Kuenenia stuttgartiensis
MDYISNTESDKKKMLEDMGISSLDALLGEIPEALRNFSLSLPPGLSEPEVLHAIKKLSKKNKTTDDYSSFLGAGAYDHFIPSVVNHLASRSEFYTCYTPYQPEVSQGTLQVMYEFQTLMCELTAMDVANASMYDGSTALAEAALLSIRHKEKNKIVCSSAIHPEYRQVMKTYLKGFNTEIVEINCPEGTTDMHQLEASLADNTAAVLVQSPNFFGCVEDMQEISAIAHKHDALFVACVNPISLGILMPPGEYNADIAVGEGQVLGNYLNYGGPYLGFFTVKNELLRKMPGRIAGETVDKAGRRCIVLTLQPREQHIRREKATSNICTNQALLALRACIYLCALGKKGIAEIGNLNIQKSHYAFERLCNLDIFEPVFHNPFFNEFVLKAKNDFRIASIIRRMQEKGIHCGIDISQYYPGMVNCMLLCVTETKTKESIDHLVNEFTKCT

SEQ ID NO: 10383 - protein, 470 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNIMTKKADEIQIYKYVVHNVVRNRFGKTATFMPKPMFGDNGSGMHCHMSLSKNGVNLFAGDKYAGLSEQALYYIGGVIKQPKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 10384 - protein, 273 aa, Ustilago maydis 521
MSISPFRYQILTKQNDYIEEHIRRHGRRLDHEERQRKRAAREVHKASAVAQKVTGLKAKMLNKKRRNEKIQMKKTLKAHEERDVKQASTSSDPNQALPTYLLDREGQKDAKALSSAVKERRKDKAARYSVPLPQVRGIAEDEAFKVIKTGKRKQKGWKRMVTKPTFVGESFTRKPPKLERFIRPMGLRYNKAHVTHPELKASFNLPIVGVKKNPQSPLYTQLGVLTKGTIIEVNVSELGMTTTTGKVVWGKYAQVTNNPENDGCVNAVLLLSS

SEQ ID NO: 10385 - protein, 472 aa, Thermobifida fusca YX
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 10386 - protein, 483 aa, Burkholderia sp. 383
MNEFLRTGHYIGGEWHESHGASDATYPVLNPATGETIAKVAKGGADDTQRAIDAAAHAFPAWRALTAKERGARVKRWGELMLENRDALAELLTREQGKPLAEARGEVVYAASFLEWFAEEAKRMYGDVIPSPKPNSQIVVTREPVGVVAAITPWNFPLAMITRKAGPALAAGCTMVLKPSEETPLSAFALAVLAERAGVPAGVFNVVSGDAVAIGETLTSSSVVRKLSFTGSTRVGKLLAKQSADTLKKLSLELGGNAPFIVFDDADLDAAVEGAIASKFRNTGQTCVCVNRFLVQDGVYDAFTRKLADAVRKLRVGNALAGEVDQGPLINEAALGKVERHVADATAKGAHALTGGKRHALGGTFYEPTVLTGMTADMLIAEEETFGPVAGCFRFATEEEAVAAANDTPFGLSAYFYTRDLGRAWRVSGALESGMVGVNDGIISTEVAPFGGVKQSGLGREGSKYGLDEYVELKYTLMAGLGR

SEQ ID NO: 10387 - protein, 413 aa, Synechocystis sp. PCC 6803
MYSPGYVATSSRQSDAGNRLFVYEVIGLSQSTMTDGLDYPIRRSGSTFITVPLKRMNQEMRRITRMGGKIVSIKPLEGDSPLPHTEGIAKPSQSEGSGSEAVANPAPESNKTMTTTPKEKKADDIPVNIYRPKTPYIGKVLENYPLVREGAIGTVQHLTFDLSAGDLRYLEGQSIGIIPPGKDDKGKPHKLRLYSIASTRHGDFGDDKTVSLCVRQLEYQNEAGETVQGVCSTYLCNIKEGDSIAITGPVGKEMLLPPDEDANIVMLATGTGIAPFRAFLWRMFKEQHEDYKFKGLAWLIFGIPKSENILYKDDLEKMAAEFPDNFRLTYAISREQQNAEGGRMYISTGLAENAEELWNLMQNPKTHTYMCGLKGMEPGIDEAFTALAEQNGKEWTTFQREMKKEHRWHVETY

SEQ ID NO: 10388 - protein, 219 aa, Zea mays
MSSSPWPSLLSSPLPSSATLFSKKPASLRPVSTSTVRFWKSGARTPQCTMLGTLTKPTDESVLKKLSTRQERKFGEEINQDLLYLISVQRVLHMEDFNESTPDTLNLKDVAVFRCSAWCLDPSAIPSSKELWIVEPPFAVEGDPAGKRVLVYTVNIAVSITLRQDGSDPVLRSEDPDDEDHSPRRRRLISPSHEFAQGHHVRGQRSERRSVHDRIGPRA

SEQ ID NO: 10389 - protein, 348 aa, Chromobacterium violaceum ATCC 12472
MKAVVWDGPQRLRLAMLPRPALLAPDDALLRVTHASTCGTDLHIYRGAVPGFEPGTVIGHEFVGEVAAVGAAVRRLRPGQRAACADFVACGECESCAAGRHAQCGERRLFGFSGLQPRLDGGLAEYVRVPRADVALSPLAAGADPRFGLLSGDVMPTALGALQRLALAPGERLAVVGAGPVGVLTAWLAARRGVEVLLLEASPARAARARGGGLAVAEIAVGQPLSDAAPGLAGVFDAAVDAVGGESGLKTALAALRPRGRLVGAGSQAGRFELDWGALMQREIALQFVIGDPIGLRGEVAAAMADCAPALDLMFSDRLRLDEVPDYFAALYRRERFKALVEVAGEAA

SEQ ID NO: 10390 - protein, 273 aa, Stereocaulon tomentosum
VEHKDVKVVAVNDPFIEPHYAAYMLKYDSQHGQFKGTIEVEGSDLVVNGQRVKFYTEKDPANIPWKDTGAYYIVESTGVFTTTDKAKAHLKGGAKKVVISAPSADAPMYVMGVNQETYKSDVEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRIEKSVTYDEIKEAMKKASSGELKGIMSYSEDDLVSTDLNGDNHSCIF

SEQ ID NO: 10391 - protein, 316 aa, Rhodococcus sp. RHA1
MTALDNRHFGFGDIPDQWGRTVLVTGANNGLGLHAATALAGAGATVLLACRNPQTGAAALTRIRKAGSDAEHHLIPLDLTDLASVRDAAQHACGVAPRIDVLINNAGLMAVPFGRTADGFELQIGTNHFGHFALTGQLLPALLGAPAPRVVTLASIAHRRGRIVLDDLNFDRRKYTRMGAYNQSKLANLLFSGELARRSAAAGLPLLSVATHPGIAATNLFDSMAPPIPGALAVTHLGLRMVGNDEKDGALGQLYAATMPDVRTDDYLGPNELFGVRGPVARSPRTGGARNTKLAAALWEKSVELTGVEYTQLVRA

SEQ ID NO: 10392 - protein, 260 aa, Corynebacterium diphtheriae
MARTPLIAGNWKMNLDHLQAVATVQKLAFALPKEYYEKVDVAVTVPFTDLRSVQTLIEGDKLAITYGAQDVSQHEAGAYTGEISAQMLAKLGCTWVVVGHSERREYHGESSELVAVKAKAALNQGISPIVCVGEPLEIREAGTHVEYVVEQTRASLAGLTADDLAKTVIAYEPVWAIGTGKVASAADAQEVCAAIRNLIIELAGKEVAEGLRILYGGSVKAETVAEIVGQPDVDGGLVGGASLDGEAFAKLAANAATVVD

SEQ ID NO: 10393 - protein, 334 aa, Corynebacterium diphtheriae
MTIRVGINGFGRIGRNFYRAITERGADIEVVAINDLTDNHTLSHLLKYDSILGRLGKEVSYDDESITVDGHRMVVTAERDPKNLKWGELNVDIVVESTGFFTDANAAKAHIEAGAKKVIISAPAKNEDATFVVGVNHTDYDPAKHNIISNASCTTNCLAPMAKVLDEKFGIVKGLMTTIHAYTGDQRLHDAPHRDLRRARAAAQNIVPTSTGAAKAVALVLPELKGKLDGFAMRVPVITGSATDLTFETTKEVSAEEINAAMKEAAEGELKGVLAYTEDPIVSTDIVTDAHASIFDAGLTKVIGNQVKVVSWYDNEWGYSNQLVSLTEYVGERL

SEQ ID NO: 10394 - protein, 364 aa, Tropheryma whipplei TW08/27
MDCSELYSVIPAGGIGSRLWPLSRAASPKFLHKLTGTETSLLRDTWDRLVPISGVDRIMVVIGSDHFDAVTSQLPELKGHNVILEPEPKDSTAAICLAAAILNTREPDVIIGSFPADHVIKTSPLFQQSVAQAVVAANEGYVVTIAITPTEPATQFGYILCGDSAGIKGAPQVLSVKRFVEKPSQKDADRYLSSGKYLWNAGMFIAKACVLLEQLEKARPDIHSLIIDIANSPDLDSALKKNWPKMPRIAIEYSVAEPCAAEGRMVTVPAKFEWNDAGDFSSIARLNSRGGSDLVILGETSRVLSDSATGIVVSQTDRIISVIGTKDIVVVDTPDSLLVTTKDDAKKVKQIVEALRLSGRDDVL

SEQ ID NO: 10395 - protein, 103 aa, Zea mays
MSASSSMTKKASSFVVAASMSAVEALKDQAGLCRWDYALRSLYNRAAAANKVVAGRAVPLSLSSSQTAGGSGSAAAAGRAARPRRSEEEKMHKAYHLVCWGPN

SEQ ID NO: 10396 - protein, 279 aa, Streptococcus pyogenes MGAS8232
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDHLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 10397 - protein, 506 aa, Carboxydothermus hydrogenoformans Z-2901
MSVLLTILDGWGIAETTYGNSIKEAGTPNFNRYWDNYPHTILEASGLAVGLPRGQMGNSEVGHLNMGAGRIVYQELTRITKEIEEGSFFQNRELLEAVNHAQKTGGNLHLMGLLSDGGVHSHIEHLFALLELCRREKFSRVFIHPFLDGRDVPPQNAREYIEALEARLKELGFGQIATVMGRYYAMDRDKRWERTEKAYRAMVFGEGFKVTEPEAAVALAYDRGETDEFVSPTVVLTSEGQPRGVVKEGDSIIFFNFRPDRARQITRAFVDDDFTGFNRKKIENLHFVCFTQYDKTIKAPVAFLPQTIENCLGEYLSKKQKKQLRIAETEKYAHVTFFFNGGVEKPYPGEERILIPSPKVATYDLKPEMSAYEVTEKLLEEMEKGYDLIVLNYANPDMVGHTGVFEAAVRAIKAVDECLGRVVDKFLSLGGTAIITADHGNAEKMLEEDGSPHTAHTTNPVPFILVGEKYRGIKLKEKGSLANVAPTILKILELEIPEEMTSEPLF

SEQ ID NO: 10398 - protein, 600 aa, Magnaporthe grisea 70-15
MADTKSSAEDVSPIERVNKADSAGTYFSEKKDALDQQSSHDKPTAEELVTLRRVASKIPLNIYSIAFIQLCERFSWYGTVIVYTNFIQMPMPEGSTTGAPLTRDGQPGVLGMGQQASTSITLTNMAIGACMPLLGAYIADQHLGRYKTICAALVVAILGHLVLVVAASPPVLAQGPSNALGALITGMLTVSLGAGGFLPNISPMIAEQIDTEKGPRVTVLPKTGERVIENPAVTINRVYNWFYLFINIGALVGQISMVYAEAYVGFWLSFLLPAIILCFCPSIMWWGRKRFKTRKPTGSALSKALRTFLLANKGRWHILPWVTYQRLNDGTFWENVKPSKFAPGTKPKWMTFDDAWVDELQRGFAACQVFLWYPIYWLSYGQMNNNLISQAATMKLDGVPNDLLTNLDPITLIILIPIFDFVIYPFLRKHKINFTPLKKITAGFLVGGAGMIWAAVVQNSIYSLSECGNMASGTTATGDQCPPATLSVWAQTGSYVLIALSEILASITSLEYAFSKAPKNMRSTVQAIAMFMTAISSALAVAFVPLSTDPLLVWNYGSTAVIAIVGGALFWWVFRELDSKEGELNELPEGKLFADRDEED

SEQ ID NO: 10399 - protein, 223 aa, Streptococcus agalactiae A909
MDELKKLAGVTAAKYVKNGMIVGLGTGSTAYFFVEEIGRRVKEEGLQVVGVTTSNRTTEQARGLAIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 10400 - protein, 720 aa, Cryptococcus neoformans var. grubii
MGKGKNHDRKANPGFGKVKSKSGTSTGEFTLKRVKGENFYRDAKSASRVKMLNGGKAVRDRDGKIVEAAAFQKGEKEAEPGRVKPDRRWFGNTRVISQSALDHFRTALKEQKADPYSVLLKRNKLPMGLLQDDTKDGGRRPHIVETEPFGNTFGPKAQRKRPRLDIGSIEELGESSAASAAAAAAETATAESQGNGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVEGGWHGEEGATFVLTAIAKKSGKLLKGGEPDQEAAAKMVLNDWIRGKVPFFVAPPTKPESGADAHVSSATTEKVQEQEQKELAEEKETKEMLEEQERSLGKVLGIKRVKGVEQPISKIVTMTKFLGDDARRYVEEEEVDVDDVDKEMAEEDEDEDEDDDDDVEESGEDQEEEELAWDDVFPEEAAGVDAADGEEVEEDDEEEEGDEDDEDVPSAKQLGKRKAIDSDEEEQTAIKAKRMTTNKQKASNFYTHANVKNRNRDRKVPKNPGKRSRGDDEPTGKKAKKRR

SEQ ID NO: 10401 - protein, 385 aa, Mycobacterium leprae
MEISGALLSQVGALLTTLAVLGAGARRYSLSPIPVYLMAGLSLGKGGIMPVSAADEFITTGAPIGIVLLLLTLGLEFSATEFASSLRRHLPSAGVDIILNATPGAVAGWLLGLDGVAVLALAGVTYISSSGVIARLLADLRRLGNRETPAVLSVLVLEDFAMAAYLPLFAVLAAGGSWLDAVVGMIVAVCALFAAFAASYHWGHHVGRLVAHPDSEQLLLRVLGVTLIVAAVAESLHASAAVGAFLVGLTLTGDTAERARKVLGPLRDLFAAIFFLAIGISVDPHKLLPMFPTALILATVTAVTKVATGILAARYDGVARRGQLRAGTALVARGEFSLIIIGLVGTSTPAVAALATAYVFIMAIAGPVLARYTPGSLPTSSGSAN

SEQ ID NO: 10402 - protein, 475 aa, Thermus thermophilus HB8
MEVKEAPTEALIGGAWRRLARRFPVVSPATGERVAEVADCGEEEAREALEEAVLAFPAWSRATAYERAQVLRRWYERILEHKEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYEEAAKTLKRVSLELGGGAPVLVFADADLDRAVEETLRAKFRNAGESCVAANRIFVQAEVAEAFAEAYARRVQALKVGDPLSEETDIGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSFGL

SEQ ID NO: 10403 - protein, 214 aa, Haemophilus somnus 2336
MNQSLLSQFGTSEERVKRAIEAFKRGNGVLVLDDEDRENEGDLIFPAETITVEQMAKLIRYGSGIVCLCITDELCQQLDLPPMVQNNTSINQTAFTVSIEAAQGVSTGVSAQDRVTTIQVAIADNAKPQDLSRPGHVFPLRAKKGGVLARRGHTEAAVDLASWAGHKPAGVICEITNDDGSMARTLEIVEFGKKFNYPVVTIEDLVRYSSSKVV

SEQ ID NO: 10404 - protein, 535 aa, Ashbya gossypii ATCC 10895
MGNSPSKDSPYAFQSTTQQAGAGSQQQSSLADENPNEPNDPDDSRLTPTHTKNISISKPRNSHVITSGVSAVAPTSVRRSPYYDLKIDVNMARALQPVSTSSDSFSSSSSSSSAASSSSTASSSTSLCAKPGETAAVPGHCGYGREHGFLSLKSSLSSSSDTALSSINVSGGGSLPTIAEERENSHIIARNSKATSAPSYSHMAKKSRIANPRSETPIVLKRNPHDPYNNDKLNIDDAIEKLLYIGDSRSYHSRDFPFHSWEVQLICATVREIFLEQPSLLRLQAPIKIVGDVHGQFTDLLRILKLSGVPDETNYLFLGDYVDRGKQSLETILLLLCYKIKYPDRFFMLRGNHESASVTKMYGFYDECKRRMSTKTWKQFVDVFNTLPFAAIVQDKIFCVHGGISPQLSNMRQIEKIARPTDIPEEGLLTDLLWSDPDPAVSDWSLNDRGVSYTFGKRNVYDFCANFKFDLIIRGHMVVEDGYEFFAKKKFVTIFSAPNYCGQFQNWGAVMSVTTGMMCSFELLKPHGLKDTRRK

SEQ ID NO: 10405 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 10406 - protein, 340 aa, Bradyrhizobium sp. BTAi1
MNLSALNTVALAMVTPGKGILAADESTGTIKKRFDAIAVESTAQNRRDYREMLFRSDGMTFISGVILYDETIRQNAADGTPLVKLIEQAGSIPGIKVDEGTQPLPGCPGETVTVGLDRLADRLAAYYALGARFAKWRAVIDLDKDRIPSMTAVHVNAHALGRYAALCQAAGLVPIVEPEVLMDGDHDIGRCFDVTRRVMNEVFRELRIQRVALEGMILKPNMVVSGQKCPVQAGVTEVADRTVQLLKECVPAAVPGVAFLSGGQSDAVATAHLDAINRRGPLPWMLTFSYGRALQAAPQRVWAGRTANVPAAQRAFSHRARMNALASRGQWTTERENEAA

SEQ ID NO: 10407 - protein, 480 aa, Oryza sativa
  misc_feature (56)..(56): Xaa can be any naturally occurring amino acid
  unsure (1)..(480): unsure at all Xaa locations
TTTQTTYRCDTRSRAKRYHPPIHGGLHLRHLLLHSHQARLLLLLLLKSQLRLLRQXSGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 10408 - protein, 460 aa, Kineococcus radiotolerans SRS30216
MGRTSTDASTGAPLSLQDLRHDITSGRIDTVLVAMTDMQGRLQGKRLTGRFFLDEVLEHGTEGCNYLLGVDVEMNTVDGYEITSWSRGYGDLLLRPDLSTLRRIPWHPATAMVLCDVLQLDDEPVRPSPRQVLRAQLQRLEGHGLRPLVATELEFNLLRVTYEEAHANGYRDLRPASTHNIDYSLLGTGRVEPVLRRIRNEMDGAGLYTESAKGECNLGQQEIGFRYADALTTCDQHSVFKLGAKEIAAQEGMSVTFMAKLDQREGNSCHIHLSLTDLDGSPVFAAGAGSEMAPVMRSFLAGQLAALRELTLLLAPNVNSYKRFADGSFAPTAVAWGYDNRTCALRVVGRGPSLRMENRVPGGDANPYLAVSALIAAGLHGIEEGLELEEVTTGNAYTGGAPRVPTTLLAAAELFAGSALARRAFGDDVVDHYARAAHVELEAFQTAVTDWERARGFERL

SEQ ID NO: 10409 - protein, 924 aa, Pisum sativum
MMELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 10410 - protein, 142 aa, Brassica napus
  misc_feature (139)..(139): Xaa can be any naturally occurring amino acid
  unsure (1)..(142): unsure at all Xaa locations
MENHSTGFWAAWILLLIGASNASIHDYKTEKFIPQANSRFFHGGSEGLYASNSQDLNTSSSSSDISLKGKSFVRFADVTFVRTMESASKQNPMQSTAGLVEAILLEVKDRDRIGGSFLKSNAICCTPDLADAGSCTLGXVII

SEQ ID NO: 10411 - protein, 471 aa, Arabidopsis thaliana
  misc_feature (81)..(81): Xaa can be any naturally occurring amino acid
  unsure (1)..(471): unsure at all Xaa locations
MAFSLLSPIPTSASLFFTLSAITASNNASSSSLSRLYSLYHPKGTLRTRTATSFFGASGNLRIVSMAENRQLVCRIGGGAXAELDDMDEGEIQRIGNEDEDDDEFIQVHANNSSAASPERWDVLGLGQAMVDFSGVVDDEFLKKLGLKKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 10412 - protein, 380 aa, Zea mays
  misc_feature (39)..(39): Xaa can be any naturally occurring amino acid
  unsure (1)..(380): unsure at all Xaa locations
MSIAAVSADGLLALADEAERRYDFSAAAACLESALRPPXRRSSPPTHPPRLKLLAHSHLAGAYAVLGAIASQKHVLHRGLGLLDSASASGLLQREPALLWTCNFQAQLGSVFTNDGDAASALSALSVGASAAAELGSPQLELFFAASELHVHLLCWEDSAAVENAVTRASLLWDALTAEQMEHWVGLFFYTQLLQTFYLLRICDYKAASQHVERLDTAVKSEMQRGRQITALANDLSTLERTLGQSGLKEREMLALSHKQRQLKGQLRALCGYDSLNDVLDYGDKLLLAPPLMHGEWLPRTAVFVLVDLMVVMVGRPKGIFKECGKRINSGLRLIHDELVKLGIVDGVISDGSTHSEWASASLYHSPACSQSTGLQTPAE

SEQ ID NO: 10413 - protein, 412 aa, Corynebacterium diphtheriae
MTLDSIERAIADIANGKPVVVVDSEDRENEGDLIFAADKATPELVAFMVRYSSGYICASLTSEECDRLQLPPMTSHNEDARGTAYAVTVDANTGTTGISATSRADTLRKLADSQFGPQDFTRPGHVVPLRAKAGGVLERAGHTEAAVDLARMAGLNPAGVLCEVVSEDDPTDMARAPELRRFADRHDLALISIEQLIEWRRRYELLVERAVSTQLPTEFGRFTAVGYRGIVDGVEHIALVAGDITSDEGKDVLLRVHSECLTGDVLGSRRCDCGPQLQASLRAISERGRGVVVYLRGHEGRGIGLLHKLQAYHLQDEGADTVDANKALGLPVDARNYSVAAHILRDLGVQSVCLLTNNPEKSLELERYGVKVTGREPVKVEVHEDNIRYLTTKRDRMNHDLPWIAEYKKEQS

SEQ ID NO: 10414 - protein, 126 aa, Arabidopsis thaliana
MTVKKVEIKVDINCGKCNSAIMEAVTEIEGVNHISLDEGNSILTVVGTMDPVCVATRLKKIKQKPVIISVGPPPKPPEPPKPPEPEKPKPPPAPEPPKHVCKPPYCNSCDVVSVTTYESGSGCTIL

SEQ ID NO: 10415 - protein, 181 aa, Arabidopsis thaliana
  misc_feature (130)..(130): Xaa can be any naturally occurring amino acid
  unsure (1)..(181): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLXGCTDSAQVLKEVEECKKEYPGAFIRIIGFDNTRQVQCISFICYKPPSFNDA

SEQ ID NO: 10416 - protein, 470 aa, Geobacter metallireducens GS-15
MTPQEVVSFAKENGALMVDFKFMDFVGTWQHISVPITEFSEDTFEEGQGFDGSSIRGWQPIHASDMILLPDPDTAKMDPFVAVPTLSLICNVFDPITKEDYTRDPRNIARKAEAYLKSTGIGEIAFFGPEAEFFIFDEVRYDSSSNQSFYMVDSVEGAWNSGREEFPNLGYKPRHKEGYFPLSPTDSQNDLRNEMVMELQKVGIRVECQHHEVATGGQAEIDMRFSSLVDMADQLQWFKYVIKNVAYRNSKTVTFMPKPLYGDNGSGMHCHQSIWKNGQNLFAGDKYGGLSQMALWYIGGIIKHAKALCAITNPTTNSYKRLVPGFEAPVNMAYSSRNRSASIRIPMLSTNPKAKRIEYRTPDPSCNGYLAFAAMLMAGLDGIENKIDPGQPLDKDIYGLSPEELKDIPSAPGTLEDALNALRDDHEFLLKGDVFTPDVIEKWIEYKMEAEVNPVRMRPVPLEFALYYDI

SEQ ID NO: 10417 - protein, 970 aa, Brassica juncea
MPDSVRSMKMNMKSFLKKLHITPNQPDEAADGSSIPTNKSSDVSSSPHHQSPEVKPFSGLSNWLSSVGHRKSPSPPNSLNATNGGDDEQQQDSKEDPEVEEEYQIQLALELSAREDPEAAQIEAMKQFSLGSCAPDNSPAELVAYRYWNYNCLGYDDKILDGFYDLYGVLNASSAEKIPPLLDLQGTPVSDGVTWEAVLVNRSGDYNLLRVEQMGIDIAAKTESVSSSSFVNSELVRKLAVLVGDYMGGPVVDPDSMLRAWRSLSYSLKATLGSMVLPLGSLTIGLARHRALLFKVLCDSVGVPCRIVKGQQYTGSEDVAMNYIKTDDGREYIVDLMGDPGTLIPADAAGLQIDYDEPVCSTSPGDNDSFHDASSTNGIESSFQENIEFPPGEHSSSTKSSKEDVAKVEKAPPVQNLSSRPIHSFTHMRSPSWTEGVSSPAARRMKVKDVSQYMIDAAKENPRLAQKLHDVLLESGVVAPPNLFSEVYPQQLDATVEIKNLTEAKKEKETAQQGRHQNDLGPVRFLPPLPRLHSKADTHDQQHDHGKVVSQSDSSHSEASSTEYARTVPAAVAAAAVVASSMVAAAAAKTANTESSTLELPAAAAATATAAAVVATAAAVSRHLELGSNSDGDAGSGGHEPQGSGDSPHGPNSGGDRVSDRSTGDESSKSDGTLDDVSDCEILWEEITLGERIGLGSYGEVYRGDWHGTEVAAKKFLDQDLTGEALEEFRSEVQIMKKLRHPNIVLFMGAVTRPPNLSIITEFLPRGSLYRLIHRPNNQLDERRRLRMALDAARGMNYLHSCSPMIVHRDLKSPNLLVDKNWVVKVCDFGLSRMKNSTYLSSKSTAGTAEWMAPEVLRNEPADEKCDVYSYGVILWELFTLQQPWGRMNAMQVVGAVGFQHRRLDIPDFVDPAIAELISKCWQTDSKLRPSFAEIMVTLKKLQRPATGSNIPRPVPSSSSLSTEQEQKDC

SEQ ID NO: 10418 - protein, 142 aa, Dehalococcoides sp. BAV1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGIDIEQNTVHGSDSAENAKHEISLFFSESELVNYDRR

SEQ ID NO: 10419 - protein, 274 aa, Acinetobacter sp. ADP1
MEVFMYQINALNPKEEGHKARKRFGQNFLHDQRVIAKIVRSVNPRPGDNVVEIGPGLAALTSPLIGECDALTVVELDRDLAAGLPDRVPHPERLTIVEADALKYDFSQLATQESPLRVVGNLPYNISTPLLFHLLEFGDKVKDMHFMLQKEVVDRITAEPNTKEYGRLSVMIQYFCQPTFLFEVPAGAFNPPPKVTSAVFRLVPYKEKPIVAKDEKALSRLVGHVFTQRRKTLRNSLKGMLADDAFDKAGIDPMARPETLTLAQFVALSDQMVP

SEQ ID NO: 10420 - protein, 140 aa, Arabidopsis thaliana
  misc_feature (39)..(39): Xaa can be any naturally occurring amino acid
  misc_feature (121)..(121): Xaa can be any naturally occurring amino acid
  unsure (1)..(140): unsure at all Xaa locations
SVIPGGEHGIDRTYDVAEKVWAEVFFYLAQNNVMFEGIXPPAVPGIMFLSGGQSELEATLNLNAMNQAPNPWHVSFSYARALQNTCLKTWGGKEENVKAAQDILLARAKANSLAQLGKYTXGEGESEEAKEGMFVKGYPY

SEQ ID NO: 10421 - protein, 241 aa, Magnaporthe grisea 70-15
MASPDSQPKPKPSSNGATTGDPAIKLGHQQRQKIFTPPNFALLLCLLLSLVNFYHLQKPGRASVIYVQEPSTPIPPTIYKNTAKMSTEQTFIAIKPDGVQRGLVGPIISRFEQRGYKLVAIKLVTPGKAHLEQHYADLKDKPFFAGLVEYQPADMNSGPIAAMVWEGRDAVKTGRTLLGATNPLASAPGTIRGDYAIDVGRNVCHGSDSVENAKKEIALWFKEGEVVSYQASQASWIYEKP

SEQ ID NO: 10422 - protein, 500 aa, Leifsonia xyli subsp. xyli str. CTCB07
MSEQNREPAETSEESALQPTAAMRRKVTGLALAAAVGGFLFGFDSSVINGAVDSIQRNFALNAFVTGFIVAIAFFGCAVGAFVAGRLADRWGRLRVMLLGAVLFLISSVGAGLAFSVWDLGLWRIVGGLGIGIASVVAPAYIAEISPRQSRGRLGSLQQLAITLGIFVALLSDALLAGIAGSASSQLWLGLEAWRWMFLVGVIPSVVYGVLALTLPESPRYLLTTGRHKDARAIFSTMVPEGDVDRQVRDIERVIEEDKEGRRGTLAGNRFGLKPIVWIGVILSVFQQFVGINVIFYYSTTLWRAVGFTESNSLLITVITSVTNVVVTIVAILLVDRVGRRPILLTGSVGMALALGVMALSFTFAVKQDGAVSLPSPWGPLALVAANVFVVCFGASWGPLVWVLLGEIFPSRIRGKALGVAAAAQWIANFLVTVSFPPMSDFSLPFTYGMYAVFAALSWFFVFFKIPETNGMALEHAETLFQEAGGRRRGIQVRSSGDSV

SEQ ID NO: 10423 - protein, 558 aa, Oryza sativa
MAETRRWELAAHRRLEKGKVVGVVVLDGWGEAAPDTFNCIHVADTPTLDALKKGGPERWRVIKAHGTAVGLPTDDDMGNSEVGHNALGAGQIYAQGAKLVDMALASGKIYEGEGFKYIQQSFENGTLHLIGLLSDGGVHSRIDQLQLLLKGASEHGAKRIRVHILTDGRDVLDGSSVKFVELIENDLAKLRDKGVDARIASGGGRMYVTMDRYENDWQVVKRGWDAQVLGEAPHKFQNALEAVKKLREDPKANDQYLPPFVIVDERGRPIGPIMDGDAVVTFNFRADRMVMLAKALEYESFDKFDRVRFPKIRYAGMLQYDGELKLPSHFLVAPPEIERTSGEYLARNGIRTYACSETVKFGHVTFFWNGNRSGYFHPNLEKYEEIPSDIGIPFNEQPKMKAVEIAKKTRDAILSRKFDQVRVNIANGDMVGHTGDIEATIVGCKAADEAVKIVLDAIEQVGGIFVVTADHGNAEDMVKRDKSGKPLRDKDGNVQPLTSHTLNPVPIAIGGPGLQPGVRFRSDLPSAGLANVAATVMNLHGFEAPDHYEPTLIEVVDK

SEQ ID NO: 10424 - protein, 154 aa, Arabidopsis thaliana
  misc_feature (100)..(100): Xaa can be any naturally occurring amino acid
  misc_feature (113)..(113): Xaa can be any naturally occurring amino acid
  misc_feature (134)..(135): Xaa can be any naturally occurring amino acid
  misc_feature (138)..(139): Xaa can be any naturally occurring amino acid
  misc_feature (146)..(147): Xaa can be any naturally occurring amino acid
  misc_feature (151)..(151): Xaa can be any naturally occurring amino acid
  unsure (1)..(154): unsure at all Xaa locations
MSTALINSITYFLSEHPYIVGFRWSNSQSWGSTWSFLFTSISLYIAVSSSLHILLSAVRRSNRSVPLGHIPEIHSLLMSILSATIFAGILLSAAAEIRDXRWLWRRRKPAILXKWVLCFPFRDSSSGGVSFGKXXFYXXGFFPNFXXFLAXLAG

SEQ ID NO: 10425 - protein, 341 aa, Colwellia psychrerythraea 34H
MKSLAKLKAEPGIWLTRTEKPKLGHNDLLIKIKKTAICGTDIHIYNWDEWAQKTVPTPMVVGHEYAGEVVGIGQEVKGFTLGDRVSGEGHITCGHCRNCRGGRTHLCRNTVGVGVNRAGSFAEYLVIPAYNAFKLPDEISDDLASIFDPFGNAVHTALSFDLVGEDVLITGAGPIGIMAAAVAKHVGARHVVITDINEYRLDLARKMGATRAVDVSKESLKDVMTDLGMTEGFDVGMEMSGVPMAFTSMLESMNNGGKIAMLGIPGSDMAIDWSQVIFKGLTIKGIYGREMFETWYKMASLIQSGLDLTPIITHHYNIDDFQQGFDMMRSGQSGKVILDWT

SEQ ID NO: 10426 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESGKA

SEQ ID NO: 10427 - protein, 641 aa, Ashbya gossypii ATCC 10895
MPLKKEPVKKWKQPVGPKPIQRKNKNTIGLGKAIQNARSKENAIEYLPDGEMRFTVDKHEANWVKLRSVTQESSLDAFLSTAELAEKDFTADRHSNVKIIRMDAGADVATSHGIMLSNQQRAALNEKQRAHSAELIVPRRPYWDEEMTRFELERQEKEAFLNWRRKLATLQEENDDLLLTPFERNIEVWRQLWRVVERSDLVVQIVDARDPLLFRSTDLEEYVKELDERKQNLLLVNKADLLTTKQRIIWAKYFIAKGIAFTFFSARRANELLELQKELGEDYVQREEQDEPVAMVDGETVDAEVLERIRILKIEELEDLFLSKAPSEPLQEPRPGHEPLIQIGLVGYPNVGKSSTINALVGAKKVSVSSTPGKTKHFQTIKLSDRVMLCDCPGLVFPNFAYNKGELVCNGVLPIDQLRDYIGPSTLVAERIPKYFLEAVYGIHIETRSEEEGGGEHPSAQELLVAYARARGYMTQGFGSADEPRAARYILKDYVNGKLLYINPPPHLEDDTPYTREECKEFNKALYTLQNLPESRREQLLEAAKNKGITSLDLARDLSKLTFSSHIGGDSLTQAKSVTHGGKQAALYNAAKDLDREFFQLNGIQGKLTKPFHQANAQQGIGKKHNKKNKKGKKKAAMFSD

SEQ ID NO: 10428 - protein, 335 aa, Zea mays
  misc_feature (142)..(142): Xaa can be any naturally occurring amino acid
  misc_feature (159)..(159): Xaa can be any naturally occurring amino acid
  unsure (1)..(335): unsure at all Xaa locations
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAXKWRAVLKIGPNEPSQLXPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 10429 - protein, 473 aa, Synechococcus elongatus PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKPLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDPGEPLDVDIYDLSPEELAKIPSTPGSLKDALKALEADHDFLTVGGVFTEDFIQNWIEYKLDNEVIPISLRPHPYEFALYYDC

SEQ ID NO: 10430 - protein, 320 aa, Glycine max
MGTSVQVTPLCGVYNENPLSYLVSIDGFNFLVDCGWNDHFDPSHLQPLARVASTIDAVLLSHADTLHLGALPYAMKQLGLSAPVYSTEPVYRLGLLTMYDQYLSRKQVSEFDLFTLDDIDSSFQSVTRLTYSQNHHFSGKGEGIVIAPHVAGHLLGGTIWKITKDGEDVIYAVDFNHRKERHLNGTVLGSFVRPAVLITDAYNALNNQPYRRQNDKEFGDILKKTLREGGNVLLPVDTVGRVLELILMLESYWADENLNYPIYFLTYVASSTIDYVKSFLEWMSDTIAKSFEKTRENIFLLKYVTLLINKTELDNAPDGP

SEQ ID NO: 10431 - protein, 313 aa, Wolbachia endosymbiont of Drosophila simulans
YSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 10432 - protein, 535 aa, Coccidioides immitis RS
MSRNDRNTSSYMASSLSHLSNRMKLEWTSKLSTEYQPAKNYRRTSIICTIGPKTNSVETINILRKAGLNVVRMNFSHGTHEYHQSVIDNAKEAERIQPGRPLAIALDTKGPEIRTGLTPDNKDIPISAGTELNITTHDDFAAKSDNKNLYVDYKNITKVIEKGKLIFVDDGVLSFEVLGIVDDQTLRVKCLNNGTISSKKGVNLPGTDVDLPALSEKDIDDIKFGVKNRVDMIFASFIRRGDDIKRIREVLGDEGHEIQIIAKIENQQGVNNFDEILDQADGVMVARGDLGIEIPAPKVFIAQKMMIAKCNIKGKPVICATQMLESMTYNPRPTRAEVSDVANAVLDGADCVMLSGETAKGNYPKEAVAMMHETCLQAEVAIPYFSVFDELRNLCPRPADTVESIAMAAVSASLELNAGAILVLTTSGLTARLLSKYRPVCPIIMVTRNEAAARYSHLYRGVYPFFFPEKKPDFNIRIWQEDVDRRLKWGIAQALTLEVISKGDSVVCVQGWRGGQGHTNTIRVVPAEPNLGLAE

SEQ ID NO: 10433 - protein, 279 aa, Bradyrhizobium sp. BTAi1
MTGSGSMTSVSELQHTTGPIVLAGAGKMGGAMLTGWLAGGLDPARVVVIEPMPSAEITALAARGIRLNPAAPTPAEVVIVAVKPQMFREAGPALKPWVADTTLVLSIMAGTTIASLQNVVGGAVVRAMPNTPAAIGRGITVAVPASDVSAAQRALTDALLRATGAVEWVDDEALMDAVTAVSGSGPAYVFLLAEELARAGIAAGLPEALATRLARDTVSGAGELLHRSELSSATLRQNVTSPGGTTAAALSVLMGPDGFQPLLERAVAAATARSKELAT

SEQ ID NO: 10434 - protein, 469 aa, Blastopirellula marina DSM 3645
MTPKEVLALCREKDVKAVDFRFMDFPGMWQHTTIPVGKLVEDIFEDGLGFDGSSIRGWQAINESDMLIVPQADTAFIDPFCTLPTLVLICNIQDPITREDYSRDPRNVARKAVNYLRSTGIADRAFFGPEAEFFVFDDVRFDQNSHQGFYFLDSCEGEWNRGRDEGPNLGYKLRHKEGYFPVPPSDQMMDIRNEMMQTMIECGLDVECQHHEVATGGQCEIDLKFQEMVKMADQMLIYKYIVKNVAKKYGKTATFMPKPMFGDNGSGMHTHISFWKDDTLMAGSGYAGLSETALYMIGGILKHAPALLAFTNPTTNSYKRLVPGYEAPVNLAYSQRNRSASCRIPMYSPSPKAKRIEFRCPDPSCNPYLAFAALTMAAIDGIQNKLDPGDPLDKDIYDLPPEEMAAVPKTPGSLEDALVALQDDHDFLLKGDVFTQDVVDTWIHYKKKNEADAIRLRPHPYEFCMYYDI

SEQ ID NO: 10435 - protein, 643 aa, Zea mays
MKSTVFSAAVVSIGYALLGWDFAALSEANNHMEKEFELLNGPSIEGITLAASTFGAIVITIFSGALLDWLGRRVILVYSSLVLFSGGVLMLWSPNIYIVLLASWRIMIGAIFAPSIVYFALLVYYLPESPRWLASDGKISEARVSLQWLRGKKHDVSGEIAAIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGEANNGDGLRASLLSQAANVEVNDTNTSFTSEGSSSYLRRHGTSVLAQEFMASIHDYDIEEEEEEIHRFALPHQSAPRDMESTGRHPFRHQIVRLSETADMKFKWRVLLQPGIRHALCYGMLIQALQQVRLCVIVDYVFNSAWSSVYLRTGYHVYRMLVSLLTRSFLLVSCLLFSKIQSTGISGLLRCAPEIFEQSGVASLFSDIGLSPHSTSILMSTLNALLILPCITAAMLLMDVCGRRVLVLATTPVLILSLSVMSMSTLVNMGPFESAVLFHFALTICFWSYVIGLGPIPNILCSEIFPTKARATCASFCSLSFWFGGLLSAYCFPVMLSTIGLGGACGIYALVCCAPLFLVYYRIPETKMLNLELIAELFKLSRQEYVQ

SEQ ID NO: 10436 - protein, 409 aa, Methanopyrus kandleri AV19
MKRRRREIQSNVQVVDVETGEIEPISHRVPVGPNHPILKEPLRIKLAVRGEEVVDCKVEMGYCHRGIEKIMEGMPWQKAAFLAERVCGICSHAHNMCFIGGVEKLAEGDPAPRGLFLRVLVQELDRIQSHLIANAAYFYSIEHETMFVWNMNTRERVLDCIEEITGNRILTGWNVVGGVRMDVTEDQLNNVLETLDAIRDDVITYRRIAKNDPFIKLRSRGVGVITKDHIRKYRVVGPQARASGVPESDMRLQEPVYPELGFKPVYRKEGDNLARILVRYDECLQSIELIERIVDELPEGRHRRELEVNAGHVDNRVEAPRGELVYDMELAPGGVVKRVTIRTPSVPNIRVLEAIAPGSPSIADAVATYASLDPCVACNERFVVIDEREGKVLLEGKAREVIRACSRTS

SEQ ID NO: 10437 - protein, 1003 aa, Vicia faba var. minor
MASMTMRFHPNSTAVTESVPRRGSVYGFIGYRSSSLFVRTNVIKYRSVKRNLEFRRRSAFSVKCGSGNEAKQKVKDQEVQQEAKTSPSSFAPDTTSIVSSIKYHAEFTPLFSPEKFELPQAFIATAQSVRDALIINWNATYDYYEKLNVKQAYYLSMEFLQGRALLNAIGNLELTGPYAEALSQLSYKLEDVAHQEPDAALGNGGLGRLASCFLDSLATLNYPAWGYGLRYKYGLFKQRITKDGQEEVAEDWLEMGNPWEIVRNDVSYPVRFYGKVVSGSDGKKHWVGGEDIKAVAHDVPIPGYKTRSTINLRLWSTKAASEEFDLNAFNSGRHTEASEALANAEKICYILYPGDESIEGKTLRLKQQYTLCSASLQDIIARFERRSGASVNWEDFPEKVAVQMNDTHPTLCIPELMRILIDIKGLSWKDAWNITQRTVAYTNHTVLPEALEKWSMDLMEKLLPRHVEIIEMIDEELIRTIIAEYGTADSDLLDKKLKEMRILENVELPAEFADILVKTKEATDISSEEVQISKEGGEEEETSKEGGEEEEEKEVGGGREEGDDGKEDEVEKAIAEKDGTVKSSIGDKKKKLPEPVPVPPKLVRMANLCVVGGHAVNGVAEIHSEIVKDDVFNAFYKLWPEKFQNKTNGVTPRRWIRFCNPDLSKIITQWIGTEDWILNTEKLAELRKFADNEDLQTQWREAKRNNKVKVAAFLRERTGYSVSPDSMFDIQVKRIHEYKRQLLNIFGIVYRYKKMKEMNAAERKENFVPRVCIFGGKAFATYVQAKRIVKFITDVGATVNHDPEIGDLLKVIFVPDYNVSVAEMLIPASELSQHISTAGMEASGTSNMKFAMNGCLQIGTLDGANVEIREEVGADNFFLFGAKAREIVGLRKERARGKFVPDPRFEEVKKFVRSGVFGSYNYDELIGSLEGNEGFGRADYFLVGQDFPSYLECQEEVDKAYRDQKKWTRMSILNTAGSSKFSSDRTIHEYAREIWNIEPVKLE

SEQ ID NO: 10438 - protein, 359 aa, Zea mays
LSLPSCSATTASNGRRPVRQGRSDGTRRTPTGAGGMPGDAYDLLCAEDDAAGSALLCTTDDDDGCCSAVEEDSAAAAASIAELIGGEAQYSPRPDYPDRLRSRSIDPAARAESVAWILKVQEYYGFLPLTAYLAVNYMDRFLSLHRLPQEDGWAMQLLAVTCLSLAAKMEETLVPSLLDLQVEGTSRYDCFEPGTVGRMELLVLMALNWRLRSVTPFTFVDFFACKVDPGGRHTRCLIARATQVILAAMHDVEFLDHCPSSMAAAAVLCAIGETPSLESVSPGAAVSWCIGLAEEGISSCYRLMQRLVIGNVRTRVASTTTITMAAVNLCCSDEALSSHSSATSSPPPAKRRKRSPTAT

SEQ ID NO: 10439 - protein, 216 aa, Zea mays
  misc_feature (167)..(167): Xaa can be any naturally occurring amino acid
  misc_feature (183)..(183): Xaa can be any naturally occurring amino acid
  unsure (1)..(216): unsure at all Xaa locations
MSSSRMLPIVEPEILVDGPHDIDRCAYVTETVLAACYKALNEHHVLLEGTLLKPNMVTPGSDSKKVTPEVIAQYAVRTLQRTVPAAVPAVVFLSGGQSEEEATLNLNAMNKLSTKKPWALSFSFGRALQASTLKAWAGKVENVEKARAAFLARCKANSEATLGTYKXDAAADTESLHVKDYKXLSCFSLRSPVFWNSCLRVGWLSGLLVRAFIIRT

SEQ ID NO: 10440 - protein, 489 aa, Acidobacteria bacterium Ellin345
MCHGSLPCNERMDYTQASASQTLTAANPASNKPEKPTLVRGMSFLDAVLLLVGGIIGSGLFLTSSDVAKTTYTPLIFMSAWIVGGIVSLLACLSVAELGSMFPEAGGQYVYLREAYGDFPAFLYGWMIFSVNVTGSNATIAAGFAAYAGAIIAPLNATRPIFSIGAWTFNMGHATAISAIVFLTWINVVGLRPAVILQNIATWAKFIAIAGFLVLGFLIGHGSWHNATQPIPGHVGFLSLASGFGVALIAVFWVYDGWVYATWVAGEIKDPQRNVPRSLIYGIAIVAAVILAVNVLYLYAMPMQQMAMQDTVGQAAAQILFFPAIGRWFSALVAIACFGAAACSILSGARVYYAMAADGLFFQKLAEVHPRWRTPAFSLIVQCIWSCALVLTGRYDQLFTFVMFISVIAYAAAASSIFVLRRKRPDMPRPYKCPGYPWVPLAYCVICGAWALNALWSKPFESLAGVGIMLIGAPAYIYWHRAKRKPAVL

SEQ ID NO: 10441 - protein, 92 aa, Triticum aestivum
  misc_feature (14)..(14): Xaa can be any naturally occurring amino acid
  misc_feature (73)..(73): Xaa can be any naturally occurring amino acid
  unsure (1)..(92): unsure at all Xaa locations
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 10442 - protein, 448 aa, Streptococcus pneumoniae R6
MPITAADIRREVKEKNVTFIRLMFSDILGTMKNVEIPATDEQLDKVLSNKVMFDGSSIEGFVRINESDMYLYPDLDTWTVFPWGDENGSVAGLICDVYTTEGEPFAGDPRGNLKRALRHMEEVGFKSFNLGPEPEFFLFKLDENGDPTLEVNDKGGYFDLAPTDLADNTRREIVNVLTKMGFEVEASHHEVAVGQHEIDFKYDEVLRACDKIQIFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 10443 - protein, 514 aa, Vicia sativa
MFQFHLEVLLPYLLPLLLLILPTTIFFLTKPNNKVSSTSTNNNIITLPKSYPLIGSYLSFRKNLHRRIQWLSDIVQISPSATFQLDGTLGKRQIITGNPSTVQHILKNQFSNYQKGTTFTNTLSDFLGTGIFNTNGPNWKFQRQVASHEFNTKSIRNFVEHIVDTELTNRLIPILTSSTQTNNILDFQDILQRFTFDNICNIAFGYDPEYLTPSTNRSKFAEAYEDATEISSKRFRLPLPIIWKIKKYFNIGSEKRLKEAVTEVRSFAKKLVREKKRELEEKSSLETEDMLSRFLSSGHSDEDFVADIVISFILAGKDTTSAALTWFFWLLWKNPRVEEEIVNELSKKSELMVYDEVKEMVYTHAALSESMRLYPPVPMDSKEAVNDDVLPDGWVVKKGTIVTYHVYAMGRMKSLWGDDWAEFRPERWLEKDEVNGKWVFVGRDSYSYPVFQAGPRVCLGKEMAFMQMKRIVAGIVGKFKVVPEAHLAQEPGFISFLSSQMEGGFPVTIQKRDS

SEQ ID NO: 10444 - protein, 604 aa, Zea mays
  misc_feature (21)..(21): Xaa can be any naturally occurring amino acid
  misc_feature (218)..(218): Xaa can be any naturally occurring amino acid
  unsure (1)..(604): unsure at all Xaa locations
MVKRSKKSKSKRVTLRQKHKXVLRKVKEHHRKKRKEAKKEGKAGQRKKVEKDPGIPNEWPFKEQELKALEARRAQALQELELKKEARKERARKRKLGLLEDEEIANLASAASAQGSEFAAKDAAKDAAKDKAPLTVAKSNDHSERSFYKELVKVIEASDVILEVLDARDPLGTRCIDMEKMVRKADPSKRIVLLLNKIDLVPKEAVEKWLTYLREEMXPTVAFKCNTQEQRTKLGWKSSKLDKTNSIPQSSDCLGAENLIRLLKNYSRSHELNWQFTWGIVGLPNVGKSSLINSLKRSRVVNVGSTPGITRSMQEVQLDKKVKLLDCPGVVMLKSSNSGVSVALRNCKKVEKIEDPVAPVKEILSICPHEKLLSLYKVPNFGSVDDFLQKVATVRGKLKKGGVVDVEAAARIVLHDWNEGKIPYFTLPPKRDAGEDSDAVIISEDGKEFNIDDIYKAESSYIGGLKSIEEFHHIEIPPNAPPAIDEEMLEDGGKKPSEAIQESRDREEQMPDVKDSGGSKAASASTQNDKLYTAEGVLDPRKSKAEKKRRKASRPSALNDMDADYDFKVDYRMEDGGSEGAHADDEDGGDGSEDNEPMTGVDDA

SEQ ID NO: 10445 - protein, 475 aa, Burkholderia mallei ATCC 23344
MNIHPVILCGGSGSRLWPMSRGGYPKQYLKLAGDRSLVQQTALRLRNIPDTTAPIVVTNNEQRFLVAEQLRQVDITPSSIVLEPVGRNTAPAIAIAALLAMHDSPEALLLVLPSDHVILNEPAFITAAREAAAIAADKHLVTFGITPTQAHTGFGYIRRGPLLADGGQAFKVDAFVEKPDASTAERFVRDSGYYWNSGMFMLKAATYMEELHRHAPEIARQAEFALASAKRDHDFLRLDADAFFACPNVSIDYAVMERTERAAVIATADLGWSDIGSWSALADIADTDAQGNALVGDVFTDSVKNSYIRAEHRMIAALGLDDIVIVETADAVLVAHRDKAQDVRKIVEWLNASGRHESVTHRRVVRPWGSYEGIDQGERFQVKRIVVNPGAQLSLQMHHHRAEHWIVVKGTALVTNDGKKIILTENQSTYIPLGATHRLTNPGKIPLELIEVQSGSYLGEDDIVRFEDTYGRTST

SEQ ID NO: 10446 - protein, 111 aa, Glycine max
  misc_feature (23)..(23): Xaa can be any naturally occurring amino acid
  unsure (1)..(111): unsure at all Xaa locations
DLFFFLDITLHGTYYQILSVKEXYDEIRNSYRSAILHSHPDKLNGCSSDEKFLKIQKAWQVLSDAELRVVYDNDLRSSRLDGVTADELIQNCLVQLWKFSGKLFDFCTHLC

SEQ ID NO: 10447 - protein, 369 aa, Pseudomonas putida KT2440
MRRGCRVALNSIEELVEDIRQGKMVILMDDEDRENEGDIIMAAECCQPEHINFMAKHARGLICMPMTRERCETLKLPLMAPRNGSGFGTKFTVSIEAAEGVTTGISAADRARTVQAAAAKDAKAEDIVSPGHIFPLMAQPGGTLARAGHTEAACDLARMAGFEPSGVICEVMNDDGTMSRRAELEVFAAEHGLKIGTIADLIHYRMIHERTVQRVSEQSVESELGEFNLVTYRDAVEGDVHMALTLGKICAEEPTLVRVHNMDPLRDLLLVKQPGRWSLRAAMAAVAEAGSGVVLLLGHPLDGDVLLAHIRESAGDAPAKAPTTYSTVGAGSQILRDLGVRKMRLMSSPMKFNAISGFDLEVVEYVPSE

SEQ ID NO: 10448 - protein, 292 aa, Schizosaccharomyces pombe
MPPKKAAKGKGDPGKAAKKDPTKKAADATFGLKNKNRSTKVQAKIRQIEQNAAASGSKDAKRQEALRKRREEEKRAAEAAKAEVAALFNAIPKKQTPQNFLTRKEEVKESQKIDLYSDVRDQQTDLPLEKRPWINTDIVCKFFLEACETGKYGWLWQCPNGNMTCIYKHALPYGYVLSRDKKKDDTKEEISLEAFIEIERHRLGPNLTPVTEENFKKWSDGRRDRILKQAEERRSNRAVGRSNLSGREYFESNKDKTHEVVGDEEDWDFSALRRETEALAKAQDATAPIVSV

SEQ ID NO: 10449 - protein, 92 aa, Arabidopsis thaliana
MASSMLSSATMVASPAQATMVAPFNGLKSSAAFPATRTANNDITSITINSGRVHCMHVWPPIGKKKFETLTHHPDLTDSDLAIEVNYIIRIN

SEQ ID NO: 10450 - protein, 162 aa, Glycine max
MSKNRGFNLRRRLIRVSKWIFRKIRTRAPREYHCLGDSPPSPMVKLLTWGRKLTAGAKSRLKVASGSGYAQLGTDPDPSVPKGHLAVYVGQKDGELHRVLVPVIYFNHPLFGELLKQAEEEFGFHHEGGITIPCRFTEFERVKTRIASGSRRGTRPKRLAWR

SEQ ID NO: 10451 - protein, 152 aa, Rhodopirellula baltica SH 1
MQRTLVLLKPDCVQRRLIGDVLSRFEAKGLHIVAMKLLQVTPELSKQHYAEHVEKPFYPSLEEFITSAPVVAIALEGLEVIRVVRDMLGATNGLQAAPGTLRGDYSSSRQMNLVHASDSEESAQRELDLYFNADEFCDYSLVLTPFMRADDE

SEQ ID NO: 10452 - protein, 142 aa, Aquifex aeolicus VF5
MAVERTLIIVKPDAMEKGALGKILDRFIQEGFQIKALKMFRFTPEKAGEFYYVHRERPFFQELVEFMSSGPVVAAVLEGEDAIKRVREIIGPTDSEEARKVAPNSIRAQFGTDKGKNAIHASDSPESAQYEICFIFSGLEIV

SEQ ID NO: 10453 - protein, 442 aa, Kluyveromyces lactis NRRL Y-1140
MSLVPQAYLSNFHNRVKNEDVPLFTAAQLSRNKRGKQVNYAEFDTDLLDEFIDKNDEDDLEDDVDDSDGRRRGGDYYDQVDGSDGGAAAAAATAAAAAGLGEDGGIGEGTPGSGDPGAVTGGTPAADTGPDGTNDGTAGTSNPSSELDRIKLNDLPDLESQDDSATPLALLKYPRIRETFVQSRIAISYKDLLGDSIQDPQQVDIESPIMVPIRLNVEFSGHKLADFFMWNLNDHSMTPEQFATILCQDLDFPVLSNPNNSPYTQIISMINEQLQEYETLASLQVPDLHVIINLTANLDSKLYDDTFEWNLNDDSLCPEQFAELVVQDLGLQREFVPAIAHSLHESLLKVKKDWLEGNLNLAHVENKAAFGYTSGIRLDIDTLGASWFPKVEVLSQWEIEKREIEKERNMRRLKRESAKVDDGRSRRRGKRRMDDLETTLRI

SEQ ID NO: 10454 - protein, 152 aa, Nicotiana tabacum
MSTPARKRLVRDFKRLQQDPPAGISGAPYDNNIMLWNAVIFGPDDTPWDGGTFKLTLQFSEDYPNKPPTVRFISRMFHPNIYADGSICLDILQNQWSPIYDVAAILTSIQSLLCDPNPNSPANSEAARMFSENKREYNRKVREIVEQSWTAD

SEQ ID NO: 10455 - protein, 446 aa, Salinibacter ruber DSM 13855
MTDHATDAMEVAPSDVDLRTSRRFYERAQHSIPGGVNSPARAFDSVGGTPLFIERAEGAYLEDADANEYLDYVGSWGPMIFGHAHPDVVEAVKDQAEASTSFGAPTEIEIEVADLVCDLVPSVEKVRMVNSGTEATMSAARLARGYTGRDKIIKFEGNYHGHGDFFLISAGSGAMTLGKPDSPGVTDGNAKDTLLAQYNDLSHVQRLVEANQGEVACIIVEPIAGNMGCIPPEPGFLEGLRELCDAHDIVLVFDEVMTGFRVAPGGAQERYGVIPDLTCLGKIIGGGLPVGAYGGKQEIMDYVAPTGPVYQAGTLSGNPLAMRAGHAILSKIAEEKDRIYDQLEDYAEALQKGTEHNLDALGLDYTTHQVGAMGSLFFTDAEVVDQDTAQTADTEAYAAYFHAMLEEGIYLPPSQFEAVFYGTCHGEDELETTLETQRRALKRVHS

SEQ ID NO: 10456 - protein, 278 aa, Acinetobacter sp. ADP1
MSATLKSNITFIGGGNMAQALIGGLIARGLPSTRIMVSDPVEAIRQVLQEKEIQALNNNVEAIQHADVVVLAVKPQVLATVLKPLQGLFDGKLIVSIIAGAEIETIAELSGTDRIVRVMPNTPALVQTGAHGLYANENVGSDDRDLASQILAATGLTIWVNSEAQIDAVTAVSGSGPAYFFYLMESMIRAGKNMGLDEKVATALTLQTALGAAQMAITSSNTPSELRKNVTSPNGTTQAALEVFDRAQISQNIQTALAAAQKRSQELAHELSDSTKTT

SEQ ID NO: 10457 - protein, 384 aa, Pisum sativum
MAIHHHHHHHQQLHHNSLLDALYCDEEKLEEEQEDVSSQQSDVTTNNDNNILDSTSLFPLLLLEQNLFSQDEELTTLFSKEKTQQETYYEDLKNVVDFVSLSQPRREAVQWMLKVNAHYAFSPLTATLAVTYFDRFLLTFHFQKDKPWMIQLVAVTCISLAAKVEETQVPLLLDLQVQDTKYVFEAKTIQRMELLILSTLKWKMHPVTPHSFLDHIITRLGLKTNLHWEFLRRCENLLLSVLLDSRFVGCVPSVLATATMLHVIDQIEESDDNGVDYKNQLLSILKINKEKVDECYNAIVEVTNENNYGHKRKYEQIPGSPSGVIDAVFSSDGSNDSWKVGSSSYSTSEPVFKKTKTQGQNRNLSPLNRVIVGILATASATTSP

SEQ ID NO: 10458 - protein, 226 aa, Campylobacter lari RM2100
MIFAANLKCNHTRSSFELYAQKLNQNLSNEDEIFIFPPSIAFSSLKVNFHQGAQNFYPCENGAYTGEIGKIHLEEFNIKSVLIGHSERRALNEDESFLKAKFDFAKNLDFNIIYCIGESLETKNANKSLDFLKKQIENIDLSYKKLIIAYEPIYSIGTGVSANLDDINTILNFLRKFTNAKLLYGGSVNQSNIKEICALKNCDGVLIGSAALNASDFLNMIQIAKG

SEQ ID NO: 10459 - protein, 438 aa, Propionibacterium acnes KPA171202
MLNTIEEVLAELRAGRPVLVTDDADRENEGDAILAAELADPRWVGWMVRHTSGYLCAPMTEERADQLDLPLMWPASQDPLRTRYTVAVDAAHGITTGIDAVQRARTARVLADPSSTPSDLVRPGHVLPLRARAGGVLERRGHTEAAVDLARLAGLEPVGLIGELVGDDGMCLRADAIADLARTEGLALTTIDQLAQWRQAHDPGPAVPTQRVTALASAHLPTRHGQFAITGYRDNCTGVEHVLLVGEKGIDADDGGPAWVRVHSECLTGDALGSLRCDCGDQLAAAQQHVCRHGGAIILLRDHEGRATGLLNKIAAYKAQDGGLDTVDAQTHLGLPVDAREYGAAVAILANIGITSVRLLTNNPAKAEALRDGGLEVTMSPLETSTRPEDERYLRTKRDRMGHALTLGVSPSEMSTQPLASSHTTSTTPALTIKGDRP

SEQ ID NO: 10460 - protein, 369 aa, Schizosaccharomyces pombe
MSNSIVGEVYHHVILDVIANSRSDFEENGVDDATLRELQNLWQSKLVATDVATFPWAQAPVGTFPIGQLFDPVSGLRTDSLDVTAPAVANSPILNNIAAIRAVQQMDTFAQQHGNSNYYSPPTPSLPQSATNISFDSSAIPNVQSNPNNTAPFPSYSSNSLQLPTNQTADSPIINDHSTANVTSTGQEHAPDSSSTNSFGGLLLPNQNSPKKSELGETESSNTTPANSRNDVPQTDGAIHDLDDAGSPSNFESNRFAIAQKADAEIYEVLKKNRILQIDGTIEDNEDEKKPPVDTPSDEAINSDLDDPDSDEAPETEEGSDIGQAIVLCLYDKVNHHKNKWKCVFRDGVVGVNGKDYLFFKANGEFEWI

SEQ ID NO: 10461 - protein, 534 aa, Coccidioides immitis RS
MGQQQSKGSGGSRISSDKGGPESLQSYPSFSRSDTRDSTRSIRGSIRSKIPGSSKSDKFDSPKSSNGNVTRGDIGPGDKPDGGPVALPYRTTSDASVVTDKSAASQEEDESASLDVPRLPPSPRHSASLGRGHENVNAAQRSGEVDHVSEAPPTGAGQSIVSQKPGESILIKRDNMINPVLRDLNGSSPSESIGMNGSPGMGIGSLKSIDVDDMITRLLDAGYSAKVTKAVCLKNAEIIAICAAVREVLLSQPALVELSAPVKIVGDVHGQYTDLIRLFEMCGFPPASNYLFLGDYVDRGKQSLETILLLLCYKLKYPENFFLLRGNHECANVTRVYGFYDECKRRCNIKIWKTFVDTFNCLPIASIVAGKIFCVHGGLSPSLSHMDDIRGIARPTDVPDYGLLNDLLWSDPADMEEDWEPNERGVSYCFGKKVIMEFLQRHDFDLVCRAHMVVEDGYEFFNDRILVTVFSAPNYCGEFDNWGAIMSVSAELLCSFELLKPLDSSALKSHIKKGRNKRNSILNSPPALVSAQSY

SEQ ID NO: 10462 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 10463 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRTAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 10464 - protein, 216 aa, Pseudomonas putida KT2440
MFTQHHAQFPNVSAAIAAFQAGRPVLLLDDDDREDEADIIAAAENITLQTMAMMIRDCSGIVCLCLDEATVDELQLAPMVQNNQARHGTGFTVTIEAAEGITTGVSAQDRITTIDAALRSSAEQRHIVSPGHVFPLRARNGGVLTRRGHTEGSVDLARLAGLRPAAVLCELMNPDGSMARGEQVAVYARQYNLPVLTIEELARYREAMLEREAEPA

SEQ ID NO: 10465 - protein, 417 aa, Burkholderia mallei ATCC 23344
MAEIKNYTLNFGPQHPAAHGVLRLVLELDGEVIQRADPHIGLLHRATEKLAENKTFIQSVPYMDRLDYVSMMVNEHGYVLAIEKLLGIEVPERAQYIRVLFDEITRVLNHLMWIGAHALDVGAMAVFLYAFREREDLMDVYEAVSGARMHAAYYRPGGVYRDLPEAMPQYKASKIRNERALAKMNEARSGSVLDFIDDFFTRFPKCVDEYETLLTDNRIWKQRLVGIGVVSPERALQLGLTGPMIRGSGIAWDLRKKQPYEVYDRLDFDIPVGVNGDCYDRYLVRVEEMRQSTRIAKQCIEWLRKNPGPVITDNHKVAPPSRVGMKTNMEDLIHHFKLFTEGFHVPEGETYAAVEHPKGEFGIYLVSDGANKPYRLKIRAPGYAHLSALDEMARGHMIADAVTIIGTQDIVFGEIDR

SEQ ID NO: 10466 - protein, 556 aa, Cryptococcus neoformans var. neoformans B-3501A
MPPPSLTSSSTRFRVGLFVFLLAVSLSLTYRFAPSFSSRRSIFPNGKTRPSEYIIDVDVEKLRGQTGKRIAIVGAGASGSAAAFFLRRAANVVERRAGLAESSLISDIIVYEKEGYVGGRTTTIYPHDDDRARPQELGASIFVDSNLNLMKAVKEFNLTLVDPDFGGSGIGIWDGRKFLFTSSSSSWITSARALLRYGPLSPFRTRRAVSSLLKKFLRLYDPSWLHDRGVMYSVEDFAEVVGLGREYTTRSGESWAKEVVGAGERWIGEVWEGSTRVNYAMNIDKIHALAAGVSMATGGASQVEGGNYQIFQSMLADAGAKLYLGTTVEDIVPQEKDASRKFIVKTNRTELASEEVDHVFWAAPWGLQRMKSLEKEFTEPVPPTPYVRLHVTYLTTTQKHPSPSFFGLPAGSTVPNTILTSAHPPRSPNAPSLPPPRFQSITWHGESFPGSNEYAVKIFSLTRLSDRLLREILGDEPTWVKRKEWNSYPKMEPTARYAPVTLTEGVEYLAGMERWVSTMETQTISAREAVARVAHKWWGLGLGECEDGDSWDWTCS

SEQ ID NO: 10467 - protein, 270 aa, Symbiobacterium thermophilum IAM 14863
MAIGFIGMGNMGRLLVTALVRAGALQPDEVLIYSRSPEKRRRVTAALPGVQEAYGGGDLARRAGVVFLCVKPPETAGVLEEIGPYITADHLLVTINNTVTLAMLEARTPARAAKVIPSVVHAVRRGVSLLVFGGRCTHRDRALLMRLMGAVSRPFVVPEEAVRTASDLTACGPAFLSLVLHAMAEAARGKAPALSREAVMAMVRETARATCELMEQTGYDFADVAARVATPGGVAAAGVDALHPRLDGFWEAVLAATAAHEAAKRAQLVL

SEQ ID NO: 10468 - protein, 486 aa, Pasteurella multocida subsp. multocida str. Pm70
MGGISMQQFSLLKTKAYINGEYVQAKEHKTFAVTNPANQQIICELPDLSAEETEYAIACAAQAQKKWQKVTPKERANLLRRWYNLVIENQEELAQLLSLEQGKPINESRGEILYGASFIEWFAEEAKRIYGDVLPQDKENHRLLVIKQGIGVVAAITPWNFPNAMITRKAAPAFAAGCAMVLKPAQETPLSALALAELAHQAGLPAGLFNVITSTRSVEIGKVLTEHPTVRKVTFTGSTRVGKILMAQSASTVKKLSLELGGNAPSIVFDDADLENAIEGIIASKFRNSGQTCVCTNRIYVQAGIYDRFVELFSAKVAAFKVGSANEAGVNIGPLISQSAVNKIQEHIDDATAKGANLVIGGKLHTRGGTFFEPTVLRDVTQAMLVAKDETFAPLAPVFKFDTEAQVIEMANDTEFGLASYVYTQDISRIWRVSEALEYGIVGINEGLISNEMAPFGGVKESGLGREGSRYGIDEFLEIKYLCLKV

SEQ ID NO: 10469 - protein, 283 aa, Rhodopirellula baltica SH 1
MTASDPAPADSSATNPTSPAPTPEVIFLGTGTSVGVPAIGCECDVCQSTDPHNNRTRCSILIRLPEGNLLIDTPPDLRTQLLREKVKLVHAVLFTHEHADHIYGLDDLRLFPFRLGRPVPLYCRADVEARIRTSYDYAFSQREQTHAGSRPQLEILSINNDDPFEVLGVRVTPVPLKHGPHFEVLGFRMGDFAYCTDTNHISETSMDRLRGLDTLVLDALRFTPHPTHFNIDEALEVIEELKPRQAFLTHLGHDIDHGPVEASLPDHVHLAYDGLRLPMPSIA

SEQ ID NO: 10470 - protein, 339 aa, Cleome spinosa
MKELGLCLGVESGSDQRRGDSSGHGLRVTAIDSNSDYEDGILDLNASDNRNEESESGRVVDGSGLPPIRDSFFGEEAVVADEELEWEEVHEAITWTYEPVQVRGFAIPEEEGELSSSSRDDHEHDLDWQVLLAVNNVVNYIEQAEGISLTADDVDANYYLYLANIDEYDENHGDHDAIFRQMFDNETGIGGNPPAAKRVVKDLPLVEFTVEKLGKGEVVCSVCKDKIAIEEKVRRLPCRHYYHGDCILPWLGIRNTCPVCRYELPTDDPDHERTRRQQRSDRLGKRVIDTDCYSHAPVNNSICNAWTGDHHHVKTFMSCDEDTKDMVGCYYKLFGMVPP

SEQ ID NO: 10471 - protein, 321 aa, Salinibacter ruber DSM 13855
MQSISFENGDEMPMIGLGTWKSPPGEVYEAVTTALEAGYRHVDCAPIYKNETEVGAALSDSFDAGGIRRDDVWVTSKLWNNAHHPDDVRPALEQTLSDLRLDALDLYLIHWPVALQPEVDFPESPDDFVSPEAVPLTETWAAMEALKKDGLVRHIGVSNFSVPNLQMILDAGEVRPEMNQVEMHPYLPQPELVSFAEAHNIPITAYSPLGSGDRPDAMKADDEPTLMANPTINDIADRHGVSPAQVLLQWGVARGTAVIPKSTTPAHIKDNLAAADLDLSADELETIDSLDSKYRYLAGAAWTMEGSPYTQAGLWGEEQIR

SEQ ID NO: 10472 - protein, 561 aa, Cryptococcus neoformans var. neoformans JEC21
MPIRSPTSLSLKRSSHFTTATRRLHTSTPTLIAAASLSKKLQRFSPQLTPRLLAPNGSRTMSNWPKVTSENPLGLDDPSLFIQKGFINGQYVGTQSGKTFEVNDPASGKTIGTCPEMTVEDTRHAIEVAEKAFATFRNTSPVQRSNWLSELYRLYQASIKDIARLIVWENGKSWNDAMAEATYAGTFFSWFAGEALRTYGDVIPCSVPGTRNFSIKQPIGVVALLCPWNFPAAMIARKMGPALAVGCTSVIKTPSETPFTTLAIIELARRAGIPDGVINVITTDANLQDVGKELCTNPAVHKVSFTGSTRVGKILASQCSSTLKKMSLELGGNAPLIVFEDADIPTAVAGTIASKFRGSGQTCVCANRIYVHEAIYDEFAKKLAEKVAEFKVGPGFGEGVTHGPLIHSRQADKVEEHVQDAIKKGAKVLVGGKRGNGTEYIPTVLTNVSDECLIATEETFGPVAALFRFSSEEEVVARANRAEVGLAGYFFSRDSDRIWRVAEALETGMVGANTGMISQAVIPFGGIKESGYGKEGGRQGTEEYTITKLVAVGTSLHNMPK

SEQ ID NO: 10473 - protein, 569 aa, Ehrlichia ruminantium str. Welgevonden
MHDSKYLLDIITLLSAAILIVVLFWKLNISPVLGYFVAGTLIGAHGLNLVESSVIIQNLGEFGVVFLLFLIGIELTFERLIAMRLHVFGFGTLQVIVTTLAIWYIANKFGIDSKGSIIIGGALALSSTAIVLQVLQEKGCQSTQVGRLSIAILLLQDLAVVPLIVLLPLLSGESHHSIPISLLYSFIKAAVALTLIFITGRLLLRPLFNTIAAIKSSEIFIATTLLIVLGSAFITENFNLSMALGAFVSGLLVAETEYRHDVEQVVLPFKKLLLGLFFMTVGMSIDIKFVVNKLPIIGLISFSLITLKSLIIFILCRFFKFHVAAAIQAGLLLSQGGEFAFILFGLAAEKNVLPSDLAQTLMMITTVTMAFTPPLAALGDWIAKLITKKKISLNSQELTLDTKDLDQHVIVVGFGRVGRMVAKVLVAEHVNYIASDIQPKTVKDGRDAGFPVYLGDLTKLATLESMAISRAKMIIIAINNEVTIKKIISLVAQRFPNIIIIVRLPDLNNAEVYKELGAHYLIPETYEVGLQLGAIALSNTGFSNHAISLLKDRFRTVNYAAVKNKEANE

SEQ ID NO: 10474 - protein, 169 aa, Zea mays
CDQTLVQKNFGWRRRRFVSCSRGFGLLVWRSPSSPGSTSPRQHQRSILSATAHAAERPEIAPHSLSPDGCRSGLPDPSQIRWQERRNSGLNLIDMRQQRGGAGAGRRADDPGLLKRAFDRVFRFVRLAEFEIFFVLFFLIAFFLFKDLMARPQYNQLFVKKPDLDDSWP

SEQ ID NO: 10475 - protein, 153 aa, Aspergillus oryzae
MSDEQTFIAIKPDGVQRGLVGPIISRFENRGFKLAALKLCSPSKEHLEQHYADLSSKPFFPGLVSYMLSGPIVAMVWEGREVVKTGRTILGATNPLASAPGTIRGDFAIDVGRNVCHGSDSVENAKKEIALWFKPEELQKYKHSQFDWIYEKA

SEQ ID NO: 10476 - protein, 310 aa, Candidatus Kuenenia stuttgartiensis
MEENTIIPHTPDFLRKLFARKGVVLNKKYGQHILIDQNILSYIANSASLQKDDVVLEIGTGTGSLTRYLAEKACHVFTVEIDSKLFDLSSEILKFYKNITIINADILQSKHKLNAEIVTRISGWLATNNHTAFKVVSNLPYNISTPVIINLLESDLPISLMVLMLQKEITERLTAAPGSREYGILSVITQLFSEVELMKTLPPEVFWPRPEVSSAIVKMSVHRAKYANKITDYPFFIKIIYAIFTSRRKTLLNSIEKLKLPGVSRSELKRILAAMQLNENIRGEMLDPEQLIHLTESLFLATSRANTLTF

SEQ ID NO: 10477 - protein, 474 aa, Corynebacterium efficiens
MERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 10478 - protein, 187 aa, Brassica napus
VDPASGPKHKSLLANERDLVTDLPGQPDVSFRHYAGYVPVDESNGRAMFYWFFEAMDLPKEKPLVLWLNGGPGCSSVGYGATQEIGPFLVDANENGLKFNPYAWNKEANMLFLESPVGVGFSYSNTTSDYQKLDDDFTARDAFNFLCNWFEKFPEHKGNTFYIAGESYAGKYVPELAEVVYDNNNQD

SEQ ID NO: 10479 - protein, 384 aa, Mycobacterium sp. JLS
MEVSATLLLELGVILAALTVLGTIARRFALSPIPLYLLAGLAVGEGGLAPVPAAGDFVETGATIGVVLLLLTLGLEFSIGEFATSLRRHLPSAGVDLVLNAAPGAIAGWLIGLDGVGILALAGVTWISSSGVIARLLSDLRRLGNRETPAVLSILVLEDFAMAAYLPLLAVLATGGTFLQALLGMAIAVSALGFAFVVSYRWGHHVGRLVVHPDNEQLLLRILGLTLIVAALAEFIHASAAVGAFLVGLTLTGEAAERARTVLTPLRDLFAAIFFLAIGVSVDPAALIPMLPVATALAVATAATKVLTGQFAARRDGVGRPGQLRAGTALIARGEFSLVIIGLVGASVEALEAVATPYVLILAMVGPVLARFTGGRAPARRRPG

SEQ ID NO: 10480 - protein, 313 aa, Wolbachia endosymbiont of Drosophila simulans
MKKFLLKPKKSLGQNFILSSEITKKIVALAGSLENFNVIEIGPGYGALTREILVHNPKSLLSIEKDRDLVKHHDQLLNEHQGKYRIIEADALHVTEEELIERPVKVIANLPYNISVVLFLKWLNNRIIEADALHVTEEELIERPVKVIANLPYNISVVLFLKWLNNIKFFTNLTLMFQKEVADRITARPNSKDYGSLSVLSQLLCDIKKEFDIEPKEFFPRPKIHSSVITVNPLPIPKFAVNLETLTRLTRAVFSQRRKMLRNSLQNITNHTETVLENAKLSGNERPENLTIEQFCLLANNVECLFCKSPIAI

SEQ ID NO: 10481 - protein, 324 aa, Arabidopsis thaliana
NLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 10482 - protein, 232 aa, Wolbachia endosymbiont of Drosophila simulans
MNGMRSSFVDFIGKLNNKSNEITSKLVICPPFTSFPSSIELNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 10483 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 10484 - protein, 429 aa, Zea mays
CHSLERLEITGCPMITDKGLVAVAQGCPELKSLTIEACSGVANEGLKAIGRCCAKLQAVSVKNCAHVDDQGVSGLVCSATASLAKVRLQGLNITDASLAVIGYYGKSIKDLTLARLPAVGERGFWVMANALGLQKLRCMTVVSCPGLTDLALASVAKFSPSLKPVNLKKCSKVSDGCLKEFAESSKVLENLQIEECSRVTLTGILAFLLNCSPKFKSLSLSKCVGIKDICSAPAQLPVCKSLRSLAIKDCPGFTDASLAVVGMICPQLENVNLSGLSAVTDSGFLPLIKSSNSGLVNVDLNGCENLTDAAVSALVKAHGASLAHLSLEGCSKITDASLFAISESCSQLAELDLSNCMVSDYGVAVLAAAKQLRLRVLSLSGCMKVTQKSVPFLGSMSSSLEGLNLQFNFIGNHNIASLEKQLWRCDILA

SEQ ID NO: 10485 - protein, 412 aa, Brucella melitensis 16M
MTERLSLSRDRINVLLLEGISQTAVEYFKSSGYTNVTHLPKALDKADLIKAISSAHIIGIRSRTQLTEEIFAAADRLIAVGCFSVGTNQVELKAARKRGIPVFNAPFSNTRSVAELVIGEIIMLMRRIFPRSVSAHAGGWEKTAIGSREVRGKTLGIVGYGNIGSQVGNLAESLGMTVRYYDTSDKLQYGNVKPAASLDELLKTSDVVSLHVPSSKSTSKLITEAKLRKMKKGAFLINNARGSVVDLEALAKVLQEGHLAGAAIDVFPVEPASNGERFSTPLQGLENVILTPHIGGSTEEAQERIGTEVTRKLVEYSDVGSTVSAVNFPQVQLPPRPTGTRFMHVHENRPGILNSLMNVFSHHHINIASQFLQTDGEVGYLVMEADGVGEASDAVLQEIREIPGTIRARLLY

SEQ ID NO: 10486 - protein, 286 aa, Kluyveromyces lactis NRRL Y-1140
MRLYVLRHGQSEVNQRNIFGGWVDVHLTEKGLDQARNSAILIKAYCQSQGLELPKLGYTSRLIRTEETMNEILKEFGKQPEFRIVSGELPPQQTSDNGKFPVYQSWRLNERHYGSWQGQSKHKMLEEYGEEQYMYIRRDYLGKPPKADLNREMVQDFDQGDTGYEFKEPNRHVKYLEEEITHDELPNGESLCDVVQRLKPLLENMILPNLKERGDSLIVGHGSTVRSLLKILEGISDTDIKEVNIPNAIPSVIELDDNFRFIRKFYLDPESAKVNAELVRQEGFKE

SEQ ID NO: 10487 - protein, 398 aa, Zea mays
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 10488 - protein, 208 aa, Phanerochaete chrysosporium
GAGGETTAGTLTFVVYFLTQHPNVLQRLRQEILDVVGPSNLPTYDDIKQMKYLRAVLNETLRLYPPVPWNMRYAVKDGILPNSEPDGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRHI

SEQ ID NO: 10489 - protein, 513 aa, Kluyveromyces lactis NRRL Y-1140
MGTGKKEKQRRIREGNTKDGNLRVKGENFYRDTKRVQFLNMYKGGRSVRNAKGDIIKAAPLQDTAAPTARVAPDRRWFGNTRVISQDSLSHFREALGENKRDSYQVLLRRNKLPMSLLNEKDSAESPTAKILETEPFEQTFGPKAQRKKPRIAASSLEELISSTSTDNKTFEEKQELDSTLGLMGKQEEEDGWTQAAKEAIFHKGQSKRIWNELYKVIDSSDVVIHVLDARDPLGTRCKSVTDYMTNETPHKHLIYVLNKCDLVPTWVAAAWVKHLSKERPTLAFHASITNSFGKGSLIQLLRQFSQLHKDRHQISVGFIGYPNTGKSSIINTLRKKKVCQVAPIPGETKVWQYITLMKRIFLIDCPGIVPPSSKDSEEDILFRGVVRVEHVSHPEQYIPGILKRCKRQHLERTYEISGWKDSVDFIEMIARKQGRLLKGGEPDESGVSKQILNDFNRGKIPWFVPPPEKDKIEEKEPGDKKRPAEENQEDQEEEEKEQEEQEEPVSKKAKKE

SEQ ID NO: 10490 - protein, 160 aa, Prunus armeniaca
WPSNYSNPTKPSNCNGTKFDDRKVYPHMRSKLKISWPDVESGNDTNFWEREWNKHGTCSERTLNQFQYFERSYEMWRSHNITEILKNASIVPHPTQTWTYSDIVSPIKAATKRTPLLRCKYDKNTQLLHEVVLCYEYHVLKQIDCNRTAGCENPQAISFQ

SEQ ID NO: 10491 - protein, 567 aa, Oryza sativa (japonica cultivar-group)
MSKKRREGGGGGNGGCDPPAVTDALSMDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVKALRILDENCCVGCRSNVEEMRSIQETMQNKELAVLSISLFFACLALFKLACDRVLFLFTRKGAAAAERMCGASKGWILVLASSSFTTFLVLLYN

SEQ ID NO: 10492 - protein, 160 aa, Prunus armeniaca
WPSNYSNPTMPSNCNGTKFDDRKVYPHMRSKLKISWPDVESGNDTNFWEREWNKHGTCSERTLNQFQYFERSYEMWRSHNITEILKNASIVPHPTQTWTYSDIVSPIKAATKRTPLLRCKYDKNTQLLHEVVFCYEYHALKQIDCNRTAGCKNPQAISFQ

SEQ ID NO: 10493 - protein, 584 aa, Vibrio angustum S14
MTNNTFEQYATKPQSNRIGKQYVDGVNHFFPSAIIDEEWQTDNQVTITVKMTSLVEVMKWLYYDQGGWLTVTFGNDERTLNGHFAVYHALSMEGEVKSWVTVKVLVDANSQEFISITPTIPAAVWGEREVRDMYGLRPVGLPDERRLVLPDDWPEDLHPLRKDAMDYRQRPQPTTETETYNFDNQLGDDSNRIVPVGPLHITSDEPGHFRLFVDGEDIVDADYRMFYVHRGMEKLAETRMGYHEVAQLTDRVCGICGFTHSVGYSNTIENALSVDVPFRAKMIRTVLLEVERLHSHLLNIGLSSHFVGFDSGFMQFFRVREKTMELAELLTGARKTYGMNLIGGVRRDFLKDQRLKGIAMVKEVRKTFSELVEVLLATPNIESRIAGVGILSKQVARDYSPVGPLIRASGFKRDVRIIHGQSLESYGDVPMELQTMDGGDVQSRVMVRIREVFDSLNIVEYGLDHLPPGAILTEGFNYVPNKFALGFTEAPRGENVHWSMTGDNQKLFRWRCRAATYANWPTLRYMLRGNTVADAPLIIGSLDPCYSCTDRVTIVDTKKKRSKTIPYKAIEQYSIDRKNSPFKL

SEQ ID NO: 10494 - protein, 814 aa, Oryza sativa
MMPEDIHAKSPSDACVQKDGTFLNSCAPEEHLCNSKDRPALFLAMTFSTGKSAKGQEQHSDFPASWFSRQKQEKDSTNQVLEANLGMDCAIISEGEWADTLTDISVGYLLTEASIGTNTDCPGTAIAKNTLFLENPCSYDSFDAAVALHASRHKTVEQPALASHSTIWGAEETCDEFSFNLAASRKQESSNTSASSCPGSDSGVLPSTSQGFQGFLQDLAGAKVADNPCMDDAKDMEALCANSPPRSKSDSGLKDQSLADLYWAQVTLTAHIAPLTRGSPVQVAVVLAHEIAWRHGHLYDDLTFDLEVLLVVREVGHWIPETFRAPLVERTVRAIDSSLALSIGRRDPRWAEFPADFLGGFVILRSHRVAMDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 10495 - protein, 174 aa, Prunus armeniaca
WPSNYSNPTMPSNCNGTKFDDRKVYPQLRSKLKRSWPDVESGNDTKFWESEWNKHGTCSEQTHNQMQYFERSHAMWYSHNITEILKNASIVPHPTQTWTYSDIVSAIKSKTQRTPLLRCKPQPKTKSQTKAQPKSQANSLLLHEVVLCYGYNALKLIDCNRTGGCQNQQAISFQ

SEQ ID NO: 10496 - protein, 167 aa, Prunus armeniaca
WPSNYSNPTMPSNCNGSKFDDRNVSPQLRAKLKRSWPDVESGNDTRFWEGEWNKHGTCSEQTLNQMQYFERSQNMWRSYNITEILKNASIVPSATQTWTYSDIVSPIKTATQRTPLLRCKPDPAQNKSAPKPQLLHEVVFCYEYNALKQIDCNRTAGCKNRQAISFQ

SEQ ID NO: 10497 - protein, 322 aa, Zea mays
  misc_feature (106)..(106): Xaa can be any naturally occurring amino acid
  unsure (1)..(322): unsure at all Xaa locations
MSAYCGKYADELIKNAAYIGTPGKGILAADESTGTIGKRLSSINVENVEENRRALRELLFCCPGALQYISGVILFEETLYQKTIEVVGTDKETTTQGHDDLGKRCXFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 10498 - protein, 1249 aa, Methanopyrus kandleri AV19
MPGLPIKLRVEKAYPEDVGKRAVRMDKASRDRIGVSEGDLVKITGSKTTVARVLPAKKEDVGKGIVRMDKYERQNAGASVGEPVEVDRAEEKVAKRVELMPTERVVVPVQAGLKEEVEEELTREHEQDILEQIKRYLRSRAQQTPIPATHRDVIPLEVQGKTIAGHVLIKFPDSLLVVGIEPEDATVIGPETEIEVKPYSEDLAKAAEIPDVTYDDIGGLDREIELIREYVELPLKRPELLKELGIKPPKGVLLYGPPGTGKTLLAKAVANECGAKFYSINGPEIMSKYYGESEARIREVFEEARKNAPAIIYIDEIDAIAPKRGETGEVERRVVAQLLTLMDGLSEDERVVVLASTNRPDDIDPALRRPGRFDKEIEIGVPDKEGRKEILQIHTRDMPLADDVDLDKLAELTHGFTGADLEALCKSAGLKALRRAIRKIGAKLAEKGEKEEREVAVKVSELSDEELMEVLEKGLDRARIPEEKKRALRRVLREAEEEEKEEVAYTDALDKVLEAEELPEIREELKVTMRDFMEALKEIEPSALREVIVEVPDVSWDDVGGLEDVKQELKEAVEYPLKYPEVYEKLGTRPPKGILLYGPPGTGKTLLAKAVANESDANFIAVRGPEVLSKWVGESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSEKKIREIFQKARQTAPCVIFFDEIDAIAPKRGTEVGGSRVTERIVNQLLTEMDGIEATEDVFVIAATNRPDIIDEALLRPGRFDRIVYVPPPDEEAMKEIVKIHTRDMPLAEDLTVDDIVEILRRREREEDAKYTGADIEAVCMEAAMLALREVLDELERIEKESETEEELEARKEALLEELRVERRHFEKAVEKVPPSVPKEKLEEYEKLKEEYQRLAG

SEQ ID NO: 10499 - protein, 338 aa, Phaffia rhodozyma
MAVKVGINGFGRIGRIVLRNAIIHGDIDVVAINDPFIDLEYMVYMFKYDSTHGVFKGSVEIKDGKLVIEGKPIVVYGERDPANIQWGAAGADYVVESTGVFTTQEKAELHLKGGAKKVVISAPSADAPMFVCGVNLDKYDPKYTVVSNASCTTNCLAPLAKVIHDNYTIVEGLMTTVHATTATQKTVDGPSNKDWRGGRGAGANIIPSSTGAAKAVGKVIPSLNGKLTGMAFRVPTPDVSVVDLVVRIEKAASYEEIKETIKKASQTPELKGILNYTDDQVVSTDFTGDSASSTFDAQAGISLNGNFVKLVSWYDNEWGYSARVCDLVSYIAAQDAKA

SEQ ID NO: 10500 - protein, 899 aa, Cryptococcus neoformans var. neoformans JEC21
MITLTPLSASAAETSPSEPICYLLELDDARILLDMGQRDYRASSQQCSWDYEEAVRDLAPTLSLVLLSHSSSNYLSLYPYARARWGLTCPVYATQPTVEMGRVVCLAEAESWRSECPVDSEKVAADDGSKKPLRGPFVPTVEEIHEAFDWIKAVRYSQPLHLGGDFSHLLLTPFASGHTLGGSLFKIRSPTSGTVLYAVGINHTSERHLDGMVGVQNGPTGYADGVLRPDLLIVEGGRSMVVNPKRKEREAALIDTITSTLESNHSVLLPVDPSPRLLELMILLDQHWTFKRTPKVKQRRYNEPPADLWPYPLCIVSKTAQDMVAFARSLIDWMGGVVKDSAGDMVDVGRGKRARGARMALGSEYGVLDFRHVQFFLNTTDLLQTYPLTRPKLVLAVPPTMSHGPSRFLFTAMANTEGNVIMLTGRSEEQTLARDLYNRWERSQTTGSKWGEGKIGHLTQLEGKLQVEVDSKVPLSGAELEAHVESERLQKEKEAAHKAAVDRSRRMLEADDLESDSDSESEADGHAGDITVRRTEGANAYAGDGEDVRTMSFDIYVKGQQMRSGRGAEMARFRMFPFVERKGRKIDQFGEGLDIGQWMRKGREIAEEGETEEVREAKKRKEEEEEKAKQAPEPPSKYVSEEVGVELKAMIGFVDMEGLHDGQSIKTIISDLQPRKLIIVRSSKESTQNLISFLGSVTGFTRDIFSPSLTEEIKIGEHVQSYSLTLGDSISSALAKKWSDFEGYEVTFVDGKIVLPAGSTIPILETPSLVGPLVKTEAEGDDADDEAKPSAEELAAASAPPISSSAPLPLPTSTFIGDLRLARLKHRLSLLNPPIPAEFAGEGVLVCGPGIAQEAQGAASVVSVRKIGEGKIVLEGCIGRVYVEVRKALYGGLARVDAA

SEQ ID NO: 10501 - protein, 402 aa, Streptomyces avermitilis MA-4680
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 10502 - protein, 250 aa, Acinetobacter sp. ADP1
MTCYDASMAKAMEFAEIDSILIGDSLGMVIQGHDSTLPVTVDDMAYHTAAVRRGNQHSFIMTDLPFMSYATLPDALNNAKKVMQAGAQMIKIEGGAWLSESIRVLTQNGIPVCVHLGLTPQSVHVFGGYKLQAKTREAADQLIADCQAVVDAGAAILLLECVPAQLGQEIAELFPQTPVIGIGAGKETDGQVLVAQDMLGLSFGKVARFVRNFMKEQAGETAIVDAFKAYHAAVQDQSFPAREHTFQVEL

SEQ ID NO: 10503 - protein, 316 aa, Zea mays
MSATGRAPCGLPRIGLGTAVQGPRPDPVRAAVLRAIQLGYRHFDTAAHYATEAPIGEAAAEAVRTGLVASREDLFVTSKVWCADAHRDRVLPALRRTLSNLQMEYVDLYMVHWPVTMKAGRFTAPFTPEDFEPFDMRAVWEAMEECHRLGLAKAIGVCNFSCKKLETLLSFATIPPVVNQVEINPVWQQRKLREFCRAKGIQLCAYSPLGAKGTHWGSDSVMDSGVLHEIAKSKGKTVAQVCLRWVYEQGDCLIVKSFDEGRMKENLDIVDWELSEEERQRISKIPQRKINQGRRYVSEHGPYKSFEELWAGRDMI

SEQ ID NO: 10504 - protein, 350 aa, Oryza sativa
MGSIGGDEAAVLRAEESASGGVDVWSDAVSSHDPDHLLVMVHGILGSNADWQYAANEFVKQLPDDVIVHCSEKNINTLTLEGVDVMGERLADEVIDVIIRKPELTKISFLAHSVGGLAARYAIAKLCRHPSDTSKSETKGTIGGLEAMNFITVATPHLGSRGNNQVPLLFGSIAMENFASRVVHWIFRRTGKHLFLTDDDEGEPPLLQRMAEDYGDLYFISALHAFRRRVAYANADCDHIVGWRTSSIRRKTELPKWEESISEKYPHIVHEEYSEELGDETCQNSATVCDSDILEEKMVTGLRRVSWEKVDVSFHTSMQRFAAHSIIQVKYQFMNEGADVIQHIIDHFQV

SEQ ID NO: 10505 - protein, 437 aa, Ustilago maydis 521
MAESNNTDLPTATATSYKPGEATMLALTFHGTQDVRLTEVRTPTITDPTDVVVRSTGVTICGSDLHLYHNKIPDLKKGDILGHEGTGVVEHVGAQITKFKVGDRVVASFSIACGTCEQCKAKLFTMCDRTNTSAKMDELYGQKLGGILGYSHLLGGYAGTQAEYFRVPFGDVNCFHVPDSVSDETALLMADVTLTAYHSVVDIKFQEGETAAIWGAGPIGQLIAQWLLKVFGARKVMLIDNVAPRLHWAQERLNGLETINFDQTPQVAEEVMHKVAGGVDVSFDAAGFRYAKSLKHQTMQTLGVETDTPEIINEAIRATRKFGRISVIADYVGQCNEFLIGAMMEKGILLKGNGQAPVQAYMEQVFEDYIVPGKFDPTLILTHRFKLEDIAKVYKAFDEKRIDEHKGGIPIIKTFIETKASKPRAASTPELSSVPGF

SEQ ID NO: 10506 - protein, 374 aa, Glycine max
MSQTTLHAFVAKNLGCGMAEGKCLPCSGVSGRTAAVYSYSSLGHRRIHSHVQVRGLKCGFRGASFVCEAKRNPDFSRQNKHGSSRSRNRNSDGRDSFESFDDDMFSLKNGPPVSLSTSGKFQATSAPGPREKEIVELFRKVQARLRERAASQEEKKVEASRAQSKENSTVDSLLKLLKKHSVEQVKRSSGGRGKDFSSDQLQESNQYNGGRNSKISDLDSSPKDEPQEDIVFSSSVARPRSNFQRRSPVPRLKYQHVSNDENEMTVVPVGSEDTENNQDQIDLKLDDEAESDFESDVDSKDEFFFPNIGMAELSEDDDSEQTYNDESVEEQPAAQHKDLSALKLSELRALAKTRGLKGFSKMKKSDLVELLTES

SEQ ID NO: 10507 - protein, 412 aa, Escherichia coli O157:H7 EDL933
MKALTYHGPHHVQVENVPDPGIEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 10508 - protein, 251 aa, Burkholderia mallei ATCC 23344
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLDAVLAVLSQDEAARIVVAYEPVWAIGTGRSATAEQAQQVHAFLRGRLAAKGAERVSLLYGGSVKADNAAELFGQPDIDGGLIGGASLKSGDFLAICRAAQ

SEQ ID NO: 10509 - protein, 219 aa, Enterobacter cloacae
MTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARQLVKLGGRPEYRQGVVTDNGNVILDVHGLEILDAIALENAINAIPGVVTVGLFANRGADVALIGTADGVKTIVK

SEQ ID NO: 10510 - protein, 239 aa, Oryza sativa
MSKLCQSACKAAKSLLSATAAASSPRTSLLAEGRNAALATLTNLGRKTLPTAYAYSYHHNSSAAAAGWLAAIPAAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 10511 - protein, 620 aa, Salmonella typhimurium LT2
MDSHTLLQALIYLGSAALIVPIAVRLGLGSVLGYLIAGCIIGPWGLRLVTDAESILHFAEIGVVLMLFVIGLELDPQRLWKLRASVFGGGALQMGVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARPLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKSHFPHLQIIARARDVDHYIRLRQAGVAMPERETFEGALKSGRQALEALGLGRYEARERADLFRHFNTRMVEEMAKGENDPLSRAAAYKRTSAMLSEIITEDREHLSLIQRHGWQGTAEGKHSGEVADEPEVKPSI

SEQ ID NO: 10512 - protein, 323 aa, Triticum aestivum
SILTNYLTKENRAEDLRNLLTQLRPFFSLIPKAKTAKIVRGIIDAVAKIPGTSDLQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFNALDDPRAIFSLKYMLLCKIMVNQADDVAGIISSKASLKYVGPDVDAMKAVADAYSKRSLKYFETALRDFKAQLEEDPIVHRHLSSLYDTLLEQNSARLIEPYPRGEFRMSQIMIAIYKSRKLHNILNDRAVLIL

SEQ ID NO: 10513 - protein, 272 aa, Pseudomonas fluorescens PfO-1; identical to SEQ ID NO: 329

SEQ ID NO: 10514 - protein, 421 aa, Symbiodinium muscatinei
MPSAVENVALLFGGAVATTALSSAFVASGPVAQEAKTGLRAAGYAKSSQSSSQSMGAMAGVGAVAGLAVAGVAGRRAGKNRTSMEAVGVGINGFGRIGRQVARIAMKDPETELKLINASYDSDYLAYMMKYDTIHGKYDGTVEADGDSLIVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVCWYDNEWGYSSRVVDLIKHMAAEDAKA

SEQ ID NO: 10515 - protein, 347 aa, Symbiodinium muscatinei
MATKIGINGFGRIGRMVFQAICDQNLLGTKLDVVGVVDMSTDAEYFAYQMKYDTVHGRFKHEVKIGEKDELIVNGHKIKCIQASREGPKALPWKDMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSFTATQKTVDGVSAKDWRGGRGAACNIIPSATGAAKAVGEVLPTTKGKLTGMAFRVPTPDVSVVDLTFTAEKDTSIEEIDALFKKASETYMKGVLSFTDEELVSSDFIHNVNSSIYDSKATLQNNLKGEKRFFKIVSWYDNEWGYSNRVVDLLMHMISA

SEQ ID NO: 10516 - protein, 273 aa, Salmonella typhimurium LT2
MNNRVHQGHLARKRFGQNFLNDRFVIDSIVSAINPQKGQAMVEIGPGLAALTEPVGERLDKLTVIELDRDLAARLQTHPFLGPKLTIYQQDAMTMNFGELSAQLGQPLRVFGNLPYNISTPLMFHLFSYTDAIADMHFMLQKEVVNRLVAGPNSKEYGRLSVMAQYYCQVIPVLEVPPSAFTPPPKVDSAVVRLVPHATMPYPVKDIRVLSRITTEAFNQRRKTIRNSLGNLFSVETLTEMGIDPAMRAENISVAQYCQMANYLSENAPLKES

SEQ ID NO: 10517 - protein, 139 aa, Prunus armeniaca
WPSNYSNPTMPSNCNGTKFDDRKVYPQLRSKLRRSWPDVESGNDTKFWESEWNKHGTCSEQTHNQMQYFERSHAMWYSHNITEILKNASIVPHPTQTWTYSDIVSAIKAATKRTPLLRCKPDPAQNKSAPKPQLLHEVV

SEQ ID NO: 10518 - protein, 314 aa, Pueraria montana var. lobata
MAAIEIPTIVFPNSFAQHRVPVVEMGSAPDFTCKKDTKEAIIEAVKQGYRHFDTAAAYGSEQALGEALKEAVDLGLVSRQDLFVTSKLWVTDNHPHLVVSALRKSLKTLQLEYLDLYLIHWPLSSQPGKFSFPIEVEDLLPFDVKGVWEAMQECQKLGLTKAIGVSNFSVKKLQNLLSVATIRPVVNQVEMNLAWQQKKLREFCKENGIVITAFSPLRKGASRGPNEVMENDVLKEIADAHGKSIAQVSLRWLYEQGVTFVPKSYDKERMNQNLQIFDWALTQEDHHKISQISQSRLISGPTKPQLSDLWDDEI

SEQ ID NO: 10519 - protein, 290 aa, Oceanobacillus iheyensis HTE831
MQNKTIIVTGANTGMGLATTIELAKKGIHVIMACRDTKRGNEAKEKAMEESNSTNISLYQCDLGSMESISKFADQIKEDFDKIDGLINNAGVVSLKHTKTEDGFESMTGVNHLGHFLLTHLLLDVLKKSEQARIINVASGAYKAGTLDYNDMHFNNRSFNVIKGYGQSKLCNILFTLELNKHLEGTNVSTFALHPGAVSTSLGVDRQTGFGEKVHLLLRPFFLTSEEGAETAIYLATEPKIDHLSGRYFYKKKLQPTKYNKVNEDEAKKLWDWSIKELGMEHKAIEEVAP

SEQ ID NO: 10520 - protein, 507 aa, Chromobacterium violaceum ATCC 12472
MKSIKPVLLLILDGFGHRTEGDDNAILHARMPVWSRLREQYAYGTINASENFVGLPSGQFGNSEVGHLNIGAGRIVQQDISRIDCDIEDGRFSSNDTLQQAMSKAQGSALHILGLLSDGGVHSHENHIHALIRAAQAAGVPKIYVHAFLDGRDTPPRSAETYLKRLDAALAECPNARLVSVTGRYWAMDRDKRWERVEPAYRLLVDGEGLFHAETGLDALKAAYERDENDEFVKATGIGAPVKMQDGDALIFMNFRADRARQLTSALTDPAFDGFKARQPKFGYYATLTSYGEAYSALPVAYAPQKIHNGMGEYLSSKGLKQLRIAETEKYPHVTYFFNGGEEQVYPGEDRILVPSPKVATYDLQPEMSAGEVTDKIVAAIQSGQYQAIFCNYANGDMVGHSGVFDAAVKAVEALDGCIERCVDAMLAAGGEVLITADHGNCEQMYDGEHHQPHTQHTTNQVPFLYIGRPAKIRAGGSLRDISPSLLAMMGLEQPAEMTGQSLIDFQ

SEQ ID NO: 10521 - protein, 239 aa, Triticum aestivum
VNKKTGKEGRRRSIPHRIALGLEHSSFSPLLGEEEEEEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMP

SEQ ID NO: 10522 - protein, 239 aa, Triticum aestivum
  misc_feature (223)..(223): Xaa can be any naturally occurring amino acid
  unsure (1)..(239): unsure at all Xaa locations
MAAPPSSVSVRAGASVSAKLTPSRAARVGFGGRVSVGSGRKCGGPVRASLFSPKPAVAMDARPTKVQELHVYELNEHDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVYGQVKLNQIVFPFKIFYTFYLKGIPDLPRELLCTPVPPSPTVEPTPXAAKATEPHACLNNFTD

SEQ ID NO: 10523 - protein, 239 aa, Glycine max
MVAQKFVVDLNKPLVFQVGHLGEAYDDWVHDPIVSKEGPRFFQSGFLELFTRTAWWVIPTVWVPVASWFISNSVKSGLPSLDVALLVFLGIFVWTLAEYTLHRFLFHVKTKSYWGNTLHYLLHGCHHKHPMDSYRLVFPPVAAAILALPIWNLVKLICTPSVAPAVFGGILLGYVMYDCTHYYLHHGQPKSDVPKSLKKYHLNHHYRLQNYGFGITSPLWDKVFGTVPPPQSKGDAKRR

SEQ ID NO: 10524 - protein, 575 aa, Rickettsia typhi str. Wilmington
MNDHILINVIILLGTAVFIVAILKRFRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIDENRSQSTQIGRVSLAILLLQDLAVVPLLVIVPLLASNNKASLAVALGIAFLKAVTALLTIFIVGRVLLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALICIKTLIITAFCVLFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIHVVVKLKNLKNAREFYDLGATTIIPESYETGLQIGGTVLKNIGISEQEINRIKVQFRLGNYIIAKKEDALSEVEDND

SEQ ID NO: 10525 - protein, 310 aa, Haemophilus somnus 2336
MIKLLSILARCKPYSYKNLTALLDLTRVQLEKQIAQLRQQGICIVDNEQNISLKPQLPLLNLSYLETELSPYKIYYHPIINSTNQYLMENILQLNKGDLCFTEYQFAGRGRRGREWQSPFAGQLMVSFYWTFNPTVSLNGLSSVLGLATAEVLNEMGAEVKLKWPNDLLLFGRKLAGILVEIVNAKNGLLNFIVGIGINLSLPQENKIDQPWAELLETLPEIDRNDLAIQLVKKWYQYLTIFEQQGMHAFFQRWIKLDYFFGQEVNIISEKEIVCGIEQGIDEEGYLLVALNNGVLRKFNGGEVSLRKKE

SEQ ID NO: 10526 - protein, 88 aa, Glycine max
  misc_feature (72)..(72): Xaa can be any naturally occurring amino acid
  unsure (1)..(88): unsure at all Xaa locations
YASIQPGQVSQNQNFEQSQFAEFRSYEGQVMYVGEKIVPIKLDLCVNHTLVKDQFLWDLDNFESDHEEFAKXLYKDTSIEYPEVGESI

SEQ ID NO: 10527 - protein, 558 aa, Arabidopsis thaliana
MASLVSGDKEAQISGDPGSKRGGWITFPFMLATLLGLSVTSFGWVMNLIVFLIEEFNIKSIAAAQISNVANGCLSVLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 10528 - protein, 472 aa, Haemophilus somnus 2336
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDIAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 10529 - protein, 270 aa, Oceanicola granulosus HTCC2516
MSAQAPVRRMTVPQLARRKGGEPIVSLTSYHAHTAAIVDRHADFILVGDSLGMVMHGMETTVGVPLDLMIMHGRAVVRGTRRALVVVDMPFGTYEESPNVAFRNAAQIMKETGCGAVKLEGGRRMAETIRFLTERGIPVMAHIGLTPQSSHVMGGFKTQGRDEETWDMHSEDARAVAEAGAFALVLEGMVEPLAARITREVAIPTIGIGASAECDGQILVLEDMLGLNPSTPPKFVKVYGELGEMIERAVSDYAEEVKSRAFPGEDNVYR

SEQ ID NO: 10530 - protein, 418 aa, Neisseria meningitidis Z2491
MANKLRNYTINFGPQHPAAHGVLRMILELDGEQIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPDFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 10531 - protein, 682 aa, Oryza sativa
MPAAAAAHHLAGVAAAFLLAVLLHVHLAAGEDEPPPWYLCDPYSASGRYSENSTFQANVNRLSATLPRNTSSSPAMYATGAAGDVPDKVYGYALCRGDVADAHACERCVAAALRDAPRVCPLVKDALVFHDLCQLRYSNRNFLLDDDYYVATYSLQRSSRLVSAPAPAAVAAFDAAVAMLANATAEYAAAANTSRRYGTAEEEGVDGDGDSGRPRMYALAQCTPDKAADVCRACLTTLTTVQLPKLYSGGRTGGGVFGVWCNLRYEVFPFFSGRPLLHLPAFVEAPPPATSAAATRRGEKKRNKTGIVLAIVMPTIAAMLLIVVAYFCCWRRRRPEEQTFLPYDIQSIDSLLLDLSTLRAATDDFAETKMIGRGGFGMVYKGVLPEGQEVAVKRLCQSSGQGIEELKSELVLVAKLYHKNLVRLIGVCLEQQEKILVYEYMSNKSLDTILFDIDKNIELDWGKRFKIINGIAQGLQYLHEDSRLKIVHRDLKASNILLDFDYNPKISDFGLAKIFDGDQSKDITHRIAGTYGYMAPEYAMHGHYSVKLDVFSFGVLVLEIVTGRRNSGSYDSGQDLDLLNHVWGHWTRGNVVELIDPSLGNHPPIEQMLKCIHIGLLCVQKRPASRPTISSVNIMLSSNTVRLPSLSRPAFCIQDVSASDSSNPHSTAVSSNDMSITDLVPR

SEQ ID NO: 10532 - protein, 948 aa, Mycobacterium sp. JLS
MLDSHQPRFADRHIGPDSDAVAVMLDTIGVATLDDLAAKALPANILDALSADGVAPGLELLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRQGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVNVPGRAAEIRDAAKSHGINIWLVDADHVSVSCDEATTADHVAAVLSAFGATRGGKPFAGPEIATRTSEFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 10533 - protein, 383 aa, Ashbya gossypii ATCC 10895
MSQLLPQAYLTNFHNRIRNEDVPLFITAAPTRNHKRAKVVNYSEYDNDLLLDDFIEQDQNDDDEKVHSDNGKGEGEEVGHEDAVASNNNLPDLEQQDDPTGILRYPRIRETFLQSKIAVRYEQVLEAGVGGSGEAVGIAEDEGAGAYSSSSQPVVIPIRLNLEHNGHKIIDFFTWNLNDHSLTLEQFAQIYCQDLDFAHNLSLQNQIVAAINDQLQEYETLASVVVPDLHVIINLTCNLDSKLYEDNFEWNLNDQTLSPEQFAELVVQDLGLTREFMPAIAHALYESILKIKKDWLEGHLNPEHVANGAAFGCLSGIRLDIDTLGSNWCPKVEVLSQWEIEKREIEKERNMRRLKRESAKVDDRLARRRGKRRMDDLETTMRI

SEQ ID NO: 10534 - protein, 152 aa, Cryptococcus neoformans var. neoformans JEC21
MSTTEQTYIMIKPDGVQRGLVGEIIGRFEKRGFKLVALKLHTPSKEHLEKHYSDLSEKPFFPRLIEYMMSGPVVCMVWEGLDAVKTGRVMLGATNPLASAPGTIRGDYALQVGMNVCHGSDSVENGQKEIALWFPEGINQYKLSSQAWLYEA

SEQ ID NO: 10535 - protein, 565 aa, Triticum aestivum
MAAAAAEMVRGFAATARAARPAATVAAPPQPRRAVAARVLRTSASEKVAADLSVAGTNGSLSALSNTDVSTDATSQAVDATPRRKTKIVCTIGPSTNTREMIWKLAETGMNVARMNMSHGDHQSHQKVIDLVKEYNAQNTDGNTVAIMLDTKGPEVRSGDLPEPIMLAEGQEFNFTIKRGVSTEDTVSVNYDDFISDVEAGDILLVDGGMMSLAVKSKTADTVKCVVVDGGELKSRRHLNVRGKSATLPSITEKDWEDIKFGVENGVDFYAVSFVKDAKVIHELKAYLKSANADIHVIPKIESADSIPNLQSIIAASDGAMVARGDLGAELPIEEVPLLQEEIIRTCRSMQKPVIVATNMLESMIDHPTPTRAEVSDIAIAVREAADAIMLSGETAHGKYPLKAVKVMHTVALRTESSLYDPTKAPSLVARPKALLNDDFCKSQLSKMFGSHATMMANTLRTPIIVFTRVGSMAVLLSHYRPSSTIYAFTNEVRVKQRLALYQGVVPILMEFSDDAEETFSRAITSLLDAKYMNEGDYVTLVQSGSQSIWREESTHHIQVRKVQC

SEQ ID NO: 10536 - protein, 269 aa, Bartonella henselae str. Houston-1
MSDRYRFTILGCGSSPGVPRPNGDWGACNPNNPKNKRYRSSLLVERIHKSGKKTTIVIDTGPDFRSQMIDACVNHLDAALYTHSHADHIHGIDDLRSYALAQKSLIDIYADSFTLRHLKNAFGYCFQTPKGSSYLPILKAHLINEDSQFIIQGQGGAIHVNTHLQLHGSIHSLGFRIGNVAYCTDVSQFPKKTLPKLMNLNVLIIEALQFKSHPSHLSVDQALQWIKYLQPKQAILTHMDRSLDYNEVINYLPPHVKPAYQGLIFEADA

SEQ ID NO: 10537 - protein, 362 aa, Pseudomonas putida KT2440
MNDLSHTHMRAAVWHGRHDIRVEQVPLPADPAPGWVQIKVDWCGICGSDLHEYVAGPVFIPVEAPHPLTGIQGQCILGHEFCGHIAKLGEGVEGYAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEAGANVVLDPSQCDALAEIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 10538 - protein, 166 aa, Arabidopsis thaliana
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGNNGETTTQGFDDLVKRCAKYYEAGARFAKWRAVLKIGATEPSQLSIDQNAQGL

SEQ ID NO: 10539 - protein, 172 aa, Triticum aestivum
MAARAVTMLAAAALVVVAAVLAGGASAQSTSGCTQTLIGMSPCLNYITGNETAPSKSCCSQLATVVSSKPECLCVALNADPAALGLGTVNKTRALGLPDQCGVKTPPLSNCASAPTTSPSSGAPAGQTPTSSGAGSKSTPTADVGSGGASLQSSAGIIAGFIVAAVYAVSAM

SEQ ID NO: 10540 - protein, 348 aa, Cryptococcus neoformans var. neoformans B-3501A
MTRQTFGMKNKNKSSKVQKHIATVQKQQEQAGKSKGDKAKEREREKAAEAKAAALAKKKMEAELFRPAQIQKVPFGTDPKTVLCVFFKAGHCEKGNKCKFSHDRNVERKVEKINLYADQREEKSKDSMDTWDEEKLRNVVTENGRKQNNATDIVCKYFIQAIEDRKYGWFWECPNGGNKCMYRHALPPGFVLKSDKKKQEEAAKKDQISLEQFIEVERHKLKPPLTPVTPETFATWKKNRLEKKAAEQEALEKAKATQRAAGKMTGMTGKDMFEFGGELYEHVDEGEEEDEDWDISRMLARYRDDETATTAFDPTKGKFVNPRTGEVVDDPEDESIAEVAKKVEGVKV

SEQ ID NO: 10541 - protein, 329 aa, uncultured bacterium 580
MANLLFEIIEFLADGKFHSGEMMAKHFNVSRVSIWNAIAKAEDVGIKIFSVRGKGYKLQHPISLLNEKIIKNAMGEEGSWFDIKVLDSIDSTNNYLSKIAATGHPHASVVAANIQMQGKGRRGRQWQSALGESLTFSFLWRFTKGAAGLSGLSLAVGVALIRALKKINISTALLKWPNDILIFDEGVYKKLAGILIELQGDTDGQSAAIIGIGLNLNLSKTQLEKIDQPATDINNLVSEKIDSNFFMAIIIKELAQALASFESDQFKPFKDEWLSYHAFQDKLIDIMLGNSQTITGKAIDISDTGALIVRTDEGSKSFASGEVSIRSAG

SEQ ID NO: 10542 - protein, 185 aa, Arabidopsis thaliana
MKDGDSLPISTSSVTATTVTGKKETGYSALFSKGRYKFWALAAILLLAFWSMLTGTVNLRWSAGNINHFTDDLVFPIHEDLDVLEMEEREKVVKHMWDVYNNGRRIRLPRFWQEAFEAAYEELTSDVPDVVEAAISEIARMSIRSIVIDPPPLHSTNVRELTKTLKLADKGRATQISKPSSRRLK

SEQ ID NO: 10543 - protein, 76 aa, Lycopersicon esculentum
WIVAASVGAVEALKDQVGLCRWNYPLRSLAQHTKNNVRSYSQAKKLSSSITTKSEKMEKSEESLRKVMYLSCWGPN

SEQ ID NO: 10544 - protein, 333 aa, Frankia sp. CcI3
MGTGTGENQADTRPPGAVASPDGPPPLRAAAERPGVVQFRMNSCRAAGFLSCRRVTTGRRHDRPRAGESQATTGNAGRAGRRAGRISGMPTLVLLRHGESIWNRENLFTGWVDVDLSEKGAKEATRGGELLRESGVLPDVVHTSLLTRAIRTAWLALDAAGRTWVPVRRTWRLNERHYGGLQGLNKAETLEKFGAEQFQLWRRSYDTPPPEIGPEQVSGVDERYDDLAPDVIPRTECLADVVARMLPYWYDAIVPDLRTGRTVLVAAHGNSLRALVKHLDHISDTDIAGLNIPTGIPLRYELDDQLGVVSSGYLDPDAAALAAAAVAAQGTKK

SEQ ID NO: 10545 - protein, 500 aa, Streptococcus mutans UA159
MNKRVKIVATLGPAVEIRGGKKFGEDGYWGEKLDVEASAAKIAELITEGANVFRFNFSHGDHAEQGERMATVRRAEELARQKVGFLLDTKGPEMRTELFADGVKEYEYKTGDKLRIATKQGIESTKDVIALNVAGGLDIYDDVAVGQTILIDDGKLGLTVTAKDITTREFEVTVENDGIIAKQKGVNIPNTKIPFPALAERDNADIRFGLEQGLNFIAISFVRTAKDVNEVRQICKETGNEHVKLFAKIENQQGIDNIDEIIDAADGIMIARGDMGIEVPFEMVPVYQKMIITKVNAAGKSAITATNMLETMTDKPRATRSEVSDVFNAVIDGTDATMLSGESANGKYPVEAVRTMATIDKNAQTLLNEYGRLNSDNLPRTNKTEVVASAVKDATKSMDIKLVVTITESGNTARLISKYRPDADILALTFDEKVQKSLMINWGVIPILTEKPASTDDMFEIAEKAALKSGLVESGDNIVIVAGVPVGSGGTNTMRVRTVQ

SEQ ID NO: 10546 - protein, 390 aa, Magnaporthe grisea
MSKQQHPSSKTQITRRRDTADMTFEQVLHKGSSANMGGLSSMLGKDREASKTAVDQYFRHWDGKTAKTETTKVREERKADYATLTRQYYNLVTDFYEYGWGQSFHFCTFAPGETFASAITRYEHTLAHRIGIKKGMKVLDIGCGVGGPARQIAKFTGANITGITINEYQVERARRYAEMEGYGAGEQLKFVQGDFMALPFEKETFDAVYSIEATVHAPKLEDVYKQIFNVLKPGGIFGLYEWVMTNAYDENDPHHKEIRFGIEHGGGIANLQTAQTAIAAIKAAGFELLESEDLADNSDRAPWYWPLGGNAWQYASTFGDILSTFTMTPAGRAIAHTVLGVVESIGLVPPGTKKTADSLSTTAAALVAGGKEGLFTPMFLMVARKPVAKE

SEQ ID NO: 10547 - protein, 430 aa, Pyrobaculum aerophilum str. IM2
MKIRLLGGAGEVGRLAVLIKTASNGILLDYGVSFDANDKPVFPLHVRPRDLTATFLSHAHLDHSGGLPSLYVSTKTPLYSTPLTMELSDLMYTDAIKLSGYYLPYTLEEVRETMSSAVPLTYGEPVEIGRDAVITVYNAGHIPGSAISVIEVEGYVVVFTGDFNTVDSNLLRGADLYNIPKNPDVVIMEATYASTDHPPRERLEREFVQSVKEVLEGGGSVLIPSFALGRAQEILLTLVKYGIDAYPIYVDGLARQINQIVGRYPHLLKDPDLYKKALEISIEVPNAYVRKGAVEEPSVIITPAGMLKGGAALFYFKKMAQNKKNGIFLPSFQAPNTPGFQILSKGYAFLDGTTIKVEARLEWFDFSAHAGRRELEEFVKRFTPETKIILVHTDPLTAAPFIRRLAKEGYDNIYLPTASGEEIFLSKKFW

SEQ ID NO: 10548 - protein, 217 aa, Shewanella sp. ANA-3
MNQSLLAPFGTAIERVEAGLEALRQGQGVLVVDDEDRENEGDLIFAAESLTNAQMAMLIRECSGIVCLCLPDEKVKALELPPMVENNSSQYGTAFTVSIEAKVGVTTGVSAADRVTTIKTAIADNAKPSDLARPGHVYPLRAQPGGVLTRRGHTEGTIDLMQLAGLKPAGVLCEVTNPDGTMARLPEIIAFGAEHNMPVLTIEDIVIYRKSLLANVG

SEQ ID NO: 10549 - protein, 220 aa, Bacillus anthracis str. 'Ames Ancestor'
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 10550 - protein, 522 aa, Acidobacteria bacterium Ellin345
MPDRSEAPDLSTQAQVRSTAAKDEGFIQGLGLTSATTLVMGSMIGSGVYIVAADITRLVQSPALLIGAWLVTGFMTITAALAYGELAAMMPKAGGQYVYLREALGPLTGFLYGWTLFMVIQTGTIAAVGVAFGKFLGIFFPSISSSHWIWHIAHVPPIHIGPMVLGNMDVGLNTQNLMGILTIIFLSVLNVYGVKLGALVQNVFTFAKTAALLGLVVLGITIGRTAEAMAANFHGHFFEGAGWTSVHPVQVGVGGPMALVITVTVLAVAQVGSLFSADAWNNVTFTAGEVKNPQRNLPLSLAIGTGAVILLYCLANFVYLLVLPMVGDPNGTTVLARGIQHATEDRVATAVMQQIFGAAGAAIMAVLILISTFGCNNGLILSGARVYYAMAKDGLFFKSAGKLHPEHKTPAASLFVQCIWCCILCVSGSYGQLLDYIVFAVLIFYILTIVALFVLRLKKPDVPRPYRAIGYPILPAIYILMALFIDIVLLLYKPQYTWPGLIIVLLGIPVYFIWSRVNRATA

SEQ ID NO: 10551 - protein, 436 aa, Streptomyces sp. 139
MRLPRSRAVNERLHALVPGGAHTYAKGDDQYPQDLAPVISHGRGAHVWDVDGNRYIEYGSGLRSVSLGHAHPRVLEAARRELDRGSNFVRPSVVEAEAAERFLATVPTAEMVKFAKNGSDATTAAVRLARAVTGRARVALCADHPFFSTDDWFIGTTPMSAGIPAETTELTVTFPYGDLAATEELLDRHRGEIACLILEPAAQTEPPPGYLAGLRELADRHGCVLVFDEMITGFRWSEAGAQGLYGVVPDLSTFGKALGNGFAVSALAGRRALMERGGLRHDDDRVFLLSTTHGAETHALAAAMAVQATYTEEGVTARLHALGERLAAGVRDAAAAMGVGDHLVVRGRASNLVFATLDGPGRPSQEYRTLFLRRLLTGGVLAPSFVVSAALDEADVDRTVDVVGQACAVYRKALDAGDPTPWLGGRPVRPVFRRRA

SEQ ID NO: 10552 - protein, 261 aa, Thermus thermophilus HB8
MRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVQGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 10553 - protein, 177 aa, Medicago truncatula
MALISSAAVTTVNRVSANLVAPFTGLKSSAGFPVTKKTNNDITSITSNGGRVNCMQVWPPIGKKKFETLSYLPPLTEDQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 10554 - protein, 393 aa, Solanum bulbocastanum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNFFRIGGVAADLPYGWIDKCLDFCDYFLTGVAEYQKLITRNPIFLERVEGVGIIGRDEALNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFMIGDQSVFPWRWKIRPPGFINLQILPQLVKRMKLADIMTILGSIDIIMGEVDR

SEQ ID NO: 10555 - protein, 456 aa, Escherichia coli
MMEGQQHGEQLKRGLKNRHIQLIALGGSIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFLLLYPLGNWICLLFMAAVLVIMLMTRGMGIWVYLIPVWLIVLGIGYLFKEKTAKAVKAH

SEQ ID NO: 10556 - protein, 180 aa, Medicago truncatula
MALISSAAVTTVSRASSTQANLVAPFTGLKSSAAFPVTKKTNNDITSIASNGGRVNCMQVWPPIGKKKFETLSYLPPLTEEQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 10557 - protein, 433 aa, Blastopirellula marina DSM 3645
MASTETTSRSAELYQRACRSLATGVSSSLRRFVTETPLYIDHADGAHFYDVDGNCRADYTLGWGPLIVGSNHAGINAAVAKQLTKGYTYGCQHVAEIELAELIVESVPGVEQVIFSNTGTEAIQSAIRIARAHTGRDKILKFEGHYHGWLNNVLVSYRPKSEDTTLAQPTCGGQPASEYADTLVLPWNDIDALKDLFALRGDEIACVLTEPILANSGSCMPKPGYLEALVELCREHGAVSIFDEVITGFRIALGGAREYFGVEPDLSVYGKALAGGFTMSAVGGRAEMFEVLRDQRTIHSGTYNGTTFNIIAAIETIRELRKPGTYERMNAHGQAIAEALTSAAADVGLDVVVSGVGSVFSVHFGVKQAPRDYRDTTRSDMQTYTRFRAAMLDNGVQLLPDARWYIGTQHDEAVLEHVINAIESSMKDTVRCS

SEQ ID NO: 10558 - protein, 393 aa, Nocardioides sp. JS614
MKAVTWQGRKDIRVEEVPDPRIEEPTDAIIRVTTTGLCGSDLHLYDPLTPFMTPGDIVGHEPMGVVEAVGSEVTELAVGDRVVVPFNISCGSCWMCERGLHSQCETTQNRDTGTGASLFGYSSLYGAVPGGQAELLRVPFADFLPVQVPHGPPDDRFIYLSDVLPTAWQGIAYAGVPEGGTLLVLGAGPIGDMATRIALHRGIRVIVVDRVPERLARVSARGAEILDLGEIDDVAEQVRGLTGGRGADSVLEAVGMEAHGSPVAEAVQKSLRLLPKKLQQLMMTNLSVERLAALYLAFEAVRRGGTVSISGVYGGTSDPMPMMQLFDKQLQLRMGQANVRAWTDELRTLLEQDEDHLDVEGFATHHLPLDAAPQAYASFQAKDDGMVKVLFRP

SEQ ID NO: 10559 - protein, 464 aa, Aneurinibacillus thermoaerophilus
MKLILLSGGSGKRLWPLSNDSRSKQFLKVLKNDNNEFESMVQRVWNQLHTVGLAEDSYVATSKSQVDMLHAQLGTEVPLIIEPERRDTFPAIALAATYLYSMEGVREDDVISVLPVDPYVESRFFDRVKDLETALVQSSAELALIGVKPTFPSEKYGYIVPKKGEHDVVANVLAVDYFVEKPSTSRAQELMKQQAFWNCGIFAFKLGYLISLLKEKKLPTDYEEMLHTYNQLPKISFDYEVVEKAQNIIMLPYEGEWKDLGTWNTLTEEMNTNLLGKGIISEGCENTHLINELDIPVTILGISNAVIAASPDGILVTDKEASPRIKDIMKNFNQRPMYEERRWGWYRVLDHTKVENGNEVLTKRIGVHAGKNLSYQIHHKRSEVWTIISGEGQFVLNDQLYHVKPGDVLQIPVGAKHAIRAITDLQFVEVQTGSELIEEDIIRLCMTWEETLDCCKDCIVKVIR

SEQ ID NO: 10560 - protein, 197 aa, Zea mays
MEKSTRTLMIITIVITSMLVGFGSSDLDQDREECTDQLIALSPCLPYVGGNAKAPTKDCCGGFDQVITKSEKCVCILVKDKDDPNLGLKFNATLAAHIPTLCHITAPNITKCISLLHLSPNSTLAKEFESLGRIEYEGKTNSTSPSHNVKDGTGGGKAEQVKSTGEKKSWLAVELLIFALFSHLLFIIPSFTSSSFI

SEQ ID NO: 10561 - protein, 109 aa, Brassica napus
  misc_feature (96)..(96): Xaa can be any naturally occurring amino acid
  unsure (1)..(109): unsure at all Xaa locations
MFFQIIQGVFTGVEALALLAFAGITLGGSAVGLALSTPLFILFSPILVPATIATTLLTTGFTTSGGLGIVALRIFWKLFKRLRKKGKGTPKIPGLXAPGAPDSNSVSGG

SEQ ID NO: 10562 - protein, 341 aa, Rubrobacter xylanophilus DSM 9941
MDKGQLESTARALVAPGKGILAADESFGTIGKRFKAVGIESTEDTRRRYRQMLFTTPGIGEFLSGVILFDETIRQKADDGRPLPRVLEDQGVIPGIKVDKSTTALPLSPQEKFTQGLDGLRERLEEYRGMGARFTKWRAVITIGEGIPTERCIGANAHGLALFAAFSQEAGLVPIVEPEVLIDGDHTIERCYEVTEWTLNRTFDYIYEMGVELSGMLLKPNMVISGKDCPEQAGVEEVARMTVECLKRSVPAAVPGIVFLSGGQSDIQATAHLNAMNRLYDDLPWELSFSYARALQGRPMEIWKGDDANVEAAQKAFYHRAKMNSAARSGSYSEEMEKEAA

SEQ ID NO: 10563 - protein, 142 aa, Brassica napus
RGGPRRPEKEEKLLLVNFFFSSAVVVTARVKATMGVPLTAWKSSFAFPVTRRATTAIPSIVGTGGGVNCLQVWPPIGKKKFGTFFYFPDLTEVEWGKEVDYFFRTRWIPGVEFKLEHGFVARGHGSTPGYYDGRYWPMWKLP

SEQ ID NO: 10564 - protein, 337 aa, Glycine max
  misc_feature (300)..(301): Xaa can be any naturally occurring amino acid
  misc_feature (325)..(325): Xaa can be any naturally occurring amino acid
  misc_feature (336)..(336): Xaa can be any naturally occurring amino acid
  unsure (1)..(337): unsure at all Xaa locations
MESKNPARFTLGKQSSLAPERHNKEAELQKDGEAVDQGVRLMYSAFEGDVDGIREALESGVSVNYKDIDNRTALHVAACEGFTDVVDLLLQKGAEVDPKDRWGSTPLADAIFYKKNDVIKLLEKHGAKPLMAPMHVNHAREVPEYEINPKELDFTNSVEITKGTFCSALWRGTKVAVKKLGEDVISDEEKVKAFRDELALFQKIRHPNVVQFLGAVTQSSPMMIVTEYLPKGDLRDFMKRKGALKPSTAVRFALDIARGVGYLHENKPSPIIHRDLEPSNILRDDSGHLKVADFGVSKLXXVKEDKPLTCQDTSCRYVAPEVSDXEEYDTKVDVFXF

SEQ ID NO: 10565 - protein, 267 aa, Frankia sp. CcI3
MVMIVAVMGAGRLGGAMLSGLLRSGHAAQDIVVAERDADRAGEIVARHGVEVQAPTVAAAKADVLIIGVKPQDVGTLLAEIGSVVANGTLVVSLAAGITTDLLEERLPSLPPVVRVMTNTPLLVGEAMSAICGGRYAEEKHLATAEALLTPVGRVTRVAESQLDAVTALSGSGPAYFFYLVDAMIEAGVLLGLPRTLAAELMTQTALGSARMLRESGEHPALLREAVTSPAGTTIAALRELDRRGVRAALMDALEAASSRSRELGRS

SEQ ID NO: 10566 - protein, 149 aa, Triticum aestivum
  misc_feature (56)..(56): Xaa can be any naturally occurring amino acid
  misc_feature (84)..(84): Xaa can be any naturally occurring amino acid
  unsure (1)..(149): unsure at all Xaa locations
AYLGDSLEQVCTKKQAGTGPEFPGYRRPTRPFSSPAPRGRFVAARVRASAEAMATXNLGVRVERNPAESRLSELGVRQWPKWGXCDKSKFPWTYSAKETCYLLQGKVKVYPDGEEGFVDIAAGDLVVFPKGMSCTWDVTEAVDKHYKFE

SEQ ID NO: 10567 - protein, 403 aa, Thermobifida fusca YX
MRAVVWHGVGDIRVEDVDEPTIQDPQDAIVQLTTSAICGTDLHLLRGTIPGMRPGTIMGHEGVGVVTEVGPGVRNFRPGDRVVISPTIGCGACSYCRAGYFSQCDNANPAGRRSGTAFLGGPEANGAFHGTQAERVRVPYANVGLIGLPERVSDEEGILLADMFPTGWFGARLAEVTPGDTVAVFGCGPVGLFTILSAWQQGAGRVLAVDGVESRLEQARGLHAEVINYNVEDPVAALVELTGGIGPDRVIDAVGVDAQRPESGPAVAAEDDVHRLEKEHAATVPSARPGETAQILSDERAQVLQWAVEAVAKAGTLAIIGNYPLNARIFPIGLAMNKNLTLNAGSCHHRKYIPKLLDMITSQQLDITSVLTQEEPITGDVLRAYEAFGQHKPGWTKVALTTV

SEQ ID NO: 10568 - protein, 394 aa, Oryza sativa (indica cultivar-group)
MTTRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSVRIIVQCPNQMPSGMIKADDRKLCPPSRSRMKLSMESSIHHFELYTEGFSVPAPSTYTAVEAPKGEFGVFLVSNGSNRPYRCKIRAPGFAHSQGLDSMSKHHMPADVVTIIGTQDIVFGEVDR

SEQ ID NO: 10569 - protein, 224 aa, Triticum aestivum
  misc_feature (123)..(123): Xaa can be any naturally occurring amino acid
  misc_feature (167)..(167): Xaa can be any naturally occurring amino acid
  misc_feature (196)..(196): Xaa can be any naturally occurring amino acid
  unsure (1)..(224): unsure at all Xaa locations
MGNSQASPSSASSASFVMASRAFSKQALDDLRAHFSSLAAQSGTRGRAISRPVFLDYFGVRGALGDRLFQLVAKESSVEDGVTFEGLIVSKATYERGTKDEADEFIFQLCDVMGDSILTRSDXLEAVLASIHETIFADNKEAKEGSNKSTFEAFHNSAVISKDAEGXSLEKSMSLSDFRTWCIVMPPLRKFLGSLXMPSDSSKAGFQVLLLHYSEKISSKFVSL

SEQ ID NO: 10570 - protein, 802 aa, Bacillus cereus E33L
MFTHVESFKSAFLEKLETMYGKSFKDSTTRDQYNTLGYMVREYMNSQWIATNESYRSGERKQMYYLSIEFLLGRLLGSNILNLGIRDVCEQGLSELGISLQQLEEVEADAGLGNGGLGRLAACFLDSLASLNLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHNEGKILRLKQQYFLVSASLQNIVRLHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEEVLHYYQNGGYRASDYYHHNGHIKKVVDQLTNGFFAQSGAEFEAIYDSLVIQNDEYFVLRDFGPYAERQEAVGRAYENRTKWLEMSILNIAQSGHFASDRTILQYSNEIWGIGNTVTQI

SEQ ID NO: 10571 - protein, 249 aa, Arabidopsis thaliana
  misc_feature (131)..(131): Xaa can be any naturally occurring amino acid
  misc_feature (165)..(165): Xaa can be any naturally occurring amino acid
  misc_feature (195)..(195): Xaa can be any naturally occurring amino acid
  unsure (1)..(249): unsure at all Xaa locations
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADXGLGGSGLAMPVEVVQFCWNFNLIRLQDLFREFGXGSKVRGDGRASLRGLKQEGQYLFYFNTPLXDRFPPAKEIGNFQGLVEHGLFLGMATSVIIAGKNGGERRGQREVKSSMGFLLGE

SEQ ID NO: 10572 - protein, 98 aa, Ammopiptanthus mongolicus
MARSFTNAKVLSVLVLNRFSSSLTRRGYAAASATQSAKRGGVVSISGKMAPKSGEEKRATTDKVSWVPDPVTGYYKPENIKEIDVAELRATLLGKKFN

SEQ ID NO: 10573 - protein, 307 aa, Pyrobaculum aerophilum str. IM2
MSALIVDKVDETLKERLERIGIKVDLAPGISKDDLIKIIKNYNILIFRGRLKIDKDIMDAGQNLKILARYGVGLDNVDVEYAVKKGIAVVSAPNAPSQSVAELTIGLLFSVARRIPLLNAKVKAGEWPKGKYIGIEIAGKTMGIVGFGRIGRFVAQMAKSLGMNILASDVIDVSKEVAKIGGRQVPLEELLRQSDVVTIHVPLTPETYHLLNAERLSLLKDGAIIINTSRGEVIDHEALLKHLDRLWGVGLDVLPEEPPKSHYLRQLIAHEKVVVTPHVGSETKEAMMRLAEELAANIEEVIQRIKL

SEQ ID NO: 10574 - protein, 282 aa, Mycobacterium sp. JLS
MSTVPTVTLNDGASIPQLGFGVYQVKPDETANAVKTALDIGYRHIDTAEMYQNERGVGEGVRDAGIDRAEVFVTSKLNNGFHRPDDARRAFDKTLSELGFEYVDLFLIHWPLPTLYDGDFVSTWQTLEEFKKDGRARSIGVSNFQVDHLGRLARETETVPAVNQIEVHPYFTNDAVRAYGREHGIATEAWSPIAQGQVLDDPTVTRIAEASGKSPAQVVLRWHVQRGDIIFPKSVTPERIEENFNLFDFELSEADVDALSGLDKSEQGRIGPNPDTFDYIPD

SEQ ID NO: 10575 - protein, 180 aa, Lycopersicon esculentum
MASSIVSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 10576 - protein, 448 aa, Aspergillus oryzae
MAASQAANIVEKVVGHNDNATVTTDVSNYNKGAYGQETGEKIKATTWQGKNSVQIVEMPKPRVVDEGDVIVKVTGSTICGSDLHLYHGVIPQLEKGDVLGHEFCGVVESVGPTVKKVKAGDRVVAAFPIACGECRNCKEQLTSACERTNENSITNAMYGKRTAGMFGYSHFTGGFAGGQAEYVRVPYGDVNLLQLPADVPDEKGLYLSDVLATAYHCVVDTGVKKGDVVAIWGGGPIGQMAAEYSFSQGATRVILIDGGEGAWRLDFVTSKIPKLETIDFSNLPRGESITSQLKKIVPGGPDVALECAAGEYAKGWAHYFEMLLGMETDTSEILNEMITAVRPFGRIGVTGVYAGYTNHFNIGALMQTGIRFIGNGQAPVQKYWEHLLELIRRQEINPLDMVTHRVSLENMPELYAAFEGRDKGMQKVYVQTRFSSPPAEGSPQLTEL

SEQ ID NO: 10577 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 10578 - protein, 287 aa, Pediococcus pentosaceus ATCC 25745
MAIIQWYPGHMAKAIRQVEEKLKLVDIVFELVDARIPVSSRNPMIEDVIKSKPHLLILTKADLADPKETKKWLDYYKSRNEYAIALNSKEPSTENIILKKTQEILADKLANKADRGIKNAEIRSMCIGIPNVGKSTLLNHLVNKKVAITGDRPGVTKKQQWLRSRRGLYLLDTPGILWPKFEDQNVGNKLAFTGAIKDNLFANDDVVIYGLNIFINHYREGLMGRYHLTEDDLEMELPELLLLITQKLGMRDDYDRASQRILLDARKGKLGRFTLDFVEEFEDLGDD

SEQ ID NO: 10579 - protein, 174 aa, Ammopiptanthus mongolicus
MISSPAVTTVKASMGAPFTGLKSMASFPVPRKVNSDITTIANNGGRVQCMLVWPPLGRKKFETLSYLPPLSIESLTKEVEYLLRKGWVPCLEFELEHGFVYRENNRSPGYYDGRYWTMWKLPMFGCSDASQVMKELEECKKEYPTAFVRIIGFDNKRQVQCISFIAYKPPGFEN

SEQ ID NO: 10580 - protein, 180 aa, Lycopersicon esculentum
MASSVMSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 10581 - protein, 344 aa, Bacillus halodurans C-125
MKVKVAINGFGRIGRMVFRKAVENKQFDVVAINASYPAETLAHLIKYDSVHGPFQGTVEIKNDALVVNGKEIKLVNSRDPRVLPWKDLEVDIVVEATGKFKTKETAGYHLEAGAKKVIITAPGKNEDVTVVVGVNENDYKPEEHHVLSNASCTTNCLAPVAKVLDEAFTIQSGMMTTVHAYTNDQKNIDNPHKDLRRARACGQSIIPTSTGAAKAISKVLPQLEGKLTGMALRVPTPNVSLVDLVVQVKEDVTPEKVNHVLKQAAAGSMKGILGFTEEPLVSIDFNGNEHSAIVDGLSTMVMEDTNQVKVLAWYDNEWGYSTRVVDLVELVAKELKKPAKVIAS

SEQ ID NO: 10582 - protein, 680 aa, Arabidopsis thaliana
MSDDPGQMLLIYDDPSDQRSLSLDDASSTEESPDDNNLSLEAVHNAIPYLGQIFLTHDAAYEFYSTFAKRCGFSIRRHRTEGKDGVGKGLTRRYFVCHRAGNTPIKTLSEGKPQRNRRSSRCGCQAYLRISKLTELGSTEWRVTGFANHHNHELLEPNQVRFLPAYRSISDADKSRILMFSKTGISVQQMMRLLELEKCVEPGFLPFTEKDVRNLLQSFKKLDPEDENIDFLRMCQSIKEKDPNFKFEFTLDANDKLENIAWSYASSIQSYELFGDAVVFDTTHRLSAVEMPLGIWVGVNNYGVPCFFGCVLLRDENLRSWSWALQAFTGFMNGKAPQTILTDHNMCLKEAIAGEMPATKHALCIWMVVGKFPSWFNAGLGERYNDWKAEFYRLYHLESVEEFELGWRDMVNSFGLHTNRHINNLYASRSLWSLPYLRSHFLAGMTLTGRSKAINAFIQRFLSAQTRLAHFVEQVAVVVDFKDQATEQQTMQQNLQNISLKTGAPMESHAASVLTPFAFSKLQEQLVLAAHYASFQMDEGYLVRHHTKLDGGRKVYWVPQEGIISCSCQLFEFSGFLCRHALRVLSTGNCFQVPDRYLPLRWRRISTSFSKTFRSNAEDHGERVQLLQNLVSTLVSESAKSKERLDIATEQTSILLSRIREQPVSSLAIRDISSSVQRNF

SEQ ID NO: 10583 - protein, 121 aa, Arabidopsis thaliana
  misc_feature (83)..(83): Xaa can be any naturally occurring amino acid
  unsure (1)..(121): unsure at all Xaa locations
IVFFFFFFFCLSSFFASIVMADEYTGEATGSSEAKVHIIYTEKPTDEEPKTYHLRTLSSALGSEEAAKDALIYSYKEAASGFXAKLTPEQVAEISKQPGVIQVVPSQTYQLHKPGGGGGSS

SEQ ID NO: 10584 - protein, 359 aa, Pneumocystis carinii
MHGKDAAKERGLLSSFRRIKKPKTERLDSYFGFWGDKCTSEKKNDVHPPERFKFYATLTRHYYSLVTDFYEYGWSISFHFCRLCKNESFSQAIARHEHYIALHAGIREGETVLDVGCGVGGPDCQISVFTGANIVGLNNNDYQIQRAKYYSEKKGLSDKLKFIKGDFMQMPFPENSFDKIYSIEATIHAPSLEGVYSEIYRVLKPGGLYASYEWVMLTEYDENDPEHQQIVYGIEIGDSIPKISKIGEAEAALIKVGFEIIHSEELSTKNSPLPWYYYLDGYLKRVRSFRDFISIARMTTIGKWLISSFIGLMEFIGLLPKGSKKVNDILLVAADSLVKAGKKEIFTPMQLWVCRKPLV

SEQ ID NO: 10585 - protein, 236 aa, Avicennia marina
MLGVFSSSIVSPPDELVAAGSRTPSPKVAATKLVGRFLEANSSAVSVKIGDDAQLAYTHHNQSALRPRSFAVKDEIFCLFEGALDNLGSLKQQYGLGKSANEVLLVIEAYKALRDRAPYPPSHVVGHLQGNFAFIVFDKSTSTLFVATDEFAKVPLYWGITADGYVAFADDADLLKGACGKSLASFPQGCFFSTAVGEIRSYENPKNKITAVPAQEEEIWGAKFMVEGPGMIAASK

SEQ ID NO: 10586 - protein, 177 aa, Triticum aestivum
  misc_feature (105)..(105): Xaa can be any naturally occurring amino acid
  misc_feature (123)..(123): Xaa can be any naturally occurring amino acid
  unsure (1)..(177): unsure at all Xaa locations
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSXPGYYDGRYWTMWKLPMFXGCTDATQVLNEVEEVKKEYPDAYVRVIGFDNLRQVQCVSFIAFRPPGCEESGKA

SEQ ID NO: 10587 - protein, 421 aa, Arabidopsis thaliana
MAPEKIPEPSVHSEEEVFEDGEEIDGGVRLMYLANEGDIEGIKELIDSGIDANYRDIDDRTALHVAACQGLKDVVELLLDRKAEVDPKDRWGSTPFADAIFYKNIDVIKILEIHGAKHPMAPMHVKTAREVPEYEINPSELDFTQSKEITKGTYCMAMWRGIQVAVKKLDDEVLSDDDQVRKFHDELALLQRLRHPNIVQFLGAVTQSNPMMIVTEYLPRGDLRELLKRKGQLKPATAVRYALDIARNILRDDSGHLKVADFGVSKLVTVKEDKPFTCQDISCRYIAPEVFTSEEYDTKADVFSFALIVQEMIEGRMPFAEKEDSEASEAYAGKHRPLFKAPSKNYPHGLKTLIEECWHEKPAKRPTFREIIKRLESILHHMGHKRQWRMRPLTCFQNFEHKKKHNWDLSSHDGSSSGSHL

SEQ ID NO: 10588 - protein, 262 aa, Ehrlichia ruminantium str. Welgevonden
MKITILGSGSSSGVPIIGCDCSACKSHLQYNKRTRASALFENNGTKLLVDTTPDLRIQALQHNLSSVDGILYTHFHSDHCDGISDLQPFVPTNELNTVHIYSDVMTLCSLVASNSYFFIRGIVSKWKKCHYLTPNIMYYYQEYNIGSFRILMIKQDHGVADCNGFIFNNQVAYCTDVKSFPKKSFDLLYKIKVLILGCLKYEESFAHSSVNTCLEWVAELKPETTIFTHMSHDLEYYSLIDYIKSRIDANVIVGYDGLQFVI

SEQ ID NO: 10589 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 10590 - protein, 959 aa, Pseudomonas aeruginosa PAO1
MTDNLNLGAIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESTIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQTDVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 10591 - protein, 571 aa, Acidobacteria bacterium Ellin345
MHADILLQISLAILVATGLALLAKLLRQPLILAYIAGGIIVGAVQGFGWVQTDVIEPISELGLILLLFMIGLEIDLKKLKSAGAPVLATGIVQFFACVGLGFAFFPLIGFSLRTGGLSVLYLSVACALSSTMIVVKLLYDKFEIDTVPGRITLGVLVFQDIWAILFLAIQHDLSHPRPLLLLLSLAKGIAVVAVAFAASRYLLPILFRSIAKSPELVLISALAWCFGVAMVASYVGLSREMGALIAGVAISTFPYNMDIVAKIITLRDFFVTLFFVTLGTKVPRPTFGLLLIAVGVSIFLNLSRFLTVFPVLHRFKEGNRASFLPALNLGQISEFSLVICALGVSVGHISDRILSVVLYTLVITSVTSTYAIMASHRIFTFVNRGLIAVGIHDLGDPAGEMEKPEPRPIVFLGFSRASSSMLVELLEMEPERKDEIAIIDFNPEAKAELDRRGLHVIYGDISHRDVLHHAGVEEAKLVISTIPDSLLKGTSNLKLLRMIRGLAPEADVIVTAEFFSHARELYAAGATFVFIPRLMSAVDLAGAVFAIMADQGEQLRERAQEALRDRDEVLP

SEQ ID NO: 10592 - protein, 584 aa, Bacillus halodurans C-125
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 10593 - protein, 338 aa, Burkholderia mallei ATCC 23344
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYEPVKRYIDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHEQAQS

SEQ ID NO: 10594 - protein, 127 aa, Glycine max
  misc_feature (33)..(33): Xaa can be any naturally occurring amino acid
  misc_feature (40)..(40): Xaa can be any naturally occurring amino acid
  misc_feature (52)..(52): Xaa can be any naturally occurring amino acid
  misc_feature (99)..(99): Xaa can be any naturally occurring amino acid
  misc_feature (119)..(119): Xaa can be any naturally occurring amino acid
  unsure (1)..(127): unsure at all Xaa locations
MASSMISSPGATTVDRAGADMVAPFTELKTMAXGFPTRKXSDDITSIASNAXRVQCMQVWPFLGKKKFETLYYLPDLDNDNWERKYNTFLTKGSIPCLXFEMEHGFLYREHNRSPGYYXGRYWTMWK

SEQ ID NO: 10595 - protein, 269 aa, Bartonella henselae str. Houston-1
MKMDYILSDFAQKQGYAVESYEIVDSTNYIAQQKAHAGHHGYLWVVAKEQSQGRARRGRTWSSPKGNLYSSLLLVEDIVHQTAAQLGFVAGVSVVETIKQFIKDEKQTSDIVSLKWPNDILLRGAKSSGILLEIFKLPSQQYALVIGIGINVKYHYEDAPYPTSSLKNIGLDIETEQLFTVLTEYFSKNYLLWKQLGGCDRIREKWLLYSAHSGQYVKIVNDEKIIEGIFDGLDNDFNCVIKQKNGQQAVITAGDVHFGSSASVNAGCY

SEQ ID NO: 10596 - protein, 400 aa, Bordetella pertussis Tohama I
MSIVADKIKRIKLSPSVATRAIVAQLREEGRRVIDLTVGEPDFSTPAHICEAAIAAMQRGETKYPPAQGTMPLRKAVRARLREETGVDYPEGRIIVGTGAKQVLYNGLAATLNEGDEVIIPAPYWVSYPDMVLVNGGVPVAVTATPATQYKLTPQALEAAITPRTKWLMMNAPSNPTGAIYTADEWRGLAEVLRRHPHVWLMTDDIYARLNFTATPTVHPLQVAPELAERTLVVNGVSKAYAMTGWRIGYGAGPEALIKAIAILQSQSTSGACSISQAAAREALAGPQDCVAEFARTFKARRDAAVAALQGAPGLSVVMPEGAFYVFPDCAGVLGKTTPDGRVLETDTDFVHYLLREAGVAVIDGTPYGVPGTFRLSFAAALEDIQQGCAAIRAACERLA

SEQ ID NO: 10597 - protein, 314 aa, Helianthus annuus
MATTAVGVSATPMTEKLTAADDDQQQQKLKKGIAEFYDESSGMWENIWGEHMHHGYYNSDDVVELSDHRSAQIRMIEQALTFASVSDDPEKKPKTIVDVGCGIGGSSRYLARKYGAECHGITLSPVQAERANALAAAQGLADKVSFQVADALNQPFSDGKFDLVWSMESGEHMPDKLKFVSELTRVAAPGATIIIVTWCHRDLNPGEKSLRPEEEKILNKICSSFYLPAWCSTADYVKLLESLSLQDIKSADWSGNVAPFWPAVIKTALSWKGITSLLRSGWKSIRGAMVMPLMIEGFKKDVIKFSIITCKKPE

SEQ ID NO: 10598 - protein, 180 aa, Pyrus communis
FTQQYQPAACKFHHTPCKDPLDKLFTVHGLWPSNFNGPDPENCKVKPTASQTIDTSLKPQLEIIWPNVFNRADHESFWQKQWDKHGTCGSPTIIDKNHYFQTVIRMYITEKQNVSYILSKANINPDGKGRTRKDIQIAIRNSTNDKEPKLKCQTKNGITELVEVSLCSNYLGKNFINCPH

SEQ ID NO: 10599 - protein, 528 aa, Vibrio cholerae O1 biovar eltor str. N16961
MDLILLSAAFLAGFIALKCHLPPLVGFLIAGFALNAYGFTSNDTLSLLADLGVTLLLFTIGLKLEVKTLLAKEIWAGSTIHNLLSTALFTLLLLIFKQLGLDSLADLSFDKLILIGFALSFSSTVFAVKSLQEKGEMNATYGTLAIGILVMQDIFAVVFLTASTGKLPEWYAIGLFVLPLLRPLFYELLDWVGHGEMLVLFGIFFALVVGAGSFQLVGMKPDLGALILGMMLASHHKASELSKALFNLKELFLVCFFLNIGLSAHPTTTGIMLALLLLLLLPIKGVLYFWVIHQFHFRVRTSLLASLSLFNFSEFGLIVGGLAFKMGWINSDILVALAVSVPLSFILAAPIERKGHAIYQRSAKWLKEQAAESLHTRDRLIDPGEAQVLILGMGRIGRGAYEELTSRHGEICLGVEIREEAANSHREEGRNVISGDATDPDFWERIFDTGKVKLVLLAMPHHQANQIALEQLQKRHYQGQIAAIAEYPDQIESLLEHGAHAAFNIYSEAGTGFARHVCEQLKPNFTRR

SEQ ID NO: 10600 - protein, 314 aa, Helianthus annuus
MATTAVGVSATPMTEKLTAADDDQQQQKLKKGIAEFYDESSGMWENIWGEHMHHGYYNSDDVVELSDHRSAQIRMIEQALTFAYVSDDPEKKPKTIVDVGCGIGGSSRYLARKYGAECHGITLSPVQAERANALAAAQGLADKVSFQVADALNQPFPDGKFDLVWSMESGEHMPDKLKFVSELTRVAAPGATIIIVTWCHRDLNPGEKSLRPEEEKILNKICSSFYLPAWCSTADYVKLLESLSLQDIKSADWSGNVAPFWPAVIKTALSWKGITSLLRSGWKSIRGAMVMPLMIEGFKKDVIKFSIITCKKPE

SEQ ID NO: 10601 - protein, 179 aa, Pyrus communis
FTQQYQPAVCNSKPTPCKDPPDKLFTVHGLWPSNLNGPHPENCTNATVNSHRIKNIQAQLKIIWPNVLDRTNHVGFWNKQWIKHGSCGYPAIMNDTHYFQTVINMYITQKQNVSEILSKAKIEPLGIQRPLVHIENAIRNSTNNKKPKFKCQKNSGVTELVEVSLCSDGSLTQFINCPH

SEQ ID NO: 10602 - protein, 805 aa, Capsicum annuum
MTDQAESSDSKNAKKDFSTAILERKKAANRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLGIHTKNMKLAEEVDLERISKDTHGYVGADLAALCTEAALQCIREKMDVLDLEDDTIDAEVLNSMAVTNEHFQTALGTSNPSALRETVVEVPNVSWEDIGGLENVKRELQETVQYPVEPPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADVTEICQRACKYAIRENIEKDIEREKRRQENPDSMDEDVDEVPEIKPAHFEESMKYARRSVSDADIRKYQAFAQTLQQSRGFGTEFRFADTSGGATAAADPFATSNAAADDDDLYS

SEQ ID NO: 10603 - protein, 218 aa, Arabidopsis thaliana
MNRLFGKPKQEANALQTLDKLNETLEMLEKKEKVLLKKAGAEVEKAKEYSRAKNKRAAIQCLKRKRLYEGQVEQLGNFQLRIHDQMIMLEGAKATTETVDALRSGASAMKAMQKATNIDDVDKTMDEINEQTENMKQIQEALATPMGAAADFDEDELAAELDELESEELESQLLQPATTAPPLPSVPVPAGRQPARPVPQKRTAEEEELAALQAEMAL

SEQ ID NO: 10604 - protein, 463 aa, Arabidopsis thaliana
  misc_feature (409)..(409): Xaa can be any naturally occurring amino acid
  unsure (1)..(463): unsure at all Xaa locations
MGNCLVGRNNENIAEEEEEKFEEVMKKDYKRKDRKLKIVLRRDELEKIILFQLNADGANKGGDAKLASFGVFLRELEAERLAGEAAAAVAKEEKSSRRLCRRWKPSLESVIEWPEEIVVNEIDENEEDNGAYNNDELNLGLNSQASVSLHHTLCKKTKMSSQICRSASKAAKSLLSSAKNARFFSEGRAIGAAAAVSASGKIPLYASNFARSSGSGVASKSWITGLLALPAAAYMIQDQEVLAAEVTIVISILDFGLSALCSSSLNVSDSIRWNELLLLSSLMISEIISRFERKGFKLVGIKVIVPSKDFAQKHYHDLKERPFFNGLCDFLSSGPVIAMVWEGDGVIRYGRKLIGAPDPQKSEPGTIRGDLAVTVGRNIIHGSDGPETAKDEISLWFKPQELVSYTSNXSEKGLYGCNLNPSLLSFEIKSHWVSFFFFTHSIKTRTSCNGFKPIPGFGFSPGN

SEQ ID NO: 10605 - protein, 394 aa, Oceanobacillus iheyensis HTE831
MELAQRVQTLTPSSTLAITAKAKDLKKQGFDVIGLGAGEPDFNTPEYIMDGAKQAMNNGLTKYTPAGGIAELKLAIIDKFKQDNGLSYNEKQIIVTNGAKHALYTLFQVILNKEDEVIIPSPYWVSYPEQVKLAEGNPIILPAAETNDFKITPTQLEEAITPKTKAVIINSPSNPTGLMYSKEELAALGEVCLKHNIIIVSDEIYEKLIYTSKEHVSIASISDELYNQTIIINGVSKSHAMTGWRIGYAAGNETIIKAMTNLASHSTSNPTSIAQYGALAAYTKDPGDISLEYKKIFAERLDAFYKLIQDIPGMECIKPEGAFYLFPNAKKAAEMNGFATVDEWVAALLEEEKVALVPGSGFGSPDNVRLSYALSIEELTEAANRIHRFVLNHK

SEQ ID NO: 10606 - protein, 375 aa, Brucella melitensis 16M
MKFKAAVLDRHGVERPYNQTKPLVIREVELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 10607 - protein, 642 aa, Cryptococcus neoformans var. neoformans JEC21
MPRIRKKTSNRQNTRDRAKITKKAAEQKRKDRKASKKDQTWKSKKKADPGVPNSFPFKDQVLAEIAEEKRKSEEGKIARREAAKAQKSTGAEDEADTPGVSSLGRTVLNRVPLTATSAAVVTPTEDSDIPELIDTALPTLQEALDRADVICEVVDARDVLGGRSGYIERLVKEAEGRIILIINKIDLVPREVLQSWVSQLDIPTFLFKSALPVPPTPSSSRNPGPSFFLEPSVILGREQLIAAAKKWSAEKKKSRKSDEPLVLALMGLPSVGKTSILNSLLPSTANKSRHVVAPLIPSGQSAKSLQPTTKSPVEVEIDVDGLKIKVIDTPGWEPVEDEKDEDEDEEEDEQIPEKWDRLEAKLSGDLLRRNLGRVDRVKDVFPLVSYIVERSNHQDLMLAYNIPFFEKGDLEAFLTGLARAQQRIRKHGEPDLEGAARVLLRDWAHNNFPYYSLPSSTSASKMDVDASKAIDKYDMTAILEKCRGKKEMKKESSKGMIRFKGGEIDEREIILDDDYTAMMTVTSDDEEQEEIDDEEDIDDEDEDEDEDGIELASASDDEPVIIGSDEGEVLELSEGKEPSESESSPEPEPRLPSPSSSKPKKRRISEASVAPAKKAKRVSFARNVPDGEERNIRGGKKGKGRK

SEQ ID NO: 10608 - protein, 314 aa, Helianthus annuus
MATTAVGVSATPMTEKLTAADDDQQQQKLKKGIAEFYDESSGMWENIWGEHMHHGYYNSDDVVELSDHRSAQIRMIEQALTFASVSDDLEKKPKTIVDVGCGIGGSSRYLARKYGAECHGITLSPVQAERANALAAAQGLADKVSFQVADALNQPFPDGKFDLVWSMESGEHMPDKLKFVSELTRVAAPGATIIIVTWCHRDLNPGEKSLRPEEEKILNKICSSFYLPAWCSTADYVKLLESLSLQDIKSADWSGNVAPFWPAVIKTALSWKGITSLLRSGWKSIRGAMVMPLMIEGFKKDVIKFSIITCKKPE

SEQ ID NO: 10609 - protein, 328 aa, Oceanobacillus iheyensis HTE831
MQSTRSKLIEILSSNHEDYASGQRLSELLSISRNAVWKHMKELEKDGYVIEAKPRKGYRIIKSPNKISTNTIRWGLETEWLGNEIIHKTSVGSTQLVGHEAAQNGAAHGTIIIADEQTAGRGRVQKNWDSNGDGIWMTIILRPNIPPNRASELTLLTAVAITKAIKKITNIDPLIKWPNDILIKEKKLCGILTEMQAEQDQVQYILIGTGLNVNQSNQLWDKQLQNIATSLYQETGHTFEKHTLLQQILLQFERTYNNYMEHGFQPIKQQWEANAFKIGSEIEITTFHEQWVGKFLGISDEGALLAESSDGSPVKIYSADIKWFSRPK

SEQ ID NO: 10610 - protein, 243 aa, Synechococcus sp. WH 7805
MRKPVIAGNWKMHMTCAQTRDWMGTFLPLIAETPDDRHLVVAPPFTAISTLATVGAGSRVEISSQNVHWEGHGAYTGEISPAMLQEHGVSYAIVGHSEPRKYFSESDEQINHRARSAQAHDLIPIVCVGESDEQRSRGEAERVIRRQVEQGLEGLDPARLVVAYEPIWAIGTGKTCESAEANRICGLIRSWVGSPDLIIQYGGSVKPANIDELMGMSDIDGVLVGGASLDPEGFARIANYQKA

SEQ ID NO: 10611 - protein, 277 aa, Burkholderia xenovorans LB400
MSTSRQQQGRHQGHIARKRFGQNFLVDMGVIDSIVDVIRPQRGERMVEIGPGLGALTEPLIERLATPEAPLHAVELDRDLIGRLKTKFGDLLELHAGDALAFDFGSLAAPGDKASLRIVGNLPYNISSPLLFHLTAFAHCVIDQHFMLQNEVVERMVAEPGTKAFSRLSVMLQYRYVIDKQLDVPPEAFNPPPKVDSAIVRMIPYELHELPPVDERVLGELVTAAFSQRRKMLRNTLAAYRDSVDFEGLGFDLQRRAEDVPVAEYVRVAQIVAASKA

SEQ ID NO: 10612 - protein, 308 aa, Aspergillus oryzae
MTTFKLNTGAEIPAIGFGTWQDAEAQEGAVVEAIKAGYRHIDTARVYGTEKAVGKAIKKSGVPREQLFITTKLWNNKHHPDDVAQALQDSLNDLDLEYVDLFLMHWPVAWKRGDELFPKENGKPAVIDVDFVDTYKAMEKLLSTGKVKAIGVSNFSKADMEHLLKNTSVVPAAHQLEGHPWLQQRSFVDWHKEKGIHVTHYSPFGNQNELYSREGTIGKLIDDPVLVEIGKKYNKSSAQVALAWGVTQGHSVLPKSKTPSRIRDNLAGDFKLSEEDMQKIHGIDRKLRFNDSSSDFGRDFFSDLDGKK

SEQ ID NO: 10613 - protein, 526 aa, Nostoc punctiforme PCC 73102
MSKVLVSDSIDQAGIDILSQVATVDVKIGLKPAQLLEIIGEYDALMIRSSTRVTQEIIEAGTQLKIIGRAGVGVDNVDVPAATRRGIVVVNSPEGNTIAAAEHALAMILALSRHIPDANASVKRGAWDRNSFVGAEVYKKTLGVVGLGKIGSHVAAVAKTMGMKLLAYDPFISTERAEQIGCQLVELDLLFQQADYITLHIPKTPETTHLINATTLAKMKPTARIINCARGGIIDEVALAAALKAGKIGGAALDVFESEPLGESELRSLGKEVILTPHLGASTAEAQVNVAIDVAEQIRDVLLGLPARSAVNIPGLGPDVLEELKPYMQLAETLGNLVGQLAGGRVEVLNIRLQGELATNKSQPLVVAALKGLLYQALRERVNYVNASIEAKERGIRVIETRDASIRDYAGTLHLEATGTLGTHSVTGALLGEREIHLTDVDGFPINVPPSKYMLFTLHRDMPGIIGKLGSLLGSFNVNIASMQVGRKIVRGDAVMALSIDDPLPEGILDEIIKVPGIRDAYTVTL

SEQ ID NO: 10614 - protein, 108 aa, Arabidopsis thaliana
MASGSLKSLISSAVGRGVTEARARIFGHMLNPTGQRSPHKILRKKLIGDKVAEWYPYDIKNEDPNVLAREEKDSIAIWGRISKLEMLKRRDKGPPKKGHGKRAAKRNK

SEQ ID NO: 10615 - protein, 389 aa, Bacillus licheniformis ATCC 14580
MEHLLNPNVKEIEISGIRKFSNLVSQYENVISLTIGQPDFFTPHHVKQAAKKAIDENQTSYTHNAGYPELRQAVQLYMKKKADLNYEAESEIIVTTGASQAIDSAFRTILSPGDEVILPGPVYPGYEPIIKMCGASPLIIDTTSHGFKLTAKLIEEALTPKTKCVVLPYPSNPTGMTLSEEELKDIASLLKGRNVFVLSDEIYSELTFDRPHHSIATVLRDQTIVIGGLSKSHSMTGWRIGFLFAPKEIAKHILKVHQYNVSCASSISQKAALEAVTNGFDDALIMREQYKKRLDYVYDRLVTMGLDVIKPSGAFYIFPSIKSFGMSSFDFCMSLLEEEGLAIVPGSSFSEYGEGYVRISYAYSPDTLREGLDRLESFVFNKRQSIQTT

SEQ ID NO: 10616 - protein, 495 aa, Candida albicans SC5314
MKHCKVFVCMSGESRVMMDNFCMVKFFFFSFLFQHQQLNGKSPSFLPSFLSIHHLQPLQNMSGQQLLEEARKAVTNKQYDEAEIKYKQIINPSESSTSTTTTTTTTTTTAKQLQQQESAILELGKIYETLNEPTKLSDLIADSRSILGNFAKSKTAKIVKTLIEDFDKLSAKDEKSLDIQIDVTKSSMQWAIESKLSFLRQSLQLKLSDLLYQKKHHHEAIKIINELLREYKKLDDKSSLVEVQLLESKIYHALRNIPKAKAALTSARTSANSIYCPTILQAELDCQSGILNSEDKDYKTAFSYFYESFEGFNSQDDPRSIIVLKYMLLTKIMLNLIDDVNNILNNKNVIKYKSKDIDAMKSIAMAYSNRSLKEFENSLLTYANELKSDAIIKNHFNALYDNLLEQNLLKIIESYSCVELSHISKVIGLNLQQVEGKLSQMILDKVFYGVLDQGNGWLIIYDEPRKDAAYEASLELVKNLSNVVDLLYEKASSLN

SEQ ID NO: 10617 - protein, 396 aa, Bartonella henselae str. Houston-1
MAEVNVRNFNINFGPQHPAAHGVLRMVLELDGEVVERVDPHIGLLHRGTEKLMETKTYLQAGPYLDRLDYVAPMNQEHAFVLAIEKLLGVEVPKRGQLIRVLFSEIGRILNHLLNVTTQAMDVGALTPPLWGFEQRERLMIFYERACGARLHANYFRPGGVHQDLPESLVEDIGNFIDPFLIALGKLDALITPNRIFKQRNVDIGVVSIDEAWARGFSGVMIRGAGVPWDLRKSQPYECYDEMEFDIPVGKNSDCYDRYLIRMEEMRQSAKIMRQCVDRLLSTEKNEPVSSLDRKIVPPKRCEMKSSMEALIHHFKLYTEGFRTPPGEVYVAVEAPKGEFGVYLVSDGTNKPYRVKLRAPGFAHLQAMDFLTRGHMLADATAILGSIDIVFGEVDR

SEQ ID NO: 10618 - protein, 100 aa, Triticum aestivum
MASGGGKVTALSWAAAMSVGAGAGTVEALKGRHAGLCRWNYHALPCVQQHTGTAVAGNGKTMAAPAAGGAAARRRKARKEEEEEEELRTVMYLSNWGPNN

SEQ ID NO: 10619 - protein, 346 aa, Crocosphaera watsonii WH 8501
MSRYAEELRTTAKAMVARGKGILAMDESNGTCNKRFDKLGIPTTEEYRQIYRSLILQTPELSNYISGPILYDETIRQTTPDGVPLLKIITDAGMIPGIKVDTGAKDLAGCPNEKVTEGLDGLRDRIAEYYSMGARFAKWRAVITIGNGIPSRGCIKANAHGLARYAALCQEGGLVPIVEPEVLIDGDHTLERCWNVTDETLHEVFNQLYTQNVAFDQMVLKPSMVISGKDCPQQASVEEVAKATISCLLKNVPATVAGIAFLSGGQSKEQSSAHLNAMNQMFGDQCPWPVTFSYARAIQQPALDYWAGDSSRISGAQTRLLKRAQCNGAASLGEYSSEMEKTLATV

SEQ ID NO: 10620 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 10621 - protein, 204 aa, Kluyveromyces lactis NRRL Y-1140
MSQLKPFPSYGQDNSNGGASGIEPVKDHRRRRSSSIISHVEPESFEDENDQQMMNNMNANWVNQRGAWIIHLVVIALLRLFFNLLPGMSNEWSWTLTNIAYVVGSYIMFHLIKGTPFDFNGGVYDNLTMWEQIDDGVLYTPTRKFLITVPIGLFLLSTHYCRYDLQLFLLNFVLTTFVAVVPKLPVTHRLRISIPGITGPAQIS

SEQ ID NO: 10622 - protein, 314 aa, Helianthus annuus
MATTAVGVSATPMTEKLTAADDDQQQQKLKKGIAEFYDESSGMWENIWGEHMHHGYYNSDDVVELSDHRSAQIRMIEQALTFASVSDDPEKKPKTIVDVGCGIGGSSRYLARKYGAECHGITLSPVQAERANALAAAQGLADKVSFQVADALNQPFPDGKFDLVWSMESGEHMPDKLKFVSELTRVAAPGATIIIVTWCHRDLNPGEKSLRPEEEKILNKICSSFYLPAWCSTADYVKLLESLSLQDIKSADWSGNVAPFWPAVIKTALSWKGITSLLRSGWKSIRGAMVMPLMIEGFKKDVIKFSIITCKKPE

SEQ ID NO: 10623 - protein, 402 aa, Bordetella pertussis Tohama I
MQEIEQRIYLAATYDTKGEEAEYLRQLLRRDGVMVVTVDVATSGQGSPAMVSAQEVAACHPQGAQAVFTGERGSAIVAMALAFERYLAGQRDVGAVLGIGGSGGTALVTPAMRALPVGVPKLMVSTMASGNVAPYVGPSDIAMMYSVTDVAGLNRISRRVLANAAGAIAGAFRQARQPIADDGRPAVGITMFGVTTPCVQHVTAALHDRYDCLVFHATGTGGQSMEKLADSRLLAGVLDLTTTEVCDFLFGGVLACTDDRFGAIARSGVPYVGSCGALDMVNFGALDTVPAACRERLLYPHNPQVTLMRTTAQENARQGAWIAERLNRCEGQVRFLIPEGGVSALDAPGQAFHDEAADAALFQALYDHVRQTDKRRLVRVPCHINDPLFARAAVEQFHEISQ

SEQ ID NO: 10624 - protein, 276 aa, Bordetella pertussis Tohama I
MPRFERSALLDKFQDMVRRRQPIVGGGAGTGLSAKCEEAGGIDLIVIYNSGRYRMAGRGSLAGLLAYGNANDIVLDMAREVLPVVRHTPVLAGVNGTDPFCNFDAFLDELARVGFSGVQNFPTVGLIDGTFRANLEETGMGYGLEVEMIRLAHAKGLLTTPYVFDPDQARAMTAAGADIVVAHMGLTTGGNIGAETALSLDDCVARIDAIAAAALAERGDVIVLCHGGPIATPQDAAHVLQRCRHCHGFYGASSMERLPVEQALTATTRAFKQLSF

SEQ ID NO: 10625 - protein, 306 aa, Synechococcus sp. WH 7805
MGWTIEDMPDQQGRVALVTGANSGLGLETTRALIGRGCTVLMGCRSARKGEAARALLLEAGGSGLDLFELDLSDLTSVARCARDVADRYGRLDLLINNAGLMAPPRMLSQQGHEMQFAVNHLGHFALTQALLPLMNNRPQARVVTVTSGAQYFGAMAWDDLQGEQRYDRWKAYSQSKLANVMFALELNQRLQASGSAVRSLAAHPGLARTNLQPVSVAATGAWQEALAYRLMDPLFQSAAQGALPQLYAATASAAGGGEHYGPGQLGGMRGAPKQQPVARAAKDQHQRQRLWTVSESLTEHHSAAV

SEQ ID NO: 10626 - protein, 225 aa, Streptococcus mutans UA159
MEELKKIAGVRAAQYVEDGMIVGLGTGSTAYYFVEEVGRRVQEEGLQVIGVTTSSRTTAQAQALGIPLKSIDEVDSVDVTVDGADEVDPNFNGIKGGGGALLMEKIVGTLTKDYIWVVDESKMVDTLGAFRLPVEVVQYGAERLFREFEKKGYKPSFREYDGVRFVTDMKNFIIDLDLGSIPDPIAFGNMLDHQVGVVEHGLFNGMVNRVIVAGKDGVRILEANK

SEQ ID NO: 10627 - protein, 510 aa, Vibrio sp. Ex25
MSAKKPLALVILDGYGYREDTASNAIANAKTPVMDALIANNPHTLISASGMDVGLPDGQMGNSEVGHTNIGAGRVVYQDLTRITKSIADGEFAETPALVEAVDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWDRVQVAYDLLTQAKAEFTAETAVAGLEAAYAREENDEFVKATAIKAEGEEDAIMQDGDAVIFMNYRADRARQITRAFVPDFDGFERAVFPAVNFVMLTQYAADIPLAIAFPPASLENTYGEWLSKQGQTQLRISETEKYAHVTFFFNGGVENEFEGEERQLVASPKVATYDLQPEMSSPELTEKLVAAIKSGKFDTIICNYPNADMVGHTGVYEAAEKAIEALDESVGKVVEAIKEVGGQLLITADHGNAEMMVDPETGGTHTAHTNLPVPLIYVGDKAVEFKEGGKLSDLAPTMLSLAGLEIPAEMTGEVLVK

SEQ ID NO: 10628 - protein, 454 aa, Klebsiella pneumoniae
MSRELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 10629 - protein, 265 aa, Oceanicola granulosus HTCC2516
MARLTVRILGCGSSGGVPRLGGHWGACDPANPKNRRTRCSLLVSREDAGGVTRTLIDTSPDMRAQLLAADVGRLDAVLYTHAHADHVHGLDDLRQVVFNTRTRLPVHADGETSEALLNRFAYAFAAPAGSQYPPILDLFDLSGPVTVDGAGGTITFTPFPVRHGAIHALGFRFDDIVYLPDVATIPDDSWPMLAGLRCWIVDALRREPHPTHSHLANTLAWIERAAPARAVLTNMHIDLDYETVAAETPAHIEPAYDGLTLAFDV

SEQ ID NO: 10630 - protein, 287 aa, Magnetospirillum magnetotacticum MS-1
  misc_feature (32)..(32): Xaa can be any naturally occurring amino acid
  misc_feature (34)..(34): Xaa can be any naturally occurring amino acid
  unsure (1)..(287): unsure at all Xaa locations
MVASNDAPLGTAFTVTVDVRHGLTTGISAEQXAXNTVRALANGNMGAGDFVRPGHVFPLIARDGGVLMRSGHTEAAVDLCRLANLPPVGVICELANDDGTVMKGPQIDAFSEQHGLKRVSVADLIAYRQARDRLVERVGSFPVKTEFGAMTGYAYVTPFEPIQQFAFVHGAIGDGRNMPVRLHRSNVVADVIEGGGQIEAVMRRFAKEGRGILVYLRDGTAGVPLNRYADEGAEAQRVRQWREVGLGAQILRDLGVVSIRNLSSSSRSYVGLSGFGIELVGEEPLEG

SEQ ID NO: 10631 - protein, 541 aa, Triticum aestivum
MEVGTWAVVVSAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHGVFRDLLGDGIFNSDGDTWLAQRKTAALEFTTRTLRTAMSRWVSRSIHGRLLPILADAAKGKAQVDLQDLLLRLTFDNICGLAFGKDPETLAQGLPENEFASAFDRATEATLNRFIFPEFLWRCKKWLGLGMETTLTSSMAHVDQYLAAVIKKRKLELAAGNGKCDTAATHDDLLSRFMRKGSYSDESLQHVALNFILAGRDTSSVALSWFFWLVSTHPAVERKIVRELCSVLAASRGAHDPALWLAEPFTFEELDRLVYLKAALSETLRLYPSVPEDSKHVVADDYLPDGTFVPAGSSVTYSIYSAGRMKGVWGEDCLEFRPERWLSADGTKFEQHDSYKFVAFNAGPRVCLGKDLAYLQMKNIAGSVLLRHRLTVAPGHRVEQKMSLTLFMKGGLRMEVRPRDLAPVLDEPCGLDAGAATAAAASATAPCA

SEQ ID NO: 10632 - protein, 321 aa, Bifidobacterium longum DJO10A
MVLIGYEAHKEHTLMNDTIPATGHLLGAADIRRIAADAGISPTKKFGQNFVIDPGTVRRIVREAGVTAANHVMEVGPGLGSLTLAILETGATMTAVEIDPPLAERLPGTVAEFMPEATSRLTVVNRDALTVTPENVPDFSDDASFTLVANLPYNVATPILLTLLERFDNLGSFLVMVQKEVADRLAAKPGSKIYGTPSVKLAWYGTAERVGTIGRNVFWPAPNVDSALVKFTRYQADDPAAPGTANSTDDGTQRELVFRLIDAAFGQRRKTLHAALKTIAPSEAFSIAGIDPTRRGETLTIAEFTALAKAIESCGDGDEAQ

SEQ ID NO: 10633 - protein, 919 aa, Zea mays
  misc_feature (436)..(436): Xaa can be any naturally occurring amino acid
  misc_feature (466)..(466): Xaa can be any naturally occurring amino acid
  misc_feature (666)..(666): Xaa can be any naturally occurring amino acid
  misc_feature (675)..(675): Xaa can be any naturally occurring amino acid
  unsure (1)..(919): unsure at all Xaa locations
MQEASRIMSQGTDGEVAGVVNSHDDKDHVHGTIRRVAEADSEKDEVHGGGQEPIFFQCLDQEQPPDPVHLEDARVEFPSDEDGDGDDVRVSFATADGDRLLEEQAELDLDVEEEQEDTSRYDYVTWMAPEPVSIHERRRRLLQGMGLTSSKDLLRSRNARARLPPDIPRYVPRRQQQLPAAEAPSTTRAAPAVAAALPEFAEHHPNDAVLTRSCSDSRLVVRGGGVRKMQPFRRVCSLPHSLQGSPAHKALSAAARCPLSSAPSKDGGTSKTTAGDTGGGGFRNPNNDREFQANSQLNSAQRSAPLNKDELEQFISHAPLVTQPVRRSQSQPVPGAGTAKGDEKPAEKRRTRWLRNIKLVASAAGLRNDKDGGGGSRSARTPSVTMSKSASTTAAMSSAATGPERLKVHHYGKSSRELTGLYMRQEVRAHEGSIWXIKFSPDGRFLASGGEDSVVRVWEVLDVDAXSSAVAHEMEMSTSLPPQPPPASTDGGRSVAAPWLAAQLSRKVRRGRSSKDALPEHVIVPESVFALAEQPSCALEGHQDDVLDLSWSKSQVRRPFQSLLLAIVDATAAAQRTEGLTCRGRHCWLQQLLSSSMDHTVRLWNVDTKTCLRVFPHSDYVTCVQFNPADDGYFISGSLDCKVRIWSVPDRQVVDWSDLNDMVTAXACYTPDGQXCKLNQEAQIDMSITKKRRSQAKKITGFHFAPGNPSEILVTSADSQIRVFNGISVLQKFKGFKNTSSQISASYTADGRYVVCASEDSNVYVWRRVPGSVGGTGGASISVRAKTWLTSRSYEYFFCRDVSVAVPWPGSPCIPCDASRRVNGNGNSDTPRRQTSSRRDDDVVGAGCVPRGTMSGTMAYHGGQLLQPELSRRESQSSARWHGGAEGGNAWGMVLVTASRGGEIRVYQNFGLPLTNLFH

SEQ ID NO: 10634 - protein, 107 aa, Triticum aestivum
  misc_feature (33)..(33): Xaa can be any naturally occurring amino acid
  misc_feature (53)..(53): Xaa can be any naturally occurring amino acid
  misc_feature (72)..(72): Xaa can be any naturally occurring amino acid
  misc_feature (74)..(74): Xaa can be any naturally occurring amino acid
  misc_feature (86)..(87): Xaa can be any naturally occurring amino acid
  misc_feature (91)..(91): Xaa can be any naturally occurring amino acid
  misc_feature (99)..(99): Xaa can be any naturally occurring amino acid
  unsure (1)..(107): unsure at all Xaa locations
THRRRGGEEAMGVTKEDVEAAITSALSPSNLVXVTDTSGGCWRRATRFEVVSXENFEGKRLLERHRMVNTAXAXHAEIHAFSIKKXXPGQXHPKPNPSXPPIPQVNS

SEQ ID NO: 10635 - protein, 297 aa, Rhodopseudomonas palustris CGA009
MSTSPEHKRTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGLTQSQTVGDQAAT

SEQ ID NO: 10636 - protein, 344 aa, Zea mays
MSKSGALDLASGLGGKINKVEVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGISGTCDFVKADFMKMPFDDNTFDAVYAIEATCHAPDPVGCYKEIYRVLKPGQCFAVYEWCITDHYDPNNATHKRIKDEIELGNGLPDIRSTRQCLQAVKDAGFEVVWDKDLAEDSPLPWYLPLDPSRFSLSGFRLTSVGRMITRTMVKALEYVGLAPQGSERVSNFLEKAAEGLVEGGKKEIFTPMYFFLVRKPLLE

SEQ ID NO: 10637 - protein, 103 aa, Oryza sativa
MSSSSLSKKASSFVVTASMSAVEALKDQAGLCRWDYALRSLYQRAAAAKQVTGRAVPVSLSSQTGGAAASSSPAAACGRAARSKRSEEEKMQKAYHLVCWGPN

SEQ ID NO: 10638 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 10639 - protein, 348 aa, Listeria monocytogenes str. 1/2a F6854
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 10640 - protein, 439 aa, Pyrococcus woesei
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLSKDGENVFMGEEGLSEIALHFIGGILKHAKALIAVTNPTVNSYKRLVPGYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 10641 - protein, 250 aa, Erwinia carotovora subsp. atroseptica SCRI1043
MAVTKLVLVRHGESQWNNENRFTGWYDVDLSEKGRSEAKAAGQLLKDEGFAFDFAYTSVLKRAIHTLWSVLDELDQAWLPVEKSWKLNERHYGALQGLNKAETAEKYGDEQVKQWRRGFAITPPELTRDDERFPGHDPRYASLSDKELPQTESLALTIERVVPYWTETILPRIKSGERVIVAAHGNSLRALVKYLDNMGEDEILELNIPTGVPLVYEFDENFKPIKRYYLGNADEIAAKAAAVANQGKAK

SEQ ID NO: 10642 - protein, 300 aa, Ashbya gossypii ATCC 10895
MTENRKTVKLFLLRHGESELNHAKIFCGWIDAHLTDKGKDQARSSASLIASFCREHGIEPPLVGYTSRLLRTIETMQVIMKELRRAAVFQTVVDTADALAVVDKVTAAGQTPVLQVWTLNERHYGSWQGQRKSSVLEQFGKSDYMLIRRDYNGRPPAVDLGREMIQEDNEQGPLTGYDFKEPNRRLKYGPELEKAIELPRNESLADVIKRLAPFLNEVVLKLLHELGESAIIVAHGSTVRSVLKILANISEEDIKDIDIPTGNPLVIELNASDMSFVRHFYLDPESARKEAENVRNEGCN

SEQ ID NO: 10643 - protein, 491 aa, Bifidobacterium longum DJO10A
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 10644 - protein, 313 aa, Triticum aestivum
  misc_feature (193)..(193): Xaa can be any naturally occurring amino acid
  misc_feature (214)..(214): Xaa can be any naturally occurring amino acid
  unsure (1)..(313): unsure at all Xaa locations
MEGATPTSAPSSTRIAVVTGGSKGIGLEACKQLAGGGAITVVLTARNETRGTAAVEQIKRLGHADVIFHQLDITDASSIARLADFLKTRFGKLDILVNNAATDGIEHVIDPVYGLTPGDETFNGMDAGQRINWMWTSCRQTYETAKQGLQTNYYGTKRVTEALLPLLRSSSDGRIVNVSSNFGLLSFFRNEEXLKQELNDVDSLTEERLDELLXMSLKDFEAGGAEARGWPAEFSAYKVAKAAMNAYSRILAKRHPELRVNCAHPGYVKTDITRNSGILTPEEGARNITSVALLPEGGPTGKYFSEGEEASFV

SEQ ID NO: 10645 - protein, 322 aa, Arabidopsis thaliana; identical to SEQ ID NO: 260

SEQ ID NO: 10646 - protein, 420 aa, Bifidobacterium longum DJO10A
MPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 10647 - protein, 341 aa, Xanthobacter autotrophicus Py2
MTAELDAIAQKMVADGKGILAADESSGTIKKRFDAIGVESTEENRRDYRELMFRSEAMTKYISGVILYEETIRQKAKDGTPLVSLIEQAGSIPGIKVDAGAKPQPAFPGETITEGLDGLAGRLKEFYDLGARFAKWRAVIDIDTAKGIPSYGSIRANAHALARYAALCQEAKIVPIVEPEVLMDGSHDIDTCYQVTEWVLKTTFEELYYQRVRLEGMVLKPNMIVPGKKAAKQASVAEVAEKTVRVLKSCVPSVVPGIAFLSGGQSDEDATAHLDAMVKLGGLPWKLTYSYGRALQAAPQKAWAGKAENVAKAQAAFTHRAHMNSLAALGQWSSEEERKAA

SEQ ID NO: 10648 - protein, 273 aa, Flavobacteria bacterium BBFL7
MQKSILITGSTDGIGKLTALKLAKEGHNIYIHGRSEDKVNLVVSDIKQASNNENIKGYVADFSNLKAVKQLADLINKEIPSLDILINNAGIFKTPVSKTDTGLDIRMSVNYLAPYLLTENILPVLEKGTHTRIVNLSSAAQSTVKKGILTGDVSINASDSYAQSKLALTMWSFHFAQQHSNITTIAVNPGSLLNTKMAKEAYGQHWSPAEKGVNILFDLATSDAYQDATGKYFDNDKGETIGHFATAHPDAYDRDKILMLEAMTNEVLSDLGE

SEQ ID NO: 10649 - protein, 148 aa, Oceanobacillus iheyensis HTE831
MEKTFLMVKPDGVQRELIGEIVKRFETKGYKLAGAKLMQVSNQLAETHYSEHKERPFFGELVDFITSGPVFAMVWEGENVIATARKMMGKTNPLEADPSTIRGDFGISVGKNIIHGSDSAESAEREITLFFTENEIVSYEKQANNWIY

SEQ ID NO: 10650 - protein, 334 aa, Anabaena variabilis
MLAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLS

SEQ ID NO: 10651 - protein, 575 aa, Cryptococcus neoformans var. neoformans JEC21
MKGGRFLLPALFKTLLLPPLIAALFIHHFPSLFLPFSALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKAFDMQARIGQLALELAIMWLCGEDMSGDASNVARTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDFAARLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 10652 - protein, 289 aa, Oryza sativa
MSGADVDKVQNLIHCCLQLYMDKKEVVDALSREAKIEPSVTQHVWQKLEENNREFFKAYYLRLMLKNQITAFNKLLEDQLRIINKEYHPGPSSMPLPNGSNSNLLKQNPCFLSESTPMPAMPDDVMCNGNSSGIVDRTQSSDQLIYAGKDIQGLHSSMDASNLLPVQNANSVLFGVENGTTIKTESGYSSNGNFGFCGNAFLESCQSIGDASGGSFSSSELNGQPLDDSILDIESSSFGFLSQLPRNFFSDLPEDFSQSTEILDNYGKSPFLPSEQNNFSDSTGGEHTG

SEQ ID NO: 10653 - protein, 274 aa, Glycine max
MEIFPIPAESYTLGFIGAGKMAESIARGAVRSGVLPPSRIRTAVHFNLARRGAFESFGVTVLPSNDDVVRESDVVVLSVKPQLVKDVVSKLTPLLTKHKLLVSVAAGTKLKDLQEWAGNDRFIRVMPNTPAAVGQAASVMSLGGSATEEDGNIIAQLFGSIGKIWKAEEKYFDAITGLSGSGPAYVYLAIEALADGGVAAGLPRDLSLSLASQTVLGAASMVSQTGKHPGQLKDDVTSPGGTTITGIHELENGGFRGTLMNAVVAAAKRSRELS

SEQ ID NO: 10654 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRSSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDAPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 10655 - protein, 106 aa, Oryza sativa
  misc_feature (28)..(28): Xaa can be any naturally occurring amino acid
  misc_feature (49)..(49): Xaa can be any naturally occurring amino acid
  misc_feature (57)..(57): Xaa can be any naturally occurring amino acid
  misc_feature (71)..(71): Xaa can be any naturally occurring amino acid
  unsure (1)..(106): unsure at all Xaa locations
QTFMMMQPDDVRRGLVGEVVGRCEKKGXYLRAVKLIHVRKSLPESRYDXLSCKPFLXAFVEYIVSGPVVAXMVWEGKQVRSSGRELDGGTNPLCAEPGTSRGDFAG

SEQ ID NO: 10656 - protein, 510 aa, Ustilago maydis 521
MPATIERQTVAPPSDEATASELSKAFLMPLGSRSYSKQYAQLYDYRLAYLKKRVLARAKSRWIDNFDSFFQSQSQPLSQLDSSDAGPSSNTVRMDEPPKFVDRILDVRQGDICYVVGNLYCAMPLKPDVLEDLTREQWLAPQPVRSKYVDYAKDELFIEDQSGRVKLVGEAIRGGTALRSMLITGVVAAVLGTETRAGDFDVVDAVFASLPNQPSTKKSLQDPSRTKHADASQDQWVVLMSGLAIGGEAALESQLSMQLLVEYLTGELGVDADRSNASKIVAAVIAGNSLAPPTRIEEEEKPKRYGQDQPNYSSAPTLALDQLLTDLCSVMPVHLLPGERDPASVAVPQQPIHFALLPRSGRFDSLHRHTNPAWISLGDRNLLGTSGQNIDDIFKYVDESDDARIEMALRTLEWGHLAPTAPDTLWCYPFKSTDPFVLKNRPDVLIVGNQPAYASAVYRFDSDDDEQSQAPELQNGCRVVLVPEFAKTGQVVWLNLGSLETKLVCIETPF

SEQ ID NO: 10657 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 10658 - protein, 75 aa, Oryza sativa
MRQQRGRGVGRGDPGLLTRAVEKVFRLVRLAEFEILFVLFFLIAFVLFKDLMSRPEYNSIFVKKPDLDGRWPGLM

SEQ ID NO: 10659 - protein, 290 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPAEDHVVVINVGKADKSSCAEVRPVTEMAAAVDVPRRCAAEAAATPGVDFARSVDVV

SEQ ID NO: 10660 - protein, 338 aa, Glycine max
MAAGVYNQPIVAFQSHSHINNFNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRRKVPIIMHNESEQARGWSQVFSEDTEKQSIPVIAAWQLNERMYGELQGLNKQETADRYGKEQVHEWRRSYDIPPPNGESLEMCAERAVSYFRDQIEPQLLSGKNVMISAHGNSLRSIIMYLDKLTSQEVISLELSTGIPMLYIFKEGRFVRRGSPIGPTEAGVYAYTRRLALYRQRLDDMFQ

SEQ ID NO: 10661 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRSARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 10662 - protein, 285 aa, Acidobacteria bacterium Ellin345
MPKMAAEKNSKPAKKAKLGQNFLSDASGALKIVEALGDISDATVVEIGPGRGAITDHLAKRAKRLIAVEIDRVLAAQLRLRYSRLENVEILEADILAVELSTVLAQRIGPLRDLRPTKPEKVRIIGNLPYYITSDILLRLFEAHALIDFAVIMVQKEVADRIAAKPGTRDYGLLSATSQLYTHVEKLFTLPPGSFNPAPQVHSTVLKLQMEPKLEALGVDEEGFDSFLKLIFGQKRKTLFNNLRVAYDMAKAREAMKAVGLKSDVRAEAVALEKTAQLYNELRKG

SEQ ID NO: 10663 - protein, 485 aa, Acidobacteria bacterium Ellin345
MEAIISPTPKSAPSNTPQLARDLRVSHATAVVVGTIIGSGIFLVPAEMMRAVGTAKLVYLAWIVGGILSFLGALTYAELGAMKPQSGGEYVYVRDAYGPLMSFLYAWSWFVIAKPGSMATIATGMMQILGGYPALSFLPKNVVSGVPFTYAQLAAVALIIFISAVNYIGVKKAGQFQVVFTVLKLAIIFGVIVVGFFAGHGSWSNFTTSFTGATGGIAGFMIALVAALWAYDGWNDINMVAEEIDHPERNVPIALIVGVGIVAALYMLLNAAVQYALPAQAIAMSKRAASDAVLVSIGAGAASIFAALMAIQMLATINGTTLSGARIPYALARDGYFFEAIGKVHPRYLTPANAIVFQGALAVILVSLVGKFQQLFSLTIFAEWLFYMIATSTVFVFRRREPNANRPYKTWGYPVVPAVFIAAAAMLLCYTFVDNLKYAMIPTTLIGPPLNSISTGGALVILLGVPVFWWFARQKSLTTKGTKEL

SEQ ID NO: 10664 - protein, 327 aa, Psychrobacter arcticus 273-4
MTTLAQYLNTNAASPALNDVITTVTDVGKTISQLLRKGALADILGEAGNQNVQGEDQKKLDVLANDLLLDALAKNTHCAGVASEELDDAIPANAEGSLLVLFDPLDGSSNIDINMAVGTIFSILPYQHQGKVSENSDFLQAGNQQLAAGYLLYGTSTVLALTITDNVVMFSLDPDTNDYVLIEENVTVDADTSEYAINASNYRYWRAPMQQYIDELIAGEIGVRGRDFNTRWVAAMVGDVHRILCRGGLFTYPFDTKYANKAGKLRLMYEANPMSLLIERAGGGATDAVNRILDIEPTDIHQRVPVVLGSKNEVDYVKNLHLNYAEK

SEQ ID NO: 10665 - protein, 950 aa, Chromobacterium violaceum ATCC 12472
MSLTELFNRHEFLARHIGPSDAERAEMLAAVGAPSIDALVDQTLPADIRLNRRLDLPSPQPEAEALAALKAVASKNVVNKSFIGLGYYPVLTPTVILRNVLENPGWYTAYTPYQAEIAQGRLEALLNFQQMVIDLTGLEMANASLLDEATAAAEAMAMAGRVSKSKSTRFFVDSRVLPQTLDVMKTRAKYFGFELVQGHPEEAGNGDYFGALFQYPGEAGDLLDLTPHIAAVKAKGGVVAVAADVMALVALKSPAEMGADIALGNTQRFGVPMGFGGPHAAYFAFKDEMKRSAPGRIIGVSIDAKGKTALRMALQTREQHIRREKANSNICTSQVLLANIAGLYAVYHGAEGVRRIAARIHRLAAIFAHAVKEAGGKLVFDRFFDTVQVDAPKADAIYAAALAAGYNLRRVGKTVLGVAFHEAATESDLAKLIELFTGKPADIAALDAAALDAIPAALKRESAILTHPVFNTHHSEHEMLRYMKKLENRDLAMNHSMISLGSCTMKLNATSEMIPITWPEFANMHPFAPREQTVGYLELIEGLQKQLKAITGFDAISMQPNSGAQGEYAGLLAISRYHESRGEAHRNICLIPQSAHGTNPATAQMMNMQVVVVKCDEAGNVDVADLKAKAEQHAANLAALMITYPSTHGVFEQGIKEICEIVHAHGGQVYMDGANLNAQVGLTRPADIGADVSHMNLHKTFCIPHGGGGPGMGPIGLKAHLAPFIANHVVAPVPGAVEGQTAVSAAPFGSASILPISYMYIAMMGAEGMKQATENALLSANYLATRLSEHFPVLYTGANGRVAHECIIDLRPLKAASGVTEVDVAKRLMDYGFHAPTMSFPVPGTLMIEPTESEPKAELDRFIAAMAAIRAEIDRVQSGAWPADNNPLVNAPHSKADIAGDWDRPYSREQGLFPLPYVLENKFWPSVNRIDDVYGDRNVVCSCPSTESYM

SEQ ID NO: 10666 - protein, 429 aa, Pyrobaculum aerophilum str. IM2
MPDGLAVWRVLRGAGVKLVKFVVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 10667 - protein, 271 aa, Burkholderia xenovorans LB400
MKIAFIGGGNMAAALIGGLIKRGVAAADLYAIDPNEEARKRNEQQFGIRTGAAADAALAAYDAVVLAVKPQILKSVAEAVAPHLNASQLVVSIVAGIRMGDMSRWLNGHSRIVRVMPNTPALIGMGVTGLVATGSVDEAGRALASQLLGAVGETVWFDDEAKIDAVTAISGSGPAYVFYFIEALQEAARQLGMDEAQGRALAVATFTGAAQLAANSDEPPGVLRERVTSKGGTTAAALASFDASGIKDAIVRGALAANARAREMGDEFGKQ

SEQ ID NO: 10668 - protein, 97 aa, Glycine max
RYIESMVADIHRTWLNGGIFMYPADAKSPNGKLRLLYEVFPMSYLMEQAGGQAFTGKQRALDLIPKKIHERSPVFLGSYDDIEQMKELYAASKEDDA

SEQ ID NO: 10669 - protein, 657 aa, Zea mays
MMNYVIFGVLLLVVGGGLRPSPAAADVFCDNLKQVAATLPQNTSSSPVQFATAIVGQAPDVVYALAFCQGDYSATACRECVAQAFNVTPACNKDGIFSYKACPVLYAGDNFIDPSNATEQADDTPFVRWNINNVTGDADDVRLITGLIRELLVDTVDRAASTAPRRFATGVMDSGRPFPTMYSMAQCTPDLSASDCLACLRRLVGMVNSTMALRMGAQIHVIRCYFRYEAYSLYDSQPMLRVGPPSVPAPAPAPAIGARRKSKLWVIPVVVVPLAVAAAAALCFIFYSPWFRRYRKGETTMAKAGSQELQGELVLDGKNSEFRVFDFEQVLEATNDFSDENKLGEGGFGAVYKGQFADGLEVAVKRLASHSGQGFTEFKNEVQLIAKLQHSNLVRLLGCCSQEEKKILVYEYLPNKSLDSFIFDENKRALLDWSRLLSIIEGIAHGLNYLHKHSRLRVIHRDLKPSNILLDREMNPKISDFGLAKIFSSNNIGGNTTRRVVGTYGYMAPEYASEGIFSVKSDVFSFGVLVLEIITGKRNSGSHQCGDFINLIGYAWQLWDDGRWIDLVDAYLVPMNHSAEMTKCIKIALLCVQENASDRPTMAEVVAMLSLSNDTAMIVAEPKQPAYFNVRVGNEEAYTTTESCSINDVTISVTTPR

SEQ ID NO: 10670 - protein, 123 aa, Brassica napus
KLELKARNPDTIKQVEKKLMEKGVQRMERHPSDGTQIKRPPPKSGRGGKYTWEGSDRMEDYEMQPDPPAMDEGDPNYDEEKIAGGGGGNNVPVVVVKEKVKVANKAPEGRPTRPVDPRLFSTP

SEQ ID NO: 10671 - protein, 227 aa, Pyrus x bretschneideri
MGITGMIYMFTMVFSLIVLILSSSTVGYDYFQFTQQYQPAVCNSNPTPCNDRPEKLFTVHGLWPSNKKGPDPEKCKNIQMNSQKIGNMAAQLEIIWPNVLNRTDHVGFWEREWLKHGTCGYPTIRDDMHYLKTVIKMYITQKQNVSAILSKAMIQPNGQNRSLVDIENAIRSGTNNTKPKFKCQKNTRTTTELVEVTLCSDRDLTKFINCPQPQQGSRYLCPADVQY

SEQ ID NO: 10672 - protein, 72 aa, Glycine max
  misc_feature (36)..(36): Xaa can be any naturally occurring amino acid
  unsure (1)..(72): unsure at all Xaa locations
GDRAFAEKHYADLSAKPFFSGLVDYIIYGPVVAKIXHVNTVVTTGLKMIRTTNPPQSEPGTFRDDSVLVMER

SEQ ID NO: 10673 - protein, 143 aa, Zea mays
  misc_feature (7)..(11): Xaa can be any naturally occurring amino acid
  misc_feature (13)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(27): Xaa can be any naturally occurring amino acid
  misc_feature (29)..(30): Xaa can be any naturally occurring amino acid
  misc_feature (32)..(32): Xaa can be any naturally occurring amino acid
  misc_feature (35)..(35): Xaa can be any naturally occurring amino acid
  misc_feature (53)..(53): Xaa can be any naturally occurring amino acid
  misc_feature (55)..(55): Xaa can be any naturally occurring amino acid
  unsure (1)..(143): unsure at all Xaa locations
LKRTYDXXXXXKXXXXKVXTXXDMIXXGXXNXPGXPLMVEGFTYIPHRFALGXAXEAPRGDDIHWSMTGDNQKLYRWRCRAATYANWPTLRYMLRGNTVSDAPLIIGSLDPCYSCTDRMTVVDVRKKKSKVVPYKELEGGPGP

SEQ ID NO: 10674 - protein, 392 aa, Synechococcus sp. WH 7805
MSRPLSLSSRAEALQPSLTLAISARAKALQQEGRDICSLSAGEPDFDTPEFIVEASVEALRNGMTRYGPAAGDPTLRELIASKISKENGIPTSAAEVLVTNGGKQAIYNLFQVLLNPGDEVLIPAPYWLSYPEMARLAGARPVAVPSSADDGFRLDLNALEAAITPASRVLIINSPGNPTGRVLSRDELLAIAELVRRHPRLVVMSDEIYEYLLDDGVTHDSFASLAPDLQDRCFMVNGFAKGWAMTGWRLGYLSGPESVIKAASALQSQSTSNVCSFAQQGAIAALTAPRDCVQTMAESYNRRRSFLVAGLQAMSGITLVPPQGAFYAFPQLPEGCGDSMSFCRRALEDEGLAIVPGVAFGDDRCVRVSCAVSRETITDGLARLARLLAVN

SEQ ID NO: 10675 - protein, 349 aa, Streptococcus mutans UA159
MKTAVFVKAGQMAIETIEKPSVIEVDDAIIRVVRACVCGSDLWSYRGDDDKATHSANSGHEIIGIVDEVGSAINTVKKGDFVIAPFTHGCGHCAACRAGFEGGCQGHDRSTNFSSGYQAEYVRYAHADWSLVKIPGQPSDYSEGMIASLLALADVMPTGYHAARVANVQKGDTVAVVGDGAVGLCAVIAAKMRGAKRIIIMSRHKDRQELALEFGATDIVEERGEEGVAKVLELTNGDGVDAALECVGTQLSTETALAIARPGASIGRVGVPHTKDINLSDYFFQNAIIAGGPASVTTYDKSVLLKAVLDGEINPGKVFTQSYSLDDIDQAYKDMQERKTIKSMVVVSK

SEQ ID NO: 10676 - protein, 371 aa, Azoarcus sp. EbN1
MTIKSRAAVAFGPKQPLQIVEVDVEPPKAGEALVRIVATGVCHTDAFTLSGDDPEGIFPAILGHEGGGIVEAVGEGVTSLEVGDHVIPLYTAECRECKFCKSGKTNLCQAVRATQGKGLMPDGTTRFSYNGQPIYHYMGTSTFSEYTVVPEISLAKIPKEAPLDKVCLLGCGVTTGIGAVLNTAKVEAGATVAIFGLGGIGLAAILGAKMAKASRIIGIDLNPAKSDLARQLGATDIVNPNDHAKPIQDVIVEMTDGGVDYSFECVGNVKLMRAALECCHKGWGESTIIGVAGAGQEICTRPFQLVTGRVWRGSAFGGVRGRTELPGYVEKAQRGEIPLDVFITHHLPLEDINRAFELMHEGQSIRSVIRF

SEQ ID NO: 10677 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 10678 - protein, 531 aa, Gibberella zeae PH-1
MYFSTTFGLAFIASLLSVPCEAETVNNVAIIGAGAAGSSAAFHLRKYALEENIAINITVFEKTDHVGGRSLTVPAYNDPSLPIELGASIFVGANHILVNTSRQFQLPLSKPHRLDKDDVTAIWDGIDFVFQTTEGSWGGWDLAKMFWSMIGEFLKLYEDPYFPFKSLSQRAEQLGLNRFTSLTGEQVLKNANIDPRFAREILQVATRVNYASNLAYIHGLETLVSLATDNAMSVETGNWRIFDEMIMDSGAAVYRNLTVASIEKSKTKAQSSSSSKYIITTADAHSKDDTAENYGVEFDNVIIANPWQFSNIKAGKGVLDRVIDEIPYTKLHVTLFTSSLELNPEFFSMKPGSKAPATVYTTLAEGDEAGQGADGVGRTGFYSISTLKYVTNPKTGQRERVYKIFSPKVVTAEFLTRILGTEIPEPVVSGKKQSEHISWYYPHSFYAYPIELPRVTFEDPVIGKGVYYTSGIESFISCMETSAFMGRNVARLVVDNFAGISRPDEPLGAGNEKGPLGEEMEGIKVQAEGEL

SEQ ID NO: 10679 - protein, 264 aa, Mesorhizobium loti MAFF303099
MIETADAEYDDTAIRFLEALWGDGYLSPGGPEEVDRVVEGLSLEGKTVLDIGCGSGGITLHLVERHGAARATGFDVEQPVIEAARRRAAGRGLSDRASFVQAPPGALPFADRSFDAVFSKDALLHVPDKDGVFAEIFRVLKPGGVFAASNWMIGHDSEPSPEMKAYIAAEGLSFAMASPARYAHAMRNAGFADVTVRDRNPWYREVARGELERLKGPLYTPVAAVVGAAYVDKNIRTWEAMQKVLDSGEHRPTHLRGWKPDAIG

SEQ ID NO: 10680 - protein, 525 aa, Gibberella zeae PH-1
MSKTDQKACLIVIDGWGIPSADSPKDGDAITNAKTPVMDALYKDSKGYTELEASSLAVGLPEGLMGNSEVGHLNIGAGRVVWQDVVRIDQTIKNGELSQNDVIKKTFQSAAGGNGRLHLCGLVSHGGVHAKQTHLYALLKAAKEYGVPKVIIHFFGDGRDTDPKSGAGYMQELVDNIKEIGVGEIGTVVGRYFAMDRDKRWDRLEIALKGLILGEGEASEDPVATVKARYEQGGDMNKDEFLTPIIVGGDDRRIKDDDTVFFFNYRSDRVRQITQLLGDVDRSPLPDFQYPKIKPLVTMTQYKVDYPFEIAFKPQHMGNVLAEWLGKQNVEQVHIAETEKYAHVTFFFNGGVEKVFPLETRDQSQDLVPSNKSVATYDLAPEMSADGVADQVVKRLGEQKFPFVMNNFAPPDMVGHTGVYDAAVIGCEATDKAIGKILEGCKKAGYVLFITADHGNAEEMKFADGKPKTSHTTNKVPLLMANYPEGWSLKKTTEGVLGDVAPTVLAAMGLPQPEEMTGKSLLEKA

SEQ ID NO: 10681 - protein, 62 aa, Arabidopsis thaliana
MASSMLSSATIVASPAHATMGAPFNGRKASAAFPATRKANNYITFITSNGGRVNCMHLCPPI

SEQ ID NO: 10682 - protein, 585 aa, Bacillus licheniformis ATCC 14580
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAAALITEEGGLTSHAAVVGLSLGIPVIVGMENATSILKEGEDITVDSARGAVYKGRASVL

SEQ ID NO: 10683 - protein, 314 aa, Brassica napus
  misc_feature (265)..(265): Xaa can be any naturally occurring amino acid
  misc_feature (274)..(274): Xaa can be any naturally occurring amino acid
  misc_feature (291)..(291): Xaa can be any naturally occurring amino acid
  unsure (1)..(314): unsure at all Xaa locations
MASSLTAAGTQPSAPSFSGLRRTCLKLDAAVSFSHRVNSSVRLVSSSQRSPRGVVAMAGSGKFFVGGNWKCNGTKDSITKPVSDLNTATLEPDVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIXGGSVNGAHXADLPKEEAIDGFLVAGXSLKGPEFAPHCELSSPQRKFLLD

SEQ ID NO: 10684 - protein, 1084 aa, Magnaporthe grisea 70-15
MSSRTLALSRHVARIGQSHSSQVRLLSSSRSLLNRSGLDSSRQQTWGKSSQAGAVARQSCLRRYQSTSAQASGIWGEDVLRQKDFPKIHSLQDFSDRHIGPDAQEEVEMLKALDPPMESMDAFVGEVIPEDVRLSKPMGVWRKQTEQEISSNISAHCRDSPPPCFIGKGYYNTLTPEVIKRNILESPAWYTSYTPYQAEVSQGRLESLLNFQTMVSDLTGLPVANASLLDEGTAAAEAMTLSINSLPSSRVKRAGKTMLVASSMNPMTIKVMEGRAEGFGVKIEKVAIPSPEFNERLEQLGDDVVGVMIQYPDDLGGLADYRDVAKRVHDKGVLLSCATELLALTLFTPPGEWGADIAFGSSQRFGVPLGGGGPHAAFFAVSEKHKRKIPGRLVGVSKDRRGERALRLALQTREQHIRREKATSNVCTAQALPANVAAMYAVYHGPEGLKAIAEGIVRKAKYVQAALAQLGFSVAETKAIDGVVAWDTVVVDMGSRETLQKFLESTKDKFQLRELTTPGRFSITVDESTTQEDINSLLGELSSYAPNKGVSPQQFTDSFTKAVSAELPGHFKRSSPYLQHPVFNSHHSETELLRYIYHLQSKDLSLVHSMIPLGSCTMKLNGSVEMTTLSMPAWSQSHPASNDQPVWADMLSSLNDMLKKVTGMSEVTLEPNSGAQGEFAGLRAIRAYHKSRGDDKRDICLIPVSAHGTNPASAAMTGMRVVPIKCDVKTGNLDVEDLEAKCEKHRDELGAIMVTYPSTFGVFEPRIREVCDIVHRHGGQVYMDGANMNAQVGLCSPGDIGADVCHLNLHKTFCIPHGGGGPGSGPVCAKSHLGPFLPNAAVREAEIKAVSLSGSKSGEEASSFAVSSAPHGSASILPISWSYMALMGPDGLKKATEVAILNANYLLARLKPHYPILYTNDKGRCAHEFILDARPFSKTAGVEAIDIAKRLQDYGFHAPTMSWPVANTLMVEPTESESKAELDRFADALISIRAEIRDIEEGRQPKTGNVLKNSPHPLHDIIGGDGNGGAGWDRPYTREQAAYPLPWLREKKFWPTVARVDDTFGDLNLFCTCPPVVDTTGDVN

SEQ ID NO: 10685 - protein, 317 aa, Debaryomyces hansenii CBS767
MSIKLNSGYDMPLVGFGCWKVDNDTCAATIYNAIKVGYRLFDAAQDYGNCKEIGEGINKALDEGLVARDELFITSKLWNSYHDPKNVELALKKVLSDMKLDYLDLFLIHFPIAFKFVPIEERYPPGFYCGDGDKFHYENVPLADTWKAMEKLTKSGKVKSIGISNFSGALIYDLLRSAEIKPAVLQIEHHPYLQQPRLVEYVQSQNIAITGYSSFGPQSFLELKHSKALDTPTLFEHKTIKSIANKNKKTPAQVLLRWASQRNIAVIPKSNNPDRLLQNLEVNDFDLSKEDFEEISKLDQELRFNNPWDWDKIPIFA

SEQ ID NO: 10686 - protein, 254 aa, Magnaporthe grisea 70-15
MSTPSPPRRIVGVSTKMYFSAARTSSYITSLLSLLPSVPSNTDVFVIPDHVTLLPSIQQLRAASSPILPGAQDCYSEDAGAYTGEVSPAVLAEVGCRIVELGHAERRRLFAETDASTAAKAAAVVRNGMIPLVCVGETARQAEISAAVADVAGQVQAVMAAVPGSAEVVLAYEPVWAIGAAQPAAAEYVVSVARGIRELECVRAREGTVRILYGGSAGPGLFEKLKDGVDGLFLGRFAHDPEQFVRTIREVSEA

SEQ ID NO: 10687 - protein, 377 aa, Nicotiana tabacum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTSAEREIVRDVKEKLAYVALDYEQELETAKSSSSVEKSYELPDGQVITIGSERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWITKGEYDESGPSIVHRKCF

SEQ ID NO: 10688 - protein, 178 aa, Glycine max
  misc_feature (115)..(115): Xaa can be any naturally occurring amino acid
  unsure (1)..(178): unsure at all Xaa locations
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 10689 - protein, 470 aa, Ehrlichia ruminantium str. Gardel
MFLSAEDTLNYIKKNTINFVDLRFTDSTSRWHHITRNAETIDTYVLSSGVNFDSSSIPGWQSVEKSDMILLPDVSTAFVDPFTAQPTLVIICNVINPYDKSEYPKDPRYTAHKASQYMLSTGIADKCYFGPEVEFFVFDNATFYNGMYHSYFKIESSEHISQFQKREHINNSHCPKIKGGYMPTPPVDSLHDLRSEILTMLKEVGITPLIHHHEVAASQCEVGFQHDELIRSADNVQKCKYIIHGVASSYGKTATFMPKPVIGDNGSGMHCHQSLWKDNINIFVNSDGSMSEICLYYIGGIIKYGKAINAFTNPSTNSYKRLVPNFEAPTWLTYSYENRSSAIRIPYVPNTDLNAKRIEVRFPDPLANPYLCFSAQLMAGLYGIKNKIHPGPSIDKNLYTLDKKELQSFISVANSLEESLYALDNNREFLLEGDVFTNDQIDTYIKLKSSEARDLHLHPHPIEFINYYSS

SEQ ID NO: 10690 - protein, 393 aa, Rhodococcus sp. RHA1
MRAVTWQGKRKVSVDTVPDPVIEQKTDAIVEITTTNICGSDLHLYEVLGAFMSEGDILGHEPMGIVREVGSEVTDVKVGDRVVIPFQISCGNCHMCDRKLFTQCEITQNRDEGTGAALFGYSKLYGSVRGGQAEYLRVPHVKNTHITVPDGPPDSRFVYLSDVLPTAWQAVEYADIPDGGSVVVLGLGPIGDMAARIAAHNGFRVIGVDLVPERLARPQARHIETVDLTDAEGELGDVIREMTGGRGPDSVIDAVGMEAHGSPGAKLLQQVTSYLPDALAGPLMSTVGIDRLHALYSAIDIVRRGGTLSLIGVYGGMADPIPMLTLFDKQIQVRMGQANVKRWVPDILPLLTDADPLGVDTFATHELPLDHAPHAYEIFQKKEDGAVKILLKP

SEQ ID NO: 10691 - protein, 158 aa, Brassica napus
DPRYVFQFEDVTTLSPQIVQLRGSVKQPIFSCKFSRDRVSHVDPLNGYWSSSGDGTELGSERRERKGWNVKIHDLSGSAVAAAFITTPFVPSTGCDWVAKSNPGAWHVVRPDPCRPNSWQPWGKLQAWREPRIRHSVCCRFHILSNGQQVGDVLMSEI

SEQ ID NO: 10692 - protein, 551 aa, Escherichia coli
MTHLPHWWQNGVIYQIYPKSFQDTTGSGTGDLRGVIQHLDYLHKLGVDAIWLTPFYVSPQVDNGYDVANYTAIVPTYGTLDDFDELVTQAKSRGIRIILDMVFNHTSTQHAWFREALNKESPYRQFYIWRDGEPETPPNNWRSKFGGSAWRWHAESEQYYLHLFAPEQADLNWENPAVRAELKKVCEFWADRGVDGLRLDVVNLISKDPRFPEDLDGDGRRFYTDGPRAHEFLHEMNRDVFTPRGLMTVGEMSSTSLEHCQRYAALTGSELSMTFNFHHLKVDYPGGEKWTLAKPDFVALKTLFRHWQQGMHNVAWNALFWCNHDQPRIVSRFGDEGEYRVPAAKMLAMVLHGMQGTPYIYQGEEIGMTNPHFTRITDYRDVESLNMFAELRNDGRDADELLAILASKSRDNSRTPMQWSNGDNAGFTAGEPWIGLGDNYQQINVEAALADDSSVFYTYQKLIALRKQEAILTWGNYQDLLPNSPVLWCYRREWKGQTLLVIANLSREIQPWQAGQMRGNWQLVMHNYEEASPQPCAMNLRPFEAVWWLQK

SEQ ID NO: 10693 - protein, 393 aa, Chaetosphaeridium globosum
MTKTKQIKNFTLNFGPQHPAAHGVLRLVLEMNGEVVERAEPHIGLLHRGTEKLIEYKTYLQALPYFDRLDYVSMMAQEHAYSLAVEKLLNCEVPLRAQYIRVMFCEITRILNHLLALTTHAMDVGALTPFLWAFEERERLMEFYERVSGARMHAAYIRPGGVAQDLPLGLSEDIYKFTQQFASRIDELEEMLTNNRIWKQRLVDIGVVTAQDALDWGFSGVMLRGSGINWDLRKAAPYDVYQQLDFDVPVGTRGDCYDRYCIRVEEMRQSLRIIAQCLNAMPTGMVKVDDRKITPPSRSQMKQSMESLIHHFKLYTEGVSVPEGSTYTAVEAPKGEFGVFLVSNGTNRPYRCKIRAPGFVHLQALDFMSKHHMLADVVTIIGTQDIVFGEVDR

SEQ ID NO: 10694 - protein, 175 aa, Aegilops tauschii
MAPTVMASSATSVAPFQGLKSTAGLPVSRRSNGASLGSVSNGGRIRCMQVWPIEGIKKFETLSYLPPLSTEGLLKQVDYLIRSKWVPCLEFRKVGFIFREHNVSPGYYDGRYWTMWKLPMFGCPAPTQVIPEVEEVRKEYPDPYCRIIGFDNMRQVQSVSFIASKPPGCEESGKA

SEQ ID NO: 10695 - protein, 245 aa, Clostridium difficile
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESRASDIYLIVEEGFYKRTLDIHRTLGLLLHTQVSIKQLLKLPAECFHPKPKVNSALIKLTRHTTDVPDKYWKLYTYFVSKWVNREYRQLFTKNQFHQAMKYAKVNDLSTVTYEQVLSIFNSYLLFNGRK

SEQ ID NO: 10696 - protein, 473 aa, Oceanicola granulosus HTCC2516
MIHPILLCGGSGTRLWPLSRKSFPKQFSRLMGEESLFQASARRLSGEGFAAPVILTAEPFRFIVTEQLAQIEQAPQAILIEPEGRNTAPAICAAALWLAGQDPEALMLVAPSDHVIPDAEGFRAAIHAAAPRAAAGDLVTFGIAPDRPETGYGYLELAAGADARAEAPQPLARFVEKPERARAEEMLAAGNFLWNAGIFLMSARAAAEAFRTHAPDIVAAVSEALAGAERDLGFTRLAAEPWSRAPDISVDYAIMEKADNLAVKRYAGPWSDVGGWDAVWQQSGPDAQGNVCSEHATAIDCSDTLLRSETDQVEVVGIGLEGIVAIATSDAVLVAKKDEAQRVKAAVSALKAKGAKQAVQFPRDHRPWGWFESLVIGGRFQVKRIVVHPGAALSLQSHHHRSEHWIVVEGTAKVTVGEEVKLVTENESVYIPLGATHRMENPGKVPMVLIEVQTGSYLGEDDIIRYEDVYARS

SEQ ID NO: 10697 - protein, 166 aa, Arabidopsis thaliana
  misc_feature (6)..(6): Xaa can be any naturally occurring amino acid
  misc_feature (14)..(14): Xaa can be any naturally occurring amino acid
  misc_feature (68)..(68): Xaa can be any naturally occurring amino acid
  misc_feature (97)..(97): Xaa can be any naturally occurring amino acid
  misc_feature (116)..(116): Xaa can be any naturally occurring amino acid
  misc_feature (118)..(118): Xaa can be any naturally occurring amino acid
  misc_feature (124)..(124): Xaa can be any naturally occurring amino acid
  misc_feature (128)..(128): Xaa can be any naturally occurring amino acid
  misc_feature (130)..(131): Xaa can be any naturally occurring amino acid
  misc_feature (137)..(137): Xaa can be any naturally occurring amino acid
  misc_feature (144)..(146): Xaa can be any naturally occurring amino acid
  misc_feature (149)..(149): Xaa can be any naturally occurring amino acid
  misc_feature (152)..(152): Xaa can be any naturally occurring amino acid
  misc_feature (158)..(159): Xaa can be any naturally occurring amino acid
  misc_feature (162)..(162): Xaa can be any naturally occurring amino acid
  unsure (1)..(166): unsure at all Xaa locations
MASSMXSSTAVVTXPAQATMVAPFTGLKSSASFPVTRKANNDITSITSNGGRVSCMKVWPPIGKKKFXTLSYLPDLSDVELAKEVDYLLRNKWIPCXEFELEHGFVYREHGNNSRXTXNGRYLXMWKXPXXGCTDFXQVLKEGXXXKKXYPXGLIRVXXLEXPSHL

SEQ ID NO: 10698 - protein, 137 aa, Zea mays
  misc_feature (53)..(53): Xaa can be any naturally occurring amino acid
  misc_feature (74)..(74): Xaa can be any naturally occurring amino acid
  unsure (1)..(137): unsure at all Xaa locations
LTREPLSPYPPSLRASIISAYCAKYTDELILNAAYIGTPVNGILAAEESTGTXGKRLSSITVDNVEENRRALHXLLVCCPGALHYISSVILFEETLYQMTYDGKPFVYVLNDGRLLPGIKVDIGTIQVVGTDNENTA

SEQ ID NO: 10699 - protein, 254 aa, Cytophaga hutchinsonii ATCC 33406
MLKATFLGTGTSQGIPVIACACEVCKSFDYRDKRLRTSVFIETDKVKLVIDTGPDFRQQMLRERIKNLDAILFTHEHKDHIAGLDDVRGFNYAQKRDMPVYARHNVIDSLKREFAYIFAEYQYPGIPRIDIHELKNEPFEIQGEKIIPIEVMHFKLPVFGFRIQDFTYITDANFISDTEIEKIKGSKIVVLNALQKEAHVSHYTLEQAIEVIKHINPEQAYFVHMGHRMGKQADVEKELPHNMHFAYDGLTLQL

SEQ ID NO: 10700 - protein, 141 aa, Heliobacillus mobilis
MERTYLMIKPDAVQRGLIGEIVSRFEKKGFKLVAMKFLRLTKEMAEKHYAEHVGKPFFAGLVEYIISGPVVAMCWEGKDVVTVSREMMGATNPAKAAPGTIRGTFAVDLPLALRRRVLRRFLEPENPGSEKTDAILEQLQQ

SEQ ID NO: 10701 - protein, 257 aa, Aspergillus terreus
MTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSTIEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 10702 - protein, 275 aa, Arabidopsis thaliana
VQNLIERCLQLYMNQKEVVDTLLEQAKIEPGFTELVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGEHLKLC

SEQ ID NO: 10703 - protein, 500 aa, Glycine max
MFGYAAAIIAAILFFQYFFHRRRCCKHPILTEYPIIGMLPQLLFNLWRAHDYSTQVLQRHGGTGEFIGPWFTNMDYLVTCDPINVHHMLSKNFHNYVKGPEFRHIFQAFGDGIFAADSEAWKYSRDLFHSLFKQKSFEVFVAKTIHNKVHNGLLPILDHVQQQGRVVDLQDVFNRFTFDNICSIVLGNDPNCLSIDFSEVAIEKAFNEVEESIFYRHVVPRCVWKIQRWLQIGQEKKMTEACKTLDQFIHACIASKREKLSKYNENEMGEAHHVDFLTALMREETAHDDKFLRDAVFNLFVAGRDTITSALTWFFWLVATNPSVEAKILDEMKEKLGTKEKTLGVLSVEEVKRLVYLHGAICEALRLFPPIPFETKQAIKADMLPSGHRVNSGTKILFILYAMGRSEETWGKDCLEFKPERWISEKGGIIYVPSYKFIAFNAGPRTCLGKEISFIQMKMVAAAILHKYRVRVVDHVATPSPSIVLLMKDGLKVQIAKREI

SEQ ID NO: 10704 - protein, 89 aa, Oryza sativa
MPSIQKALPPELADNVIRLYRECLRRARFIGHQKHNTGLIVSMVREQFKKNMHETDPEKIQKMKDDAARGLINHILYESEKMTGRKFSS

SEQ ID NO: 10705 - protein, 271 aa, Burkholderia xenovorans LB400
MTYLQEASRNAVTVPKLQAMRDAGEKIAMLTCYDASFAALLDRAGVDVLLIGDSLGNVLQGQTTTLPVSLADIAYHTASVARARPAALIVADLPFGTYGTPEDAFRSSVELMRAGAQMVKLEGGEWLADTVRFLVERSIPVCAHVGLTPQSVHAFGGFKVQGKTEAGATQLLRDSLAVQAAGAQLIVMEAIPTLLASDATKQLRIPTIGIGAGLDCSGQVLVLHDMLGIFPGKRPRFVKDFMQGQPSILAAVEAYVAAVKDGSFPGPEHTF

SEQ ID NO: 10706 - protein, 445 aa, Bifidobacterium longum DJO10A
MDKQQEFALRTVEERDVRFIRLWFTDVLGTLKSVAIAPAELEAAFEEGLGFDGSAIEGMTRVSEDDMIVQPDPSTFQILPWRGGPQGTARMFCDILTPDGEPSLGDPRHVLKRTLAKAKDKGFTFYVHPEIEFYLFESQDDWSKAPTPIDEGGYFDHVPRSPGMDFRRATVNMLEQMGISVEYSHHEAGPGQNEIDLRYADALTMADNIMTFRTVVKEISLERGIHASFMPKPLADAPGSGMHTHLSLFEGDSNAFYEAGQEFNMSLTARQFAAGILYHAAEICAVTDQYVNSYKRLWGGNEAPSYICWGHNNRSALLRIPQYKPGKGNSARMEFRALDPVANPYLAYSVLLAAGLDGIDKQMQLGEPTSDDVWELTDGERQAMGIQPLPRSLDEALKIMEKSDFVADVLGEHAFGYFLDNKHQEWEEYNQQVTPYELKKYLPKL

SEQ ID NO: 10707 - protein, 170 aa, Arabidopsis thaliana
  misc_feature (115)..(115): Xaa can be any naturally occurring amino acid
  misc_feature (157)..(157): Xaa can be any naturally occurring amino acid
  unsure (1)..(170): unsure at all Xaa locations
PRVRRVRQKKNKTQKSSLLYVSSPPVVTSPAQATMVAPFTGLKSSAAFPVTRKTNKDITSIASNGGRVSCMKVWPPIGKKKFETLSYLPDLSDVELAKEVDYLLRNKWIPCAEFXLEHGFVHREHGNTPGYYDGRHWTMWKLTLIGCTDFDQVLKEXLQECMTEYPGAFI

SEQ ID NO: 10708 - protein, 442 aa, Arabidopsis thaliana
MSTISKPLFLKLLYIFFFFCYSVSLSWSSSLSLHFPLTSLRLTPTTNSSSFKTSLLSRRNPSPPSSPYTFRSNIKYSMALILSLPIGTPSQSQELVLDTGSQLSWIQCHPKKIKKPLPPPTTSFDPSLSSSFSDLPCSHPLCKPRIPDFTLPTSCDSNRLCHYSYFYADGTFAEGNLVKEKFTFSNSQTTPPLILGCAKESTDEKGILGMNLGRLSFISQAKISKFSYCIPTRSNRPGLASTGSFYLGDNPNSRGFKYVSLLTFPQSQRMPNLDPLAYTVPLQGIRIGQKRLNIPGSVFRPDAGGSGQTMVDSGSEFTHLVDVAYDKVKEEIVRLVGSRLKKGYVYGSTADMCFDGNHSMEIGRLIGDLVFEFGRGVEILVEKQSLLVNVGGGIHCVGIGRSSMLGAASNIIGNVHQQNLWVEFDVTNRRVGFSKAECRLLP

SEQ ID NO: 10709 - protein, 281 aa, Gibberella zeae PH-1
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALVGEGASGLYAAEDVTAAEKELTSALLGSVSKATEWVDKEELLDVVTGISGSGPAYFFAFVEHLISSGVSLGLSEEQATRLATQTCLGAGKMLVESSDEPSQLRKNVTSPNGTTHAALVSFESSGLKEIVNKAVKAAANRAQELGKN

SEQ ID NO: 10710 - protein, 191 aa, Deinococcus radiodurans R1
MAHLGHGTAGRFAEREHERRLACTPGCGGYWVGGYRAGGQRFVSQSTAILTSGMERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 10711 - protein, 393 aa, Listeria monocytogenes
MDLPLSKRVKGVAPSPTLAITAKAKQMKQEGIDVIGLGAGEPDFNTPQNIIDAAIESMNKGFTKYTPSSGIIELKQAIVDKLKKDQFLNYETNQIFVGTGAKHVLYSAFQTILDPGDEVIIPVPYWVTYPEQVKLAGGIPVFVETGFDADFKISAADFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYQAFEERMERFYPELNSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 10712 - protein, 405 aa, Methanosarcina acetivorans C2A
MKVVLDPVHGYIELDEIVQELLATPQVQRLRRIRQLGFSNLVYPGANHTRFEHSLGTMHLASMLMKNLDSIEKDKKVEIRAASLLHDVGHGPFSHVTENVIDKYTRRRHDDVMDIVRKGEIKEVLKKHGISPGNLAKHIKGETSLGQILSSEIDVDRMDYLVRDSHYTGVAFGVVDYNRLINQMSFYEDRLVIDYGGLKAAESLLVSRFWMNTSVYYHHVTRISEAMCSKAVEYMIENGELDPKRLRQMDDIDLIAAMRNSSGHGGELSRRLDARKLYKRALYTGLEEAGKGVLKYRDKIERAEKEIAELAGVGQECVLVDIPKTPEMLEMKAMIKTDHKMIPLKDASHFVSILQEAHMDNWRIGVYSPKEHCEAVGKAAKEYFNIKKATKQFKLNDLEKYKAEE

SEQ ID NO: 10713 - protein, 282 aa, Vibrio cholerae O1 biovar eltor str. N16961
MIKKRNNLEKTMRNDVHLGHKARKRFGQNFLNDPYIIDGIVSAINPKPGQNLVEIGPGLGAITEPVGREVDKFTVIELDRDLAERLRNHPELASKLTIHEGDAMRFDFKQLVKPNNKLRVFGNLPYNISTPLMFHLFEFHRDIQDMHFMLQKEVVNRLAAGPGTKAYGRLTVMAQYYCKVVPVLEVPPSAFVPPPKVDSAVVRLVPYEDLPHPATSLEWLDRVVREGFNQRRKTVRNCYKGLAEPETLETLGINPGMRPENLTLAQFVALANWLDATHKTHA

SEQ ID NO: 10714 - protein, 277 aa, Listeria monocytogenes
MKRPVDFFAMKENGEKITMITAYDYPSAKNVEQAEADMILVGDSLGMVVLGYDSTVPVTIDDMIHHTKAVKRGATDTFIVTDMPFMTYHGSVNETIQNARKIIQESGAHAVKLEGAGEVVNKIARLTEAGAPVVAHLGLTPQSVGLTGSYKVRAKSAQEAQELMDNALAVEAAGAIAIVLEAIPRQLAEKVSKALSIPTIGIGAGLETDGQVLVYHDIIGYGISRRAKFVKAYADIDETIEPALASYVKEVKAETFPEVKHSFTMAEEDLKGLYGRE

SEQ ID NO: 10715 - protein, 325 aa, Listeria monocytogenes
MKNNREKLLALFTESDGTYLSGQEIADSLGCSRTAVWKQMEALRKEGFEIEAVRNRGYRLSATAEQYTKDALLLGLETKFIGQHLEVHESVNSTQIIAHQQIETSPEGTVIVADEQTAGKGRLLRPWSSKKGEGIWMSVILKPQIPIQKVPQFTFIASLAITEAIENITKLEPKIKWPNDIYIGKRKICGVLTEMQAEAETIHAVIIGMGINVNQQEFPEEIKDKASSLKLELGESVSRKALLQEILTSLEKYYELFLDKGFAPIKLLWETKAIPFGEKLTASTTKGKIHGQVKGISDEGVLLLQDTLGEVHSIYSADILLDNEK

SEQ ID NO: 10716 - protein, 439 aa, Methanosarcina acetivorans C2A
MRIWTEPEMNRYESNSLTLTGAVSLGTGVMIGAGIFALLGQIAELAGMLFPIIFLIGAVVTAFSAYSYVKFSNTYPSAGGIAMYLEKAYGKGVMTGFGALLMAFSMVINESLVARTFGTYTIQLFNMDEGSFLVPLLGVGLLVFAFAVNISGNRVIEKFSFFMALIKITGIAIFGIVGLWLADFSFTYTSTDAMATTTEEYLAAVALAVLAYKGFTTITNSGSEIVDPHQNVSKAIVISIAICTIIYFLVSLAVAGSLTLPEIIEAKNFALAEAARPVFGNYGLWFTVALAIIATISGIIASVFAVSRMLAMLTDMDLIPHRHFGMPGDIQKHTLVYTIVVAILLTIFFDLSRIASLGAIFYLVMDIMIHWGLLRNMREKIKIRSYIVITAIILDAAVLSALLLTKASTDTLLVVISLIMMLLIFAGEKLFLRSHPNQE

SEQ ID NO: 10717 - protein, 260 aa, Camellia sinensis
MATSTPREESVYMAKLAEQAERYEEMVEFMEKVSSTVVESEELTVEERNLLSVAYKNVIGARRASWRIISSIEQKEESRGNADHVSTIKDYRSKIENELSSICDGILKLLDTKLIPSATAGDSKVFYLKMKGDYHRYLAEFKTGSERKEAAENTLNAYKAAQDIANTELAPTHPIRLGLALNFSVFYYEILNSPDRACSLAKQAFDEAIAELDTLVEDSYKDSTLIMQLLRDNLTLRTSDTQDDGAEEIKEAPKHEEEKQ

SEQ ID NO: 10718 - protein, 340 aa, Ustilago maydis 521
MPLFKSSDIPDLTGRVAIVTGGNSGLGEVSCLELARNGAKVYMASRTESKAQEAIQKIKQAIPKADIHFLQLNLTELAAVRKAAEDFLSREQRLDILLNNAGVMATPYTFTKDGIELQVGTNVVGHYLFTMLLLPTLYKTSKLPEYSAPDSPSVRIVQVSSLGHVASPSDTSFKDLEAVNKQHWPEVKGTWDRYGKSKLGNILIANELSKLLPKDARITSLSIHPGVVRTGLLRGPNESYGKIIGSVNSLLSRFFTAAEDGALTQLYACTSPEVDRLNLNGAYLVPVAKLGQKSKLAQDTDGRLGQELFSFCNSFIKEKLDLDLPAHLKEIGVQLPQSHL

SEQ ID NO: 10719 - protein, 144 aa, Brassica napus
MEIDSEKTHERKQSDYTSLDERFEIQKDMYRGQQYSQIYFVRLHLMRTLLYSLAPSWKPHLPVCKVLGLEEGKECIIVGTLFKHMKLKPCVLDEYSKERSVTPLVKPHNFMHPDDSLILEDESGRVKLGGSALSPPVYVTGVVV

SEQ ID NO: 10720 - protein, 162 aa, Lycopersicon peruvianum
HGLWPDIKGTILNNCNPDAKYASVTGGKFVKRNKHWPDLILTEAASLNSQGFWAYQFKKHGTCCSDLFNQEKYFDLALILKDKFDLLTTFRNKGIIPKSTCTINKIQKTIRTVTGVVPNLSCTPTMELLEVGICFNRDASKLIDCDQPKTCDTSGNTEIFFG

SEQ ID NO: 10721 - protein, 271 aa, Zymomonas mobilis subsp. mobilis ZM4
MSHIHFIGSGQMSEAMIRAIIKHKTASASDITAYDIRPEREKELHDNYGITTFAKPKKNIETLQKADIVVIGVRPQDDLKAVTADIAQNAKEKALIVSIVAGVTLAQFEDLLGKERAIARIIPNTLTDTGLGYSGVVINNQADKALTEKFVSGFGKCLFLEESLIDIFTGFGVCGPNYVYYFIEALVDAGVLAGLPRDIAWETTMENLVGSVKMLEISGKHPRQLLDINNSPAGVGMNSLFALNQSDFTAGLQKSVLAAVKRTTELGQKKD

SEQ ID NO: 10722 - protein, 287 aa, Prochlorococcus marinus str. MIT 9211
LKAALESGKVAGAALDVFEEEPAKENPLFGMENVICTPHLGASTTEAQENVALQVADQMADYLLTGAVTNAINMPSISAEEAPKLAPYVTLAEQLGSFAGQLTETGIEEVIIEYEGEVTELNTRALTNAALCGLLKPLLSDVNMISAPVIAKQRDIELTEVKREEPRGAFETYIRLTVKTERQERSVAGTVFSDGRPRLIQVKGIDMEAELGANMLYVTNEDKPGFIGALGTVLGNSGCNIANFRLGRGTPGGDAIALVELDQELSAECIKAVEAIPHVKQAKALKF

SEQ ID NO: 10723 - protein, 380 aa, Gibberella zeae PH-1
MPTTELISYDEAQNSAFDNVLHGKSKESRGGMRAMMNKDNKAHAAAVDEYFQFFDNKKAEDEVEAVRQERTDNYASLTRQYYNLATDLYEYGWSQSFHFCRFAYGESFDRAIARHEHYLAHNIGIKPGMKVLDVGCGVGGPAREIVKFTGAHVTGLNINEYQVGRAGIYAEKEGLSDKLKFVQGDFMKMPFPDNSFDAVYAIEATVHAPSLEGVYSEIRRVLKPGGIFGVYEWLMTDIYDNDDLEQRRIRLDIELGDGIAQMFKIDHGLSAIKAAGFELLHHEDLAATDDGTAPWYWPLDSDMRYAQNLSDLLTVFRMNKWGRLVMHNLIGVLEACSIAPKGTRKTADGLAKGADALVEGGKRKLFTPMYLMVGKKPEKI

SEQ ID NO: 10724 - protein, 529 aa, Vibrio sp. Ex25
MEIILITTAFLAGFIALKCSLPPLVGFLLAGFGLHAFGYQSNDVIVTLADLGVTLLLFTIGLKLDVKTLLSKEIWGGATAHNILSTAFFALALSGLKLLGLTSLASMDSGQILLLAFALSFSSTVFAVKALQEKGEMNATYGTLAIGILVMQDIFAVVFLTASTGKVPEWYAIGLFALPFLRPLFYKLLDKVGHGEMLVLFGIFFALVVGAGLFELVGMKPDLGALILGMLLAGHPKASELSKSLFNMKELFLVCFFLNIGLSASLSVNGVVLALLFILLLPIKGLLYFVTINHFKFRVRTSLLASLSLFNYSEFGLIVAGLAYKMGWMPSDMLAAIAVAVSVSFIISAPLNRLSHKIYQHSGKWLQETAAEKLNQRDQLINPGHAQVLILGMGRIGTGAYDELRARYGKISLGIEIREDAAHQHRSEGRNVIAGDATDPDFWERILDTGHVKLVLLAMPHHQGNQTALEQLKRRKYKGQIAAIAEYPDQLEGLLESGVDAAFNIYSEAGSGFARHVCKQLEPQFTPIK

SEQ ID NO: 10725 - protein, 238 aa, Thlaspi caerulescens
MSSQICRSASKAARSLLSSARNVRFFSEGRAIGAAAAVSASGKIPLYASNFARSSGSGAASKNWLTGLIALPAAALMLQDQEVLAAEMERTFIAIKPDGVQRGLISEIVSRFERKGFKLVGIKVVVPSKDFAQKHYHDLKERTFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 10726 - protein, 266 aa, Bacillus clausii KSM-K16
MPSILFIGAGRMAEAIFSGLLRQPKQPFDSIYVTNRTNKERLGELAQRYAITPVDTHGAIAAKADVLLLAMPPSAHGEVLSELAPMIRGQLIITVAAGIGPSDMEAQLPEGTAAAWIMPNTAAQVGTSISLYAFGKNVAEKQKLLVKEIVHAIGAGEELSEEQIHDLTAITGSAPAFVYEFALQLEKMALSYGITDKQARHLVKTMLAGSVKMLETGAPPQELRDQVTTPGGATEAGLVSLGNDHFSAMLERAVHAVTDHAKNKRN

SEQ ID NO: 10727 - protein, 801 aa, Cryptococcus neoformans var. neoformans B-3501A
MSPPQGKGVPVPNLGLKHESKKKGHVMQSSLELVFSYSRSQQMHYGSRSAPSFLDDSSFRGDQFDVDDYDEDQNYNDIYDGIERTGEEQFEGRDLSGRLEDLKMAGAISEGNEDGSTQEELGQDSHITRRSSDEPAFFHSDSVPISPISQLQPSVNQGAKVNTLLPDGIGPIQGLFLAAMPSPRLAPVLPHPGSLDTSFCTEAGPSSNPRTSKRWNSHTRGDSNPMEIRESAALVSSSPQYHGKGKSAENRPLLDGRPTEGYASIQSQKEIRRKSNRRKRSEDGQSTEGQTLFNATAVLVGIGLLSLPLAFAYAGWIGGTIMLLGFGWLTCYTAKLLARLIRADGRMMGYTDIGLRAFGSWAGAGINLLVHFIVSSCNDGILTTGSSVALVLLFGDTLNVLYPSIPSNVWKLVGFFIIVPTVLLPLRLLSLPSLLSSISSFFLIIVLLVDGILPSPEPSSASTGSLLHPSPTSLSPEWSRGNWLGGIGLILAGFGGHAVMPSLARDMKRPEKFDGIVNWAFAIATGISFTAGAAGYLMFGETVSDEVTKDLMREKYHYPRILNIVALWMIVINPLTKFGLSSRPLNLTIEGILRISPSPPPSLFSPFDGGLESALGSGAPETSQVNFPKRRDRSSFSTHNDPRTSRRPSALTSPSNSRPFPQSQSQIVAFEQYVSKERKKRWLRMVSRVVITALCVGVAVVLPGFGRVMAFLGSFSAFMICIILPLLFYIRLSPTLLPTCPPSPHSLTFLPTARSQPMSKWASEKFTNAIHWVLVIASTALMIAGTIWAFLPGSGHDELET

SEQ ID NO: 10728 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 10729 - protein, 319 aa, Methanosarcina acetivorans C2A
MKIVVADSIFLTDEYRKRLEALGELEIYDSVPVSLDEFIDRIKDADIVVVGRYGVSAEALRSAPRLKMISLWQTGFDNVDLEEATDHGVIVSNVPSYAFESVAEFVFALTLNLLRRVHLADMNLREGLFDWKYYVGNQLMSKTIGVLGTGEIGKRVIQIAHGFNMNVLSVTAHPSPERAKALGVKFVDLDTLLSESDIVTLHVPLTPETEHMIGARELAKMKPTAILINTARGKVVEEAALMEALKEKKIAGAGLDVFEREPLSMDSPLLEMHNVVLTPHIAFLSEESLDECTYISIENVEMFAKGKPQNVVNPSVLKG

SEQ ID NO: 10730 - protein, 319 aa, Aspergillus niger
MASPTVKLNSGYDMPLVGFGLWKVNNDTCADQIYHAIKEGYRLFDGACDYGNEVEAGQGIARAIKDGLVKREELFIVSKLWNSFHDGDRVEPICRKQLADWGIDYFDLYIVHFPISLKYVDPAVRYPPGWKSEKDELEFGNATIQETWTAMESLVDKKLARSIGISNFSAQLVMDLLRYARIRPATLQIEHHPYLTQTRLVEYAQKEGLTVTAYSSFGPLSFLELSVQNAVDSPPLFEHQLVKSIAEKHGRTPAQVLLRWATQRGIAVIPKSNNPQRLKQNLDVTGWNLEEEEIKAISGLDRGLRFNDPLGYGLYAPIF

SEQ ID NO: 10731 - protein, 409 aa, Zea mays
NSCSCFLLRKSNVIGFSTRIDAVDPALRRAGRFDSEVEVAVPTVEERLLILKLYTKNLHLDEKVDLQTVAVFCNGYVGADLEALCREAAKLAYHRMLNLCEGDKVLKLLMEDWECARSMVGPSITRGVTKEISIVSWDDIGGLKDLKKELQKAVEWPIKHAAAFSRLGIPPVRGVLLHGPPGCSKTTLAKAAAHAAQASFFSLSGADLYSKYVGEGEALLRRTFQKARLASPSIIFFDEADAIAPKRTGPGGNSSGNATVGERLLSTLLTEMDGLELATGIIVLGATNRPNAIDAALLRPGRFDKVLYVPPPDVEGRHEILRIHTRKMKLGEDVDLWKVAECTELFTGADLEGLCREAGMAALREDISASLIHDAHFQAARSSLSPSLTKAVVDEYSKVDINDPSSRKH

SEQ ID NO: 10732 - protein, 274 aa, Zea mays
MRTPSRPGPGSPTSIPALQATKFYSVHLRPSSSQETTRTSAIRPAMAAARRLSLPLVLLVVLAVAGRAAAQDYDFFYLVLQWPGAYCDTKQSCCYPKSGKPAADFGIHGLWPNRDDGTYPQNCSPDNAFNPSKVSDLLSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 10733 - protein, 89 aa, Arabidopsis thaliana
ADSLLYAKIFLIAVSLIMDYRVAVWFSIIFSVIYLLAQQPAFSKLGTAKKLTPMQLEDLLSDGNTTKYWLVCGYLALFFYLIMLLIFSS

SEQ ID NO: 10734 - protein, 124 aa, Synechococcus sp. WH 7805
MREAVTVQSVSTRVERPWGWYEDLLSGPGYKLKRLLVRHGCRLSLQRHRHRSENWTVVAGTGQLLCDGHLVKAKAGTTFHIPCGSIHRASGGPGDLLIIEVQHGGTLEESDIERLEDDFGRVIN

SEQ ID NO: 10735 - protein, 189 aa, Lycopersicon peruvianum
QLQLVLRWPTSFCNGKNCKRTPKDFTIHGLWPDSEAGELNFCNPRASYTIVRHGTFEKRNKHWPDLMRSKDNSMDNQEFWKHEYIKHGSCCTDLFNETQYFDLALVLKDRFDLLTTFRIHGIVPRSSHTVDKIKKTIRSVTGVLPNLSCTKNMDLLEIGICFNREASKMIDCTRPKTCNPGEDNLIGFP

SEQ ID NO: 10736 - protein, 210 aa, Lycopersicon peruvianum
FFALSTISIYGSFDHWQLVLTWPAGFCKTKDCPRKDIPNNFTIHGVWPDHTSFVMYDCDPLKKYKTIDDTNILTELDARWPQLTSTKIIGLQFQRFWEYEYRKHGTCCADVFNQSMYFDISMKLTDSIDLLKILRTKGIKPGYTYTGDQISRAIKSVTQNNPNPKCTYIGRSLELIEIGICFNRTTNALMPCPRISTSCKLGTLEGVKFR

SEQ ID NO: 10737 - protein, 589 aa, Ustilago maydis 521
MRSSWLSTASAVFVCAAALANAAKLPAPLEQIHYDQAGNLVWNEDNDVSNVIPSLGRPDFSALKLEGVVAAATPVKQSVHDVFSESMKQAEDVLTWAENEIERIEHKIEDAVVGTKHTVKDWIHTGKVFVDGLEFERLTHPSFPEYSLRLNTQSEAFCDKDVVQHSGYLDISDSKHLWFIFFESRSSPKDDPVVLWLNGGPGCSSSTGLLFELGPCRVTDQGRAVKNNPHSWNNKANLLFLDQPVDVGYSYSDNDQVNNSPAAAEDVYAFLQLFFAKFPEYSKLPFTASGESYAGTYLPNIASTIYKKNKNLALARYSNPELAPKHINLDTVMIGNGLSSPQYQFPSVPEYACGADNKYALFEPGSSTCKTLEQQAATCKSLINSCQKYNSRLTCTPAALYCWSRLYGPAQETGKNLYDVRKTCDREKDGPLCYKDMEYIETLLNTPSIKKNLGVPESVNFQSCNMNINQAFLLQGDSMHDSAALLPELIEDDIRVLIYAGEADFMCNYMGNLEWMQSLETSYLDDFNNGTAKEWTVNGKKAGLVRKGGKGAGNVAFAQVYAAGHMVPYDQPEVASDMINRWLANKPLA

SEQ ID NO: 10738 - protein, 348 aa, Listeria monocytogenes str. 4b F2365
MKALKLYGKRDLRYEEADMPTIEQPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGAKRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 10739 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 10740 - protein, 319 aa, Burkholderia pseudomallei K96243
MNVATPPSMPATGGPLIDRARVDAHLAPAAREWSIEIVDTTGSTNADLGARLKALPRRRDALAAPIARVAYEQTAGRGRQGRPWFAKPGDALLCSVACVLPRPVGALAGLSLAVGAALAEAFAARPAATGDAPRGGADGARRIALKWPNDLLVATERDGETAIVGKLAGVLIETVWNTIDATAVVIGFGVNVRTADAAAAEVDALRARDATLAGGLPPVALAAVRAGATLTDTFAAALNALAVALPAFAADGLAPFAARWHALHAYAGREVVLLERGAELARGVAVGIDETGQLLLDTPAGRQAIAAGDVSLRTPGAAR

SEQ ID NO: 10741 - protein, 96 aa, Oryza sativa
DLDDFGWDTREQIISVQIGQKFSKPQSEDLYYSRARSMLQKLGLEKYEKNFKKGLLTDQTLPLLTDSALRDVKIPPGPRLLILDQIKRDPEFGKAR

SEQ ID NO: 10742 - protein, 435 aa, Nicotiana tabacum
MLINGFIYLKDWANAFAIFEDVIRDGLKPDVVLYNNIIRAFCGMGNMDRALRIVEQMKKERHRPTSRTFMPIIHAFAKAGAIRKALDVFDMMRRSGCIPTVQTYNALILGLVEKRQMDKAVEVVDEMLLAGIRPNERTYTTIMDGYASLGDTGKAFEYFSRIKDEGLELDVYTYEALLKACCKSGRIESALAVTKEMNAKNIPRNTFVYNILIDGWARRSDVWEAADLMQQMRQEGVQPDIHTYTSFVNACCKAGDMQKAMNTIQEMKRVGLNPMLKPIPLSYTVGHASLPEKALKCFEEMKKSGLKPDKAVYHCLMTSLLSRATVAEDYIITGIHRVCEEMVESGLTVDMGTAVHWSRCLRKIERTGGDITEALQKTFPPDWNSHRNLNAASYDTGNNEGLNDRVTTMVLCMRLTVTATVTMIQMPPRCNQKVA

SEQ ID NO: 10743 - protein, 239 aa, Picrophilus torridus DSM 9790
MKFSRKYGQVFLKNLNIAKIEVNLLNLSPGERVLEIGPGHGILTSIIMEKNVNLTVVEPDHRFYNEIILRFPGLNAIKNSFLDLNPGAYDKIIGNIPYNISSQIIFKLYDFDFKLALLMVQREFAERLVASPGNKNYSRLSASSKLRFDIKKVMDVSRKNFYPVPEVDSSIIIIKKNNKKIPCNPDDIIKMAFSMKRKKISSIFKNYDGPLKYKRPGDLSPEDFIDLCCYLFPERCQGS

SEQ ID NO: 10744 - protein, 400 aa, Bdellovibrio bacteriovorus HD100
MIQLSKRAQNLKPSPTLFLVAKAKELAAQGHDVISLTVGEPDWPTFKGASDAGIEAIQKGITKYTPANGTVELRKSISEKLKSELGFEYSPKEITVASGAKYIIFSALQMICSPGDEVVIATPYWVSYPAMVELADGVPHIVECGEMENFKITPEKLEAAINAKTKGFLFCSPSNPTGLQYSADELKALAEVLRKHPQVVIISDDIYNRLVFDGTKVAPHILTVAPDLKDRTVLVNGGSKAYSMTGWRIGWASGPERLITAMADYQSQSTGSPSSISQHALLAAIKTSEADIKGVVDKLVARKNSGLKELETVPGFKTAEPQGAFYFWVDIRAHLGKSYQDRVIRTSKDFCDVLLEKFFVATVPGAECGTEGFMRLSFAVSEETMKRGVARMKDLVSQLV

SEQ ID NO: 10745 - protein, 272 aa, Xylella fastidiosa Ann-1
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATALLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 10746 - protein, 272 aa, Vibrio cholerae O1 biovar eltor str. N16961
MEQRSIAFIGAGNMARAIIAGLIASGYAADKIIATAPSLTRREPLEAQYGIRTTSDNLAAAQQADVVVLAVKPQLMAEVCKPLQAVDFSGKLVISIAAGVSVKRLNEMLATQLNLVRVMPNTPSLVNLGMSGLYAPDSVSEADKAFTTQLMQSVGEVCWVDNESGINSVIAAAGSAPAYFFLFMQAMQQEAMAQGFDEATARLLVQQSALGAAAMVKANPELSLATLREQVTSKGGTTAQAIQTFNDHQLSDIVAKAMQAAVTRAQEMEQLF

SEQ ID NO: 10747 - protein, 182 aa, Arabidopsis thaliana
  misc_feature (102)..(102): Xaa can be any naturally occurring amino acid
  misc_feature (168)..(168): Xaa can be any naturally occurring amino acid
  unsure (1)..(182): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELXHGFVYREHGNTPGYYDGRYWTMWKLPLFGCTDSAQVLKEVEECKKEYPGAFIRIIGFATPASPMHXFIAYKPQAPSLISF

SEQ ID NO: 10748 - protein, 384 aa, Xanthomonas oryzae pv. oryzae KACC10331
MMTSHGMPPVCCRPPTRRRASCGAPMQRHARCPGDQSSMQGAPLLHMPPPAHLSAHAFSRTAAVDDRALLAKLASGRLSGDALARDAGLTRAAVWKRIQNLRAAGVDIEGRAGDGYRLATPLDLLDAACIRAGMAPDAAAGLAALDVAWTLESSNTTLLAQSAPEQGVAVLLAERQTGGRGRRGRQWTSPLGAHIYLSASRRFSGGLGQLAGLSLAVGVAVAEALRGCGFADVGLKWPNDLLARERKLGGLLIEGGGEMTGNARAVIGLGLNVHMPAAAAASIDQPWIDLDTLAGRPVSRDQVVAAVLSALLPALDLFEAQGLVPFLGRYADLDVLSGRAVQVEEAGTRHRGVALGLAADGALRVRLGDTVRLFHCGEVSVRPA

SEQ ID NO: 10749 - protein, 136 aa, Arabidopsis thaliana
MGCIGVVNVTSINPYLTRRSNKPYNSRRPSSMAAAIRAESMATEKLGITIEKNPPESKLTQLGVRSWPKWGCPPSKFPWTYSAKETCYLLQGKVKVYPNGSDEGVEIEAGDFVVFPKGMSCTWDVSVAVDKHYQFE

SEQ ID NO: 10750 - protein, 317 aa, Arabidopsis thaliana
MAEEIPATASFTPYVHSQTLTSHNRAVSSVKFSSDGRLLASASADKTIRTYTINTINDPIAEPVQEFTGHENGISDVAFSSDARFIVSASDDKTLKLWDVETGSLIKTLIGHTNYAFCVNFNPQSNMIVSGSFDETVRIWDVTTGKCLKVLPAHSDPVTAVDFNRDGSLIVSSSYDGLCRIWDSGTGHCVKTLIDDENPPVSFVRFSPNGKFILVGTLDNTLRLWNISSAKFLKTYTGHVNAQYCISSAFSVTNGKRIVSGSEDNCVHMWELNSKKLLQKLEGHTETVMNVACHPTENLIASGSLDKTVRIWTQKKE

SEQ ID NO: 10751 - protein, 589 aa, Shewanella oneidensis MR-1
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALIGFVLVGKYLLPRVLKLVASSGVREVLTAFALLLVMGSAQLMEWLGLSAGMGAFLAGIMLANSSYRHQLETDIEPFKGLLLGLFFMAVGMSMDLKLFLTDPLLILAILLGMLLIKTLVLMLLGRVRHHTWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRQYGGEVYFGDARRLDMLMSAGIARSRLLLLAVDSVEDSIEIAQQVKTHFPHINIIARARDRNHAYRLMSLGVTDVFRETFGSALSASEKILQGLGLSQVQANERVKIFAEHDKKLVIASAAHQNDLAKLIDLSNKGKAELESLMRGDRENVS

SEQ ID NO: 10752 - protein, 296 aa, Glycine max
MAEATKGYAVVTGANKGIGFAICKQLASNGITVVLTARDEKRGLQAVEKLQELGLSGHVGFHQLDVTDPAGIRSLADFIRNKFGKLDILVNNAGIPGAQLDGEALAAAGIMENAGRIDWSKIVTDTYELAEAGVKTNYYGAKELTKALIPLLQFSDSPKIVNVSSSMGRLEHIPNGWPKEVLSDVENLTEEKIDDILNEFLKDFKEGSLETKGWPLAMPAYSVSKAALNAFTRILAKNYPSFYINALCPGYVKTDINSNTGFLTPDEGAEAAVRLALLPDGSPSGQFFFRGEEKPF

SEQ ID NO: 10753 - protein, 320 aa, Zea mays
ARGGSVVRERNAMLPTISSKDWIDIDFGIAEGVDFIAVSFVKSAEVINHLKSYIAARSRGSDIGVIAKIESIDALKNLEEIIRASDGVMVARGDLGAQIPLEQVPSIQQRIVRMCRQLNKPVIVASQLLESMIEYPTPTRAEVADVSEAVRQRADALMLSGESAMGRYPEKALSVLRSVSLRIERWWREEKRQEALELQGVSSSFSDKISEEICNSAAKMANNLGVDAVFVYTKDGYMGSLLSRCRPDCPIFAFTSSTSVRRRLNLQWGLIPFRLSESDDMESNLNRTFSLLKARGMVQSGDLVIALSDMLQSIQVVNVP

SEQ ID NO: 10754 - protein, 475 aa, Bartonella henselae str. Houston-1
MLNDANNELKRNLQNRHIQMIALGGVIGTGLFYGSKEAIQLAGPSAILAYLIGGLIIYFIMRMLGEMSVEEPSSGAFSFFAYKYWGRLAGFITGWNYWFLYILVSMTELTVIGFYLDHWILIDHWKSSFIVLLLITLVNLFNVRFYGEFEFACALIKVAAVISMIIFGIFLIVTGVGGNQASIHYLWCHGGFFSYGAIGVVLATSVVMFSFGGTELIGIAAGETSNPQKTIPVAIRQVMWRIIIFYIGSISVIMIISPWNMIEKNSSPFVTIFETLGIPAAGHILNFVVIMAAISVYNSGIYSNGRMLYSLAIQKNAPYIFSKLSTARVPYIAILFSSFCTAIIVVINALVPDNSFMRIMALATAAAVITWAIIIIVHLKFRKAHKNKKEDFMYAFGLYPYANYLCLCFLALLFCIMFVSGFGKNGLMTRLFDMIGIKMSFLETYIPMQMPDMSLAVVIIPLWCLFLFLGYKLKR

SEQ ID NO: 10755 - protein, 359 aa, Pisum sativum
MSHFKSKYHDELIANAAYIGTPGKGILAADESTGTIGKRLSSINVENVESNRQALRELLFTASWLFLQYLSGVILFEETLYQKTAAGKPFVDVLNEAGVLPGIKVDKGTVELAGTDGETTTQGLDGLGARCRKYYEAGARFAKWRAVLKIGANEPSEHSIHENAYGLARYAVICQENGLVPIVEPEILVDGSHDILKCAAITERVLAATYKALSDHHVILEGTLLKPNMVTPGSDAPKVAPEVIAEHTVRALQRTVPAAVPAVVFLSGGQSEEEASVNLNAINQIKGKKPWTLSFSFGRALQQSTLKAWGGKTENVKAAQDALLTRAKANSEATLGTYKGASNLGAGASESLHVKDYKY

SEQ ID NO: 10756 - protein, 556 aa, Bacillus clausii KSM-K16
MEWWRTSTVYQIYPKSFNDTTGNGIGDLQGIIEKLDYLKELGIDVIWLTPIYASPQNDNGYDISDYYAIHEDYGTMADFEELLNETHKRGMKLIMDLVVNHTSTEHQWFKNAKLSKQAKYRDFYIWKEGKEGGAPTNWQSKFGGSAWEYNEATDDYYLHLFDVTQADLNWENEQLRKHVYEMMHFWFNKGIDGFRLDVINLISKDQRFPDDDGSVAPGDGRKFYTDGPRVHEYLQEMNREVLAKYDSLTVGEMSSTTIEDCIRYSNPKQRELSMTFNFHHLKVDYPNGEKWAVADFDFKALKQILSEWQVRMHEGGGWNALFWCNHDQPRVVSRYGDEDEYHNQSAKMLAATIHFMQGTPYVYQGEEFGMTNPNFTSIDDYRDVESLNVYARLKEEGVPEEHILAILKQKSRDNSRTPVQWDSSEQAGFTTGTPWIKVSSNYKEINAKKALSDPNSIFYFYQKLIALRKKLPIVTTGDYRLLVPEHDHVFAYVRTDGTEKLLVVSNFYPVNCDFECPEDLVSLKATQLISNYNQKRKLEKTFSLKPYETVAFQLKE

SEQ ID NO: 10757 - protein, 357 aa, Pisum sativum
MSAFVGKYADELIKNAKYIATPGKGILAADESTGTIGKRLASINVENIEANRQALRELLFTSPNALQYLSGVILFEETLYQKSSEGKPFVEILQENNVIPGIKVDKGVVELAGTDGETTTQGFDSLGARCQQYYKAGARFAKWRAVLKIGPNEPSELSIQQNAQGLARYAIICQENGLVLFVEPEILTDGSHDIAKCAAVTETVLAACYKALNDQHVLLEGTLLKPNMVTPGSDSPKVSPEVIGEYTVNALRRTVPAAVPGIVFLSGGQSEEQATLNLNAMNKFDVVKPWTLSFSFGRALQQSTLKTWSGKKENVGKAQDVFLARCKANSEATLGKYGGGSGTGLASESLHVKDYKY

SEQ ID NO: 10758 - protein, 824 aa, Arabidopsis thaliana
  misc_feature (302)..(302): Xaa can be any naturally occurring amino acid
  misc_feature (390)..(390): Xaa can be any naturally occurring amino acid
  misc_feature (440)..(440): Xaa can be any naturally occurring amino acid
  misc_feature (468)..(468): Xaa can be any naturally occurring amino acid
  unsure (1)..(824): unsure at all Xaa locations
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYSHPHSMLHPPICHDICTRTRYWLTLTTSVTLVPEIVALKTIAAYRSGLDIDTYVSKEVAENGLVEVLRAGKPVRIGNKGLIDYILTISLEVAVRRDLPLQIHTGFGDKDLDLRLSNPLHLRTLLEDKRYGKCRIVLLHAAYPFSKEASFLSSVYPQVXTNFEIKSFDGSANPHLGLAVIMAAGIDGLRRHLQLPTPIDINPADVAATLNRLPETLSEAVEALDKDKVLHDLLGQKLLVAIKGVRKXRSSIIRRIRMHISNSFTDTNPLSISMMIVGSFGFIVDFVSHEGSYLQNTXHKDVVQKINKLNFIFRDACSCRTTIWIXQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 10759 - protein, 505 aa, Gibberella zeae PH-1
MAHELPFKIPTLQVKQQAPSQVQPLTSSVILPSNSLTTLTTPDPGTNKPWAKVKDNSADDVDHTVQVAYDAFQTFKKTSPRLRAQWLLKWDALIREHKADLATLLVYETGKPYAEAIGEMDYSLTFTSWFAGEAERIQGTCFMPSAPNRRVFTIKQPLGVAVALVPWNFPVAMVLRKAAAALAAGCTMVVKPSPETPVTAMALAKLASEAGFPNGVLNILPTSLDNTPSLSEALCKHDLVKKVTFTGSTRVGTLVANLCSLGLKKVVLELGGNCPCLIFNDADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKMSGYGKEAGKDVAVNEYMIQKTGTITVDGLV

SEQ ID NO: 10760 - protein, 509 aa, Bacillus sp.
MSQWWKEAVVYQIYPRSFYDSNGDGFGDLQGVIQKLDYIKRLGADVIWLCPVFDSPQDDNGYDISDYRSIYEKFGTNDDMFQLIDEVHKRGMKIIMDLVVNHSSDEHAWFAESRKSKDNPYRDYYFWKDPKADGSEPNNWGAIFSGPAWSAMSTAQYYLHYFSKKQPDLNWENEAVRREVYDLMTFWMDRGVDGWRMDVIGSISKFVDFPDYETDDSRPYVVGRYHSNGPRLHEFIQEMNREVLSRYDCMTVGEAGGSDVEEAKKYTDPSRHELNMIFTFEHMDIDTKQHSPNGKWQMKPFDPIALKKTMTRWQTALMNVGWNTLYFENHDQPRVISAGAMTRELRKQSRQSISNSSARHEGNPFIYQGEEIGMTNSEMPLEMYDDLEIKNAYRELVIENKTMTEEDFRKAVAKKGRDHARTPMQWDDGKYAGFTDGEAWLAVNPRYQEINVKESLADEDSIFYYYQKLIGLRKQNKVIVYGDYRLLLEEDPRIFAYIREYRGEKLLVP

SEQ ID NO: 10761 - protein, 317 aa, Porphyromonas gingivalis W83
MKIVIADSYAALPGDLDWSGIEEMGECVFYEYTRPEDLTLRAVDAEIVLTNKTPVTAADMEKMPHLRYIGLMITGLNLIDMDAARQRGITITNIPHYSTESVAQMAISHLLHITMPIGELSRQVKDGCWQSNYEQISRNTYQIELSGLTMAIVGLGAIGTRVAEMARGFGMKILAHTSKSPIELPSYIEKSDSLEKLFSRADVLSLHCPLTAQTQRMVSADRLALMKPTAILLNMSRGSLIDEKALASALNEGRLYAAGLDVLAEEPPCMDHPLLKARNCHITPHMGWNTDAARLRLSRTIKENLRAFISGHPVNVV

SEQ ID NO: 10762 - protein, 188 aa, Arabidopsis thaliana
  misc_feature (68)..(68): Xaa can be any naturally occurring amino acid
  misc_feature (86)..(86): Xaa can be any naturally occurring amino acid
  unsure (1)..(188): unsure at all Xaa locations
MASSMLSSAAVVTSPAQATMVAPFTGLKSSAAFPVTRKTNKDIISIASNGGRVSCMRVWPPIGKKKFXPLSYLPDLSDVELAKEVXDYLLRNKWIPCVEFELEHGFVYREHGNTPGYYDGRYWTMWKLPLFGCTDSAQVLKEVEECKKEYPGAFHLGSSIRQHPLKSQCIPVSICPTKPPPKAFHPKA

SEQ ID NO: 10763 - protein, 439 aa, Rubrobacter xylanophilus DSM 9941
MSGLQEARLRLARDRSARLMERAVRRMPGGVNSPVRAFRSVGGDPLFMERGEGPRIFDADGNAYIDYVMSYGPLLLGHAPPEVVGAVERAARRGTTFGAPTRLEVELAELVCEAVPSVEVVRMVNSGTEATMSAVRLARGYTGREKILKFDGNYHGHGDALLVSAGSGVATLGLPDSPGVTPGAARDTAVLPYNDLEAVRELFEERGEEFAAVILEPVAGNMGCIPPEEGFLEGLREITAACGALLIFDEVMTGFRVSRGGAQERYGVVPDLTCLGKVIGGGLPVGAYGGRREIMERVAPAGPVYQAGTLSGNPLAMSAGLATLRRTGEPGFYERLEELGARWERGMREAASGSAVPVTVNRVGSMVSLFFASGPVRDFASAAASDAELFKDFFWHMLSRGVYLAPSQYEAGFISLAHSEEEIDRTVEAAAEWFAGRRA

SEQ ID NO: 10764 - protein, 147 aa, Listeria monocytogenes
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAQREIQLFFAPDEILSYQKAVDTWI

SEQ ID NO: 10765 - protein, 274 aa, Bdellovibrio bacteriovorus HD100
MSYSRERLQRAQEAMGIAAKKSLGQNFLVSDTVINRIIDQVKAFAPEELVEVGPGPGALTDLLLELNLPLQLIELDSAIAAYWREKGLTVIEQDALRLDWKQFYTGKRVVFVSNLPYQISSSIVIERSLENEGVAAMVLMFQKEVAQKIRGTVDSDLYGLLSVYAQAFWKIETVTDAGPRDFQPPPKVASRVLSFERIESEVKNRKAFLTFVKCAFAQRRKLLKKNLSGLLSQKKLTEEQMVGWLAELGFKETARAEELSPKQFVALYKHFGFE

SEQ ID NO: 10766 - protein, 639 aa, Escherichia coli
MSQPIFNDKQFQEALSRQWQRYGLNSAAEMTPRQWWLAVSEALAEMLRAQPFAKPVANQRHVNYTSMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWTLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINETNTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKHANKVRLAEFVKVRTGIDINPQAIFDIQIKRLHEYKRQHLNLLRILALYKEIRQNPQADRVPRVFLFGAKAAPGYYLAKNIIFAINKVADVINNDPLVGDKLKVVFLPDYCVSAAEKLIPAADISEQISTAGKEA

SEQ ID NO: 10767 - protein, 157 aa, Oryza sativa
MQASRARLFKEYKEVQREKSADPDIQLICDDSNIFKWTALIKGPSETPFEGGVFQLAFSIPEQYPLLPPQVRFLTKIFHPNVHFKTGEICLDILKNAWSPAWTLQSVCRAIIALMAHPEPDSPLNCDSGNLLRSGDIRGYQSMARMYTRLAAMPKKG

SEQ ID NO: 10768 - protein, 227 aa, Zea mays
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQV

SEQ ID NO: 10769 - protein, 253 aa, Brassica napus
  misc_feature (50)..(50): Xaa can be any naturally occurring amino acid
  misc_feature (58)..(58): Xaa can be any naturally occurring amino acid
  unsure (1)..(253): unsure at all Xaa locations
NHREYQDLQRLYSEIGHPPSDAFLFLRSYPNRRKQNPPTRFLRLTHKLRXTSTDFILXGNHHHSTIIRIFGYYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 10770 - protein, 510 aa, Arabidopsis thaliana
MEMLNAIILILFPIIGFVLIFSFPTKTLKAKTASPSNPTSYQLIGSILSFNKNRHRLLQWYTDLLRLSPSQTITVDLLFGRRTIITANPENVEHILKTNFYNFPKGKPFTDLLGDLLGGGIFNSDGELWSSQRKLASHEFTMRSLREFTFEILREEVQNRLIPVLSSAVDCGETVDFQEVLKRFAFDVVCKVSLGWDPDCLDLTRPVPELVKAFDVAAEISARRATEPVYAVWKVKRFLNVGSEKRLREAIKTVHLSVSEIIRAKKKSLDIGGDVSDKQDLLSRFLAAGHGEEAVRDSVISFIMAGRDTTSAAMTWLFWLLSQNDDVETKILDELRNKGSLGLGFEDLREMSYTKACLCEAMRLYPPVAWDSKHAANDDILPDGTPLKKGDKVTYFPYGMGRMEKVWGKDWDEFKPNRWFEEEPSYGTKPVLKSVSSFKFPVFQAGPRVCIGKEMAFTQMKDVVGSVLSRFKIIPVCNNRPVFVPLLTAHMAGGLKVKIKRREQCDSMYI

SEQ ID NO: 10771 - protein, 113 aa, Vibrio angustum S14
MKKITINDLMKWKQEGRKFASVTAYDASFAQLFEQQEMPVLLVGDSLGMVLQGREDTLPVTVEEIAYHTRSVRAGSPNALLMADMPFMSYATPEQACENAAKLMRAGANMVKL

SEQ ID NO: 10772 - protein, 413 aa, Methanosarcina barkeri str. fusaro
MSKYIHELRDPIYNFIHYNTEERKAINSKPIQRLRYIHQLALTYLVYPGATHKRFEHSLGVMELASRVYDIVTDPNNILDDSIRNIVPKSAFELQYWRRALRMAALFHDTGHLPFSHAAERELLPDDWNHEKITAEIIRSEEMIQIWNDLKIQTEDVVKLAVGPRYYKNYNFTYWEAILSEIIVSDALGVDRMDYLLRDSHHTGVAYGKFDHYRLIETMRILPKYYNYGSKEPALGIENGGLHAVEAMLLARYFMYTQLYFHPVRRIYDIHLRDFLKTWLQNEVFPIEVENHLQVTDNEVFVGLFNVARDQNHKGHEYAKRIVNRNHFRLLYDRKQEDISKNLEAQKAIYNDLKKKFGENNVIYDTEKQRGGDSNFPVYLNNRRIVSALSISDVLPKIPIAAIDSIYINPNCL

SEQ ID NO: 10773 - protein, 477 aa, Oryza sativa
MALVTPLPTTTTTTTTAAAAAIKQPHYYGCFDRCSTKQVFDNLHGNISLDPLAREFVDTEEFQRLRDLKQLVPKLANRPFRSSNLFDCVIPVPKLADHSFRSSNLFSCITPVPKQDGLKTLYQKGEELGIDRVDMQTVKLAGLLHDIGHGPFSHLFEHEFLPRVVPGSTWTHENMSALLLDSIVDKHQIDIEADHLKIVMEMIVASSKFTATEVCTLVCITALVICQLKIDVLKFDAMKLVSSQSTKEKRFLYDIVANGRNGIDVDKLLQGMRVMGDEICYPAKDYLSIHKLFTTRADLHRTVYTHAKVKAVELMLVDALVEANEYLGIALHAQDPADFWKLDDTIIKSIETAPNDELNKAKGIIQRIRRRELYKGDISDSDLLLLLVCISTIPSIKFFKEFLLSQDFGCDEKFPITDERVSHLLPAYNQDRIVRVYAKKHELVEAVSEAFENLQLRMYGEKTQVHDTPRKKRIRFH

SEQ ID NO: 10774 - protein, 400 aa, Zymomonas mobilis subsp. mobilis ZM4
MVHISAALSRIQPSPTIAVTSRVIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITPKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQGAFYVYPGISELIGKKTPSGKVIEKDLDFSSYLIDEAKVAVVHGEAFGLSPAFRISYATSTELLKKALERISDAVARLK

SEQ ID NO: 10775 - protein, 342 aa, Mesorhizobium loti MAFF303099
MMSERLEDIAAAIVANGKGLLAADESSGTIKKRFDVIGVESTADSRRDYREMMFRARDAMTKYISGVILYDETIRQKAADGTPLVDIIKASGAIPGIKVDAGAKPLAGFPGDTVTEGLDGLRERLADYYKLGARFAKWRAVIDIDTGKGVPSANSINSNTHALARYAALCQEAGIVPIVEPEVLMDGAHDIGTCYDVSKATLIKLYDELHAARVVLEGTILKPNMVLSGKKSGTVDSPEKVAEMTIKLFRETVPAAVPGIAFLSGGQEDEEATANLNAINAIGPHPWKLTFSYGRALQAAPQKAWSGKASNVAAGQAAFTHRAHMNYLAALGKWKASLEQAA

SEQ ID NO: 10776 - protein, 128 aa, Saccharomyces cerevisiae
MNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 10777 - protein, 559 aa, Magnaporthe grisea 70-15
MNRIALWTVASFLLVPFTAHACLQTWHILAGTSSPTGKWRSRATYILSGLLLKVQYDLFVKLTLELRARRLGCLPAKLYPHKDPVLGLDYFFKALRAAGAGQFFPFARENLKTIGHTHYAMALGTWVLHTDEPENIKSILATDFDSWEIAGPRLLPVLDVLGPKSIFTSNGEGWHQARSMLRPSFVRDQVADLACFDRHISHLLKKIRSSCQEGMVAFDLQKLFFLMTMDSSTDFLLGRSTDLLVKASPEAEDFLRAFDYVLFQGAKMARLGPIMMKLPHRKFDAEVQTVRSFVRKYVSKAMAEKGYQKERSYLFLHELVASGASVEYITDQVLSIILAGRDTTAAALAAAFYFLSKSPDIVDKLRQEMLEMGEENPDWETLRGMKYLQNVIKEGKFSQKIWSWDETTLLLTPSRVFPALRLAPPVATNSRTSCKETTLPRGGGPDGKSPVLIPKGTSCRWSNYSAYRRADIYGPDADEFRPERWEDLRVAWEYTPFSGGPRICIGQQFALTQMSLAIFRILQNFDKIKSKNEGPMGMRAGVTVSLADPGCLVSMTPIA

SEQ ID NO: 10778 - protein, 67 aa, Brassica napus
MQNLSSAGVTVVEEAVNCPSISKLACQYASIFRSFLEKSRLPVWNMSKSCGFWRQLTVCVLQDTLLC

SEQ ID NO: 10779 - protein, 242 aa, Synechocystis sp. PCC 6803
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 10780 - protein, 512 aa, Triticum aestivum
MDSLYWFVELLSVLCFFVFYYRHLQSKKISKAEPTEWPILGHLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTVNLLLAGRDTTGAALSWFFYLLSKNPSVEQRILDELAPIASRKKKLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 10781 - protein, 227 aa, Thermus thermophilus HB27
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERAAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 10782 - protein, 503 aa, Arabidopsis thaliana
MAIVIGLLEIFTAFVFFIFFQCLLLHKKTPKPLLTNWPALGMLPGLLLQVPRIYDWITEVLEATDMTFCFKGPCLSGMDILLTVDPVNIHYILSSNFANYPKGMEFKKIFEVVGDSIFNVDSGLWEDMRNSSHAIFSNQDFQMFWVSTSVRKLRQGLVPILENAADKNILVDLQDLFQRFLFDTSLILMTGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKPDVLPSGHRVDEKWKIVISMYALGRMKSVWGDDAEDFRPERWISDSGRLKHEPSYKFLAFNAGPRACLGKKLTFLQMKTVAAEIIRNYDIKVVEGHKTEPVPSVLFRMQHGLKVNITRI

SEQ ID NO: 10783 - protein, 370 aa, Rhodopseudomonas palustris CGA009
MDIRAAVFREVGAALRVERIVLDPPQPTEVLVRLAAIGLCRTDYHVMRGERRVAMQPMVLGHEAAGIVEAIGDQVQGVAPGDHVVLTFIPGCGHCRWCQRGLHHLCAEGPRITHGPQLDGSFRRRDAGGRDVGAFCMIGAFAEATVVDQASVLVIDKDIPLDHASLIACGVPAGVGAARHRARVKPGDTVLVVGCGGDGMNVVQGAKLCGASMIIAADIVAQKLEWARDFGATHGTTAQGDELISTVLALTDGIGVDHAFVCINPAETLLPAFRATTKAGNVVVTAITPDTVKQIDVPPLELFATQKAIMGAVYGFASPRLQIPELLGLYRRGDLKLGELISRTYRLDEINQGYADLDAGRNLRGVVLID

SEQ ID NO: 10784 - protein, 519 aa, Rickettsiella grylli
MTMSQQNPSPLLLLILDGWGFNEKKDHNAIAMAHTPHWDHLLETCPHTLLDASGQAVGLPVGQMGNSEVGHLTLGAGRIIHQDLTRINNAIETRAFFKNSCLLAGFKKILSNHQSVHLIGLLSSGGVHSHENHWTALLELAAQQGIISCYLHPFLDGRDTPPQSAKIFLKRLEAKCTQLGIGKIASLMGRYYAMDRDKRWQRTKIAYDCLTLGKTNYQATNALQALQFAYDRGETDEFVSPTRITEINPSHLTINDGDLVIFMNFRADRARQLSHAFLDKSFNAFHRQLHPRLAGFISLTEYATTLPSQVAFPQQNLRNSLGDYLAQHHLSQLRIAETEKYAHVTFFFNGGNETPLINETRVLIPSKKVSTYDRVPDMSALEITHHLLKVIKEKKYDVIICNFANPDMLGHTGNLPATLHAIQCIDDCIGKITHCLKQYGGEALITADHGNAECMFDENTQQAHTAHTNKPVPFIYVGRPAKINPIKHPSLANIAPTLLYVLNLPKPQEMTGQSLLTLI

SEQ ID NO: 10785 - protein, 366 aa, Cupriavidus necator
MTAMMKAAVFVEPGRIELADKPIPDIGPNDALVRITTTTICGTDVHILKGEYPVAKGLTVGHEPVGIIEKLGSAVTGYREGQRVIAGAICPNFNSYAAQDGVASQDGSYLMASGQCGCHGYKATAGWRFGNMIDGTQAEYVLVPDAQANLTPIPDGLTDEQVLMCPDIMSTGFKGAENANIRIGHTVAVFAQGPIGLCATAGARLCGATTIIAIDGNDHRLEIARKMGADVVLNFRNCDVVDEVMKLTGGRGVDASIEALGTQATFEQSLRVLKPGGTLSSLGVYSSDLTIPLSAFAAGLGDHKINTALCPGGKERMRRLINVIESGRVDLGALVTHQYRLDDIVAAYDLFANQRDGVLKIAIKPH

SEQ ID NO: 10786 - protein, 397 aa, Streptococcus agalactiae 2603V/R
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 10787 - protein, 837 aa, Shewanella oneidensis MR-1
MSHDSELSPNTSGVTPKKRATIAVESLKAVAHDPCEPCDALPASFTRHVRYGLSRGEGARGELFQALALSVKEQMLDDWRETRIKDSHYDNKQVAYLSLEFLMGRTLGNALLSLDLEQDSREALSHYSVSLEELEEAEHDAGLGNGGLGRLAACFLDSCASLDLSVTGYGIRYEYGMFAQKIVDGYQVERPDRWLREGNPWEVRVPHHNVTVHFFGHTESYVDKQGRRHVIWVDTQDVLAVAYDMPVPGYRNGRINTLRLWKAEATDDFDLAEFNQGDYTEAVARKNLAEQITMVLYPNDASENGKELRLRQQYFLSSASLQAILKRWVHHHGHDFTQFAAKNVMQLNDTHPSIAVPELMRLLVDEYALEWDAAWAITRQTMAYTNHTLLPEALERWPVRMMALMLPRILEIIYEINARYLDLVAHHWPGDADKLASMSIIQEGPDPHVRMAYLAIVASFSVNGVAGLHTQLLKSGLFKDFYSLWPQKFNNRTNGVTPRRWLAHCNPALAKLLSSHLGQSWVTDLSQLMALNALTQDASFIQQWREVKQGNKVLLANMIAKECGVEFDPSMLFDVQVKRIHEYKRQLLNILHVIHLYHQIQQGHTEHLVPRCVLIGGKAAPGYFMAKLIIKLASNVAHMVNSDPVVAPYLRFAFLPNYNVSAMEKICPGTDVSEQISTAGKEASGTGNMKFMMNGALTIGTLDGANIEMLEEVGEESFFLFGLNAEQVAAMRSNYQPKRIIAQSHALSEVMALLKSGHFNLLEPGIFDPIITSIESSDDQWMTAADFDSYRLAQEAVANTYKDQQKWTQMSIRNTAASGRFSSDVTIAGYRDEIWKL

SEQ ID NO: 10788 - protein, 478 aa, Pseudomonas fluorescens Pf-5
MSLQEQQTDLRGGFKQEMQTRHIVMLALGGVIGTGLFLTSGYTVNQAGPLGAVIAYIIGALMVYLVMMCLGELAVQMPETGSFSTYATRFLGPGTGYTVAWLYWLTWTVAIGSEFTAAGILMARWFPETPVWIWSALFAMVVFLSNVVSVRLFAETEFWLSLVKVITVLAFLVVGGGAILGLLHIDQAHSIGLSNFTREGLFPTGFMPIAMTLLAVAFAFSGTELIGIAAGETRDPQRNVPRAIRTTVLRLAIFFVGTIFVLATLLPREQAGLVESPFVTVFTYIGIPYSADIMNFVIISALLSAANSGLYAASRMLWTLSDQGHLPKQFSALTRMGTPLNAIIVSMAGGAASLLSSVFAPDTIYLALVSISGLAVVVVWMSIAASQIAFRRHFVANGGDVRDLKFRVRGYPWVPLGALLCCALACVGIGFDPEQRVALYFGLPFIAWCYLVYYITRSSRQRRLSLAALARPSDALQG

SEQ ID NO: 10789 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTSGFHGAELADIQMGSSVVVIGIGAVGLMGIAGAKLRGAGRIIGVGSRPICVEAAKFYGATDILNYKNGHIVDQVMKLTNGEGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 10790 - protein, 590 aa, Zymomonas mobilis
MNSSLFSDSLVILGAAGLIIPAFARFRISPVIGFILAGAVLGPKALGSLVTEYPWLKHITISDPDGIEPFADFGIVLMLFSIGIELSFKRLWAMRQAVFGLGTGKLLGCGFLIGAGLYALGENWAGAIGMGTGSQRIVNRFGAASSGNNGTCRKKPFAILLFEDLALVPIIFALVPWHLMGKIIAGTDLIATIWQGGATVIAILVLGRFALPTLFAQAARTKSAEVFLSISLLVVILASVATSAMGLSPIVGALTAGLLIAETDYHVEVEMVILPFQRLALGVFLLTVGMSLDLRLIMANWQALALGVAGVVLVKTLVTSTLLRLSHVRLATAVESCLLMSAPSETTLVILATARQAQLIMPSTAAFWEIVTAIGLTITPHLAKISHKVSLKLTLREHNLTLPSNEEPIEDIQNHTIVAGIGRVGKVIADVLTSEKKPYLAIDSDIDLVINAKRDGYHATFGDISNPVFIQQLGNKINAVVLAINDPVSMVNVVHRLHTIYPDLTIIARASDSRHAAQLFRAGATDIVAETLESSLRLAEATLISLGVSTGHAVAAIHDKRASMRENVLKAAEEGNMQAIRHTPSIMPEA

SEQ ID NO: 10791 - protein, 574 aa, Magnaporthe grisea 70-15
MSRRPPNPAAERAAQNQATIKSLLKLETNKICADCKRNKHPRWASWNLGVFICIRCSGIHRGMGTHISRVKSVDLDSWTDEQLQSVLSWGNARANKYWESKLAAGHAPSEAKIENFIRTKYELKRWVMDGPMPDPATLDAEADDDIPLSLVKEKQSIDRKESVRKASLGQSSAPTSIRRAPAPPAPEQDLIGGDPIPVRANSAGPAMSKVASKGEPAPPKTTSTKDSLLGLDFLGTETAAPPRPSSTTGTGGAGGQSRPDLKQSILSLYATAPRPQQQAQQGSFGGMNSPPLQQQQQSQGAGAFGGMNDAFSSLSFNTTSSAPKSPPANDAFASLGGLSSSRSPPPQQTSNTSAFSGLGGGSFFDTKPAQTHQQKSSFGSSSGFGGLTSPTATTASAPQAKPAGTSMPASAALGDLFDFSTPAQTSTPKPSAAPAPSSDSVFNLSASTQVKSPPATSNPTSTMGTNNWSNSDVWGANDAWSTPEAAAAPAKSTATTMPSSSSDAFGGWGSSGGGGLASQSIVPGASGGFQPKVAADEEFGGWASSTGTGNASGGTAKPAAGFGGNDDLFSNVWQ

SEQ ID NO: 10792 - protein, 488 aa, Rhodococcus sp. RHA1
MMDVMDAVELMRTVPTTLFLGGEKRDAENGATFTVFDPATGDALTEVADASPADAMKALDAAVAVQREWAATPARERGELLRAVFEKITARADDFALLMTLEMGKALPESAAEVKYGAEFFRWFSEEAVRIAGRYTPAPAGNGRILVTKQPVGPCLAITPWNFPLAMGTRKIGPALAAGCTMIVKPASETPLTMLLLAEVMADAGLPKGVLSVLPTSKSGEVTGPLLDDPRLRKLTFTGSTGVGRMLVEKSAKGLLRTSMELGGNAPFVVFDDADVDKAVAGAVLAKMRNGGEACTAANRFHVANSVREEFTAKLVDKLSSYTLGPGTDPGTTLGPLINADQLEKVGELVQDAVGAGARVRLGGVAPEGPGYFYPATVLDEIPAQARILKEEVFGPVVAIAGFDTEEEGIAAANDTEFGLASYIFTRDLDRALRVADALESGMVGINRGVISDTAAPFGGVKASGFGREGGSEGIEEYLETKYVALEP

SEQ ID NO: 10793 - protein, 335 aa, Symbiobacterium thermophilum IAM 14863
MTSRTAPELLSLLTAAGGGWVSGAEISRRLGVSRTAIWKHIEALRLLGYEIEAAPRKGYRLVARPDLLTPEEVRAGLATRRLGRVVEYRETVGSTNDLAKEMARQGAPEGLLVLAEQQTAGKGRLGRSWTTPPGAAIAMSLVLRPDLPPHAAPRITLAAAVAVTEAVREAAGVAAGIKWPNDVQVNGRKLCGILTEMEAEMDRVAFVVLGIGLNVTLRREQMDPSFRETATSLALEGAPPVRRAALVQAILARFEAVYDELLGDRFDRVLDRWRALSVTLGQAVRALGLDGQPVLEGVAEEVDQEGALLVRDGAGQVHRVVSGEVSLRPAHAQDR

SEQ ID NO: 10794 - protein, 238 aa, Methanosarcina barkeri str. fusaro
MGHLILVRHGEPGLKPEERLAGWVDISLSRKGIEEALQCAAELEKFELDLAFASNLVRTQETLFLILSGQKKTGVVVHESTGKKGNPGKTDWYSYPEKLGKKLIPIYFTPYLNERYYGKLQGRKKQKMEEKYGAEKLASWRWNFQPGPPEGESLKVVYERAVPYFKEKILPAVKAGKNVLICAHQGSLRALVKYIEEISDEDIKEVKFSTGELAIYRYSEGKLIRENAEMSSEIKRNL

SEQ ID NO: 10795 - protein, 473 aa, Synechococcus sp. WH 8102
MAKTPQDVLRQIKDEGIELIDLKFTDLHGKWQHLTVCTDLLEEDSFTEGLAFDGSSIRGWKSINASDMAMVPDASTAWIDPFYRHKTLSMICSIQEPRSGEAYDRCPRALAQRALNHLSSTGLADTAFFGPEPEFFLFDDVRYNSSEGGAFYSVDTIEASWNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMVMAGLDGIKNQIDPGDGEDRDLFELPAEELAKIATVPPSLNGALEALNADRGFLTTGGVFSDDFIDNWIDLKYEEVQQLRQRPHPHEFAMYYDA

SEQ ID NO: 10796 - protein, 394 aa, Nostoc sp. PCC 7120
MARIETRTEPMVLNMGPHHPSMHGVLRLIVTLDGEDVVDCEPVIGYLHRGMEKIAENRTTVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYFLPVIDEYEKLVTNNPIFRRRIEGIGTISREEAINWGLSGPMLRASGVKWDLRKVDHYECYDDFDWDVQWETAGDCLARYTVRMREMRESVKIIKQAIKGLPGGPYENLEAKRLAAGKKSEWDAFDYQYIGKKVSPTFKMPKGEIYARVESGKGELGIYLIGDDNVFPWRWKIRPADFNNLQILPHLLRGMKVADVVVILGSIDVIMGSVDR

SEQ ID NO: 10797 - protein, 328 aa, Gibberella zeae PH-1
MVKHASKATVHQLAKEYSSIIKGKTILTTGVSPGGLGALFVEAIAVAEPELAILAGRNINKLQQTADHLASKHPNLKTKLLTLDLSSLASIRSAAQQVNGWSDVHKIDVLVNNAGIMATDFKLTEDGFENQFASNHLGHFLFTNLIIDKILAAEAPRIVSVSSNGHRLGPIRWGDANFSNGDLYNRWNAYGQSKTANMLFAISLAEKLGSRGLQAYSLHPGAILETSLGDHLANLDSLVEADRAIGDPWGWVDWSTVPVTAEVGAATHVFAAFDPDLKDHNGAYLLDCRLADPFTDTVRPWATSSTEAELLWRLSEKMVGQKFPLKLQ

SEQ ID NO: 10798 - protein, 650 aa, Bdellovibrio bacteriovorus HD100
MSKVTVIKINQMPAVFFVIGLRLKDRSRLVTGFLPGSKPLGTFVSMILHEQLLQILAFLGFSVVLVSLFQKLGLGTILGYLAAGILIGPLGWGLISDFHFVQTIAEFGVVFLLFIIGLELQPKKLWGLRKTLLGFGGLQILVCTVVFTLAGHQLGISWASAAVVGFALSLSSTAFALQSLSERKVLNTEFGRASFAILLMQDVVAIPALAVIPSLGLVTASTREVNWGGALAIFIGLALGSRLLMGRFLQVVAETRSRELFTGVTLLTVIGVAFLMESVGLSMALGAFLAGVLLSESEYRHELEADLEPFKGLLMGLFFVSVGMSVKLSLLVENPGLILGITVGYMVLKGFLIYGVGRVMKLHRPASNNLAVYLVQGGEFAFVIFGVGQSAQVLSPEWTQRFTLVVTLSMIASPIIIVLNEKIQAMIACKRPGAGPQYDQIDEADNGNAVIIAGFGRVGQIFGRILRTQDVKFTAIEHDTEQIDLLRRFGNKVYYGDASRPEILEAAGIKNAKYFVLAVDDVETSNNIARILHEDYPHVKVFARSRNRQHTFDLMAAGVTQVRRETIDSSIALSEQLLVEMGTPAKRAHEIIERFRLHDELMLQEQFKVRHDQKTFIDVSRQAAQQLAQVLKEDAEKTYIDPQHPPEASK

SEQ ID NO: 10799 - protein, 343 aa, Deinococcus radiodurans R1
MTDASFPALPPPLVSLGDLAWDVLAKPDTLLLPGGDTTGRLELSGGGSAANLAVWAARLGAPTTFVGKIGQDRFGELATAELRAEGVRAEVLASAAHPTGVILALIDRRGQRAMLTGQGADWELLPEELPRDVLSSAGHLHLTAWSLFRDPPRAAALEAARIAKAGGATLSLDPGSFQMIQQLGREAFLNIVDALPFDVMFPNDDEARAMSGERDNEAALTWLRARYPRALIALKMDEDGALIEGPQTARVQVPATRDPLVDATGAGDAFGGAFLSQWLRHHDAERAARVAVQVGGWVVSRFGARPPADPDLTRRLASVGADLLTPDPAAAPDPSQDSPEVNA

SEQ ID NO: 10800 - protein, 821 aa, Agrobacterium tumefaciens
MINNLTAADLPRPAPRSSNPEIMAAEIIERLTYRIGKDVKVAKPHDWLTATILVVRDPRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGLRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 10801 - protein, 444 aa, Xylella fastidiosa Ann-1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARSATGRNYIVKFEGCYHGHGDSFLVKGGSGMLTLGIPSSPGVPTELSKLTITLTYNDFDAATALFEEMGHHIATVIVEPVIGNANCIPPRPGYLQHLRTLCTQYGVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 10802 - protein, 499 aa, Gibberella zeae PH-1
MQPQYRAYAQQVAQRSPHATNQRRGGIGPMMSSGPHPSVPLTQAQIAQQQQAQAQASELAKRRSRKPTDKNIPEGVEDSIVDVDGVQRYKDLRDVERRLDATITRKRLDIVDYTSRGSKRYKTLRIWISNTVEDQIWQSNGLNSDSFDFTPSMEASYRVKIEGRLLDNEDEEAEQSTAQDAANEEGKDSNDSASKQKSAEKPRFSHFFKSLTVDFDRSRFRTGNEHTVEWKKPDASARNQPAASLPAAADFDELTFKRNGDENQNITINLFRQESPERYQLSPELADVVDMKDATHQEAVMGLWEYIKLLGLQEDEEKRNFRCNEPLKKVIRQGDIGHIPLLNDYVQQHLRPLEPTRLQYTIRVDQEFHKDPQPTIYDIQVPVEDPLRDSLLPLLNNPQYIAMLKEVTGLDDQLARVVQAIAVSKAKHSFFESLSKDPANFIKHWLSSQKRDLEVIMGEAPRGGGEHASGDEWRRGGKDSVWATENARESVNVLLSKQR

SEQ ID NO: 10803 - protein, 373 aa, Halobacterium sp. NRC-1
MTEFSDRVAQVSISGIRAVFEAAGEDAINLGLGQPDFPTPDHARQAAVDAIESGAADGYTSNRGTAALVDAIVEKHARDQGVDVAPAGVIATAGGSEALHLAMEAHVDPGDEVLFPDPGFVSYDALTRMAGGNPVGLPLRDDLTLAPETVEDHITDDTAAFVVNSPANPTGAVQSPADMRAFARIADEHDVLCISDEVYEHIVFEGEHRSPMEFADTDNVVVVNACSKTYSMTGWRLGWVAASERRAERMLRVHQYVQACASAPAQYAAEAALSGPQGVVDEMVAAFEARRDVLLDGLEAMGLDVPTPGGAFYAMPTVPDGWIDEVVDRGVVVVPGSAFGDHGAGTARISYATDMATLRDAIDVMRAATAAVQ

SEQ ID NO: 10804 - protein, 365 aa, Nocardioides sp. JS614
MQQVKAVIARGKGQPVEVTTINVPDPGPGEALVQVQACGVCHTDLHYREGGINDDFPFLLGHEAAGVVEAVGPDVTAIAPGDFVILNWRAVCGECRACERGEPWYCFATHNATQRMTLAEGPDAGTELAPALGIGAFAEKTLVAAGQCTKVDPSARPAAVGLLGCGVMAGIGAAINTGAVTRGKSVAVIGCGGVGVAAIAGSALAGASPIIAVDIDAQKLEAARRMGATHVVDSSRTDPVAAIQELTGGFGADVVIEAVGRPETWKQAFYARDLAGTVVLVGVPTPEMKVPDLPLIDVFGRGGSLKSSWYGDCLPSRDFPMLVDLYQQGRLDLDAFVSEEIGIGDVEAAFERMHEGGVLRSVVIL

SEQ ID NO: 10805 - protein, 1011 aa, Mycoplasma penetrans HF-2
MKNTLIFLVTEGIGLNKKWKGNYLKLANKPNINYLISGIYPWALLSNDRKRNKYIPKKTYPSVKRDVDSNFYEMLYGETDIKTYLELLDEQIKSKSLHNLEIFNKLIDRSNKTNSKIVHIFSMLSFNENKFNAKNLFYVINVLIKKGLKPVLHLIADGQDERPYSFNKNLSNFSKFLLKRNTPIVTVAGRNHVFGKKGRDFLDNEHVMDYFETICGLGEQAFTEASEYTNENLANKVMDADILPAYNTIMDGYFVSKDDSVLFLNSDPDDFASLARMMKTSPKLKGLFLSSLAPIYGTKLDAVFFENPVKGKEESLLANMVAKNDNKVLVLGLNHKKGFINKFFGENTNNENITRKILSSPACTSDKEYFSLSSKMLIDKTIDSIGKYDVIFVMCPMIAEAARSSDLKQLLSTIETFDQHLGRLINLCRCTGNIIALTSAYGAAEKMLDKHLNIVPHNKSSLVPFVFTNGDLWPKKMQSNFLGVYSSILSTLDSLDTEHKLFYTSLIDPNFTKSKIEESLNDMFLIWKETISDDLIKSFEDNKLNFYSEFSKDEQFLSEKQKYVVLKEIIEVNKKVLLTPEARKKLYNVLIDYVEYNKIDFVGLDINYKKTFQTLFDKEIKMLKLSKLSNKYFDKKIWITNFVRNDEWINSIKFDLLESSKRTFDVDKNEKFSTRVYNEMIPFLFFEKIRKSEVEILKTNDAVSIAQFYELIKEEVRDIFEQYILDKLPVESEDATDEVVEEEKSPEQIATEKAVHSISVYFDYFVEVVDLIRYERDYLESFNRRYKETQEHLAKQNKIYDSTDIFNVPEIALNPLTAKIVSLIRLYKSELKSHAKTEKTENKKTIYKFDMAYSTKIDIAKQSIAYDGEFNEEVNLKKQDEFEKKFAEYVEVYKEFDNTVIEWESDEEKDDEYSMDDETIEYDENGNPIMVDKIDTKIKTRPEYDLTEVWVQKRIDEYNNVDNYKPNIAVDAIKQLDKNKQTSVAKARLRDYSKLSEVWKKTAQSETENNG

SEQ ID NO: 10806 - protein, 116 aa, Oryza sativa
MKPWTATVSLLLAAAVAMAAAVAAGEGGAANYLVFVDPPPSGVVCTAYQLSILAAALGSEEKAKGAIIYNYKNVVSGFSARLTPSELEAVKKQPQVNRVLPSATLSLMSSNFDGIS

SEQ ID NO: 10807 - protein, 294 aa, Escherichia vulneris
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 10808 - protein, 345 aa, Bacillus clausii KSM-K16
MRAIEVRKPGDIHVVEVQKPELETDKDVLVKVQAVGICGSDMHIYHGSNPFTVYPRIIGHEVGGIVEEVGSGVHGLRRGDRVALEPISSCGVCYACKKGRPNVCAKLEVFGVHRDGGMREWMVAPEANWHKVNGDLPFEAAALVEPMTIGAQAAYRGNIEPGDTVFIMGAGPTGIACLIMAKQKGATVFISDLQANRLDYAKQVGADFTIHLPHEKPEAVLFEKTDGEFANVVIDAVGTSTTFAEAVKLASVAGTVVTLGFNETPSDIPSLLLTKKELTVAGSRLQTNQFPDVIRQVNEQKVDPASIISHRFDFDEVKKAIELLEKEPAHVRKAVLIFEREDESK

SEQ ID NO: 10809 - protein, 870 aa, Glycine max
  misc_feature (587)..(587): Xaa can be any naturally occurring amino acid
  unsure (1)..(870): unsure at all Xaa locations
MAEPLSNTELSSSKTLDPTNGHDSTSEPHQTAPEDAQLNREDDVVPTAKRKRDDDVEDRSLHPLWKTSLCSYFRSHNGSCSHGGACRYAHGEEELRPRPDNTWDPTSERAKKALKTESDEKRAVSEEVMMTEAVVDDGDDGCGANHALNICLVHLPRKWSSENLRTFLGEQGIPFKHAKKKKGMMIGFVTFEDEEQLKSSTMELEGKSIGNKTVKVANVLPRSFEKKSNAIVASRQELDEENAGVDVASSGTLDGETNNDNLAKTRNVRDAVTPLAHMAYADQLEQKTSSLMQILKKLTRNARKACPNGVSLPEWILKSREIGGLPCKLEGIIASPIVNGYRNKCEFSVGYSLEGKVTVGFMLGNFREGVTAVEEAVDCPNVSTVACKYATIFQEFLQDSDLPVWNRFKNTGFWRQLTVREGRTNGNVVDAETFSGVAEVMLIVSTASFDDAKVAAEFKRLAQAFVAGATSHCPILPLTALVVQDHQGISNVAPADAPLHSLPIPKAAGDPEVDENNNAKDVRIHDHINNLQFSISPTAFFQVNTLAAEKLYSLAGDWSCLGPDTLLFDICCGTGTIGLTLAHRVGXIGIEMNASAVSDAHRNAEINGIKNVKFICSKAEDVMGSLLREYLNVTREQVDDPNISGSGNDIPKDSACPEPENCEIASRCPENNIAEVGSEVQKGCTCEQADGISEQAEDVMGSLLRGDANVAKEQSDDPNVSGSSNDIPVDDTCPEPENGEITSHSENNNAETSLQQFKNVVAIVDPPRAGLHPTVIKALRTHPGLRRLVYISCNPETLVANAIELCTPSPVKIEKGNKDNRGWRNMSSAGLARHRAKSMPISEAFHPVKAMAVDLFPHTPHCELVMLLER

SEQ ID NO: 10810 - protein, 234 aa, Trichoderma viride
ASKTCPSNTPLSCHNTTVVQDTCCFIPSGQLLQTQFWDTDPSTGPSDSWTIHGLWPDNCDGSFPQTCDASRAYTNITDILTAMGADDTLQYMQTYWKDYQGNDESFWEHEWGKHGTCITTLDPGCYDDYVPTEEAADFFSKTVSLFKTLPTYQWLADAGITPDGSKSYALDDIQSALSQQHGAEVTLGCDGKTLNEVWYHFNVKGSLQDGQFVAAEPDGAKSTCPDDVYYDPKK

SEQ ID NO: 10811 - protein, 499 aa, Triticum aestivum
RHGTALSVSGQRPKPRYEHGATVLQDKMYIFGGNHNGRYLSDLQVLDLKSLTWSKIDAKLQAGTSDSAKTAQVSPCAGHSLISCGNKFFSVAGHTKDPSDSITVKEFDPHTCTWSIVKTYGKPPVSRGGQSVTLVGTTLVVFGGEDAKRCLLNDLHILDLETMTWDDVDAIGTPPAPRSDHVAACHADRYLLIFGGGSHATCFNDLHVLDLQTMEWSRPKQQGPIPSPRAGHAGATVGENWYIVGGGNNKSGVSETLVLNMSTLAWSVVSTVEGRVPLASEGMTLLYSNYSGEDYLISFGGYNGRYSNEVYALKLSVKLDLQSSTKDQPTSDSTSRVLEPEVEISQDGKIREIAMDNADSKNRNDEANEQLLAALKAEKDELEATLNREGLQTVQLKEEITEAEARNAELTKELQAVRGQLAAEQSRCFKLEVDVAELRQKLQSLDALEREVELLRRQKAASEQEQAALDAKQKKQAGSGGVWGWLVGTPPDDDDSESS

SEQ ID NO: 10812 - protein, 263 aa, Campylobacter coli RM2228
MKAKKHYGQNFLNDKSILSKIIQAIPKDTENIVEIGPGLGDLTQELLKVSHVKAYEIDDDLIPILRKKFQKELDCGKLNLLHQDASKLACFDEKKYFLVANLPYYVASHLILQALEDKNCSGLIVMVQKEMALKFCAHSGESDFSALGVLSAMICEREILFDVEPECFNPPPKVVSAVMKMIKFRAYQDLCEIHAFKAFLKDCFKAPRKQLLGNLKIHKAKLTELFQELKLNLNLRPHELCVDSYLKIYEKVKEEYERKQQRK

SEQ ID NO: 10813 - protein, 343 aa, Arabidopsis thaliana
MMNAVITSATINCNSLSPSWTCGDNSPSKLLLGEISAALSRRRTVKVSCGKSSPDDYHSTLKSLNSRGRFPRKSLGQHYMLNSDINDQLASAADVKEGDFVLEIGPGTGSLTNVLINLGATVLAIEKDPHMVDLVSERFAGSDKFKVLQEDFVKCHIRSHMLSILETRRLSHPDSALAKVVSNLPFNISTDVVKLLLPMGDIFSKVVLLLQDEAALRLVEPALRTSEYRPINILINFYSEPEYNFRVPRENFFPQPKVDAAVVTFKLKHPRDYPDVSSTKNFFSLVNSAFNGKRKMLRKSLQHISSSPDIEKALGVAGLPATSRPEELTLDDFVKLHNVIARE

SEQ ID NO: 10814 - protein, 527 aa, Campylobacter upsaliensis RM3195
MKKKIIVCDAILDKGVQLLREAEDIELIEAAKVPKDKLLAMLEDVEVAITRSSTDVDDTFLKHAKKLKALVRAGVGVDNVDIPNCSKQGVIVMNVPTANTIAAVELTMAHLITSARSFVNAHNFLKIERKWEREKWYGIELKGKTLGIIGFGNIGSRVAIRAKAFGMKILAYDPYIGASKITDLGMKQAKHLDEILTQSDFITIHTPKTKETNGMIGSKEIAKMKDKVRLINCARGGLYTEDALCEGLKSGKIAWLGIDVFDKEPATNHPLLDFENVSVTSHLGANTLESQENIAIEACEQALNAARGVAYPNALNLPIKTEDLPPFVEPYIELISKMAFLAVQIDKSPVKSIKIEAEGNISDYANSMLTFATVGALSGILGENINYVNAEFVAKEKGIELSCETLPNSGYNSKLSVKIATDNSSITVSGTVFNENEQRIVGLNGFKTDFKPKGKMLIFKNKDIPGVISKISSTLAAQNINIADFRLGRDGFGYALAVVLVDEVISKEVLDELNKLEVCVFVQYVEI

SEQ ID NO: 10815 - protein, 310 aa, Zea mays
  misc_feature (94)..(94): Xaa can be any naturally occurring amino acid
  misc_feature (281)..(281): Xaa can be any naturally occurring amino acid
  unsure (1)..(310): unsure at all Xaa locations
MEGDKGNRYGKQVAVVTGGNRGIGLEICRQLASSGVTVVLTARDAERGAGAASTLGQQPNVVFHQLDVGDPSSAARLAGFIEEKFGRLDILIDXNNAGITGTASNVDDPEAFRLELAGMDLMQRIEAINRHSTEPYEQAEKCLNTNYHGIKAVTKALLPLLQSSSHGRIVNLSSYYGLLRFFSGDELKEELSSIDGLSKQRLDELSELFLKDFKDGQLEAQGWPNEGGFAAYKASKALANAYSRILAKEHPSLRINCVHPGYVQTDMNFGSGHLTVEEGAXGPGALMLAMEPKGGVTGAFFDHTVVASFV

SEQ ID NO: 10816 - protein, 261 aa, Nocardia farcinica IFM 10152
MARKPLIAGNWKMNLNHLEAIALVQKIAFALPEKYFEKVDVAVIPPFVDIRSVQTLVEGDKLLLTYGAQDVSVHESGAYTGEISASMLAKLGCTFVVVGHSERRQYHHEDDATVLGKAKKALEHGLTPIVCIGEGLNVREAGTHVEYNLEQLRGSLKGLSAEQIAKVVIAYEPVWAIGTGKVASAADAQEVCGAIRAELAELAGPEVAAQVRVLYGGSVNAKNVGELVAQPDVDGALVGGASLKGDEFATLSAIAAGGPLP

SEQ ID NO: 10817 - protein, 322 aa, Schizosaccharomyces pombe
MDYDIDAIIEKLVKARNGKPSKQVQLSDAEIRYLCTTSRSIFLSQPMLLELEAPLKICGDIHGQYSDLLRLFEYGGYPPDANYLFLGDYVDRGKQSLEVICLLFAYKIKYPENFFLLRGNHEFASINRIYGFYDECKRRYSIKLWKTFTDCFNCMPVAAVIDEKIFCMHGGLSPDLNSLDQIQRIIRPTDIPDTGLLCDLVWSDPEKDLTGWGENDRGVSYTFGADVVSRFLQKHDLDLICRAHQVVEDGYEFFGKRQLVTIFSAPNYCGEFDNVGAMMSVNEDLLCSFQILKPAEKRQRVSQSSIKESKSATNSLKKSKNN

SEQ ID NO: 10818 - protein, 605 aa, Xanthomonas oryzae pv. oryzae KACC10331
MHSGGLELALVLMLAAIVAVPVFKRFGLGAVLAYLVAGVVLGPDGVGVVQDAERISGAAEIGVVMLLFVIGLELSPALLKVMRHSVFGAGATQVLVTAVILGGLLMAARLGWKSALIVGVALALSSTAVGLQLLAERKALNSDYGRLAFAILLFQDLIAIPLLASIPLLGGSKNDALEWQDVAKAIAALALVIVCGRFVLRHLFNVVARTRMPEVFTASALLVVLGTAWIMQEAGLGASLGAFIAGVLLADSEFRHELESQIEPFEGLLLGLFFISVGMGIDLHRVVAEPWVIAAGVAILLVVKFSLLVGIGSVAKLPLRSSLMLGSVLWLGGEFAFVVFNEADRVGLLEPANHDRLVAIVGVSMALTPLLLLGMQRILNRPLRVRVPKTDRPFDTIDAQTPKVLVAGMGRFGQVVARLLTSRHVPFVALEHNPHTVEDLRRFGSQLYYGDPTRPELLRAAGADRIKVFVIAVDDPESNIKTVRLIRRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVKADVDGDDQTVAATREK

SEQ ID NO: 10819 - protein, 420 aa, Saccharomycetales
  misc_feature (113)..(113): Xaa can be any naturally occurring amino acid
  misc_feature (115)..(115): Xaa can be any naturally occurring amino acid
  misc_feature (128)..(128): Xaa can be any naturally occurring amino acid
  misc_feature (156)..(156): Xaa can be any naturally occurring amino acid
  unsure (1)..(420): unsure at all Xaa locations
KIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTXAXKDVYNFLELFFDXFPEYVNKGQDFHIAGESYAHGYIPVFAXEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDELNQDYVKEAVGAEVDHYESCNFDINRNFLFAGDWMKPYHTAVTDLLNQDLPILVYAGDKDFINNTLGNKAWTDVLPWKYDEEFASQKVRCWTASITDEVAGEVKSYKHFTYLRVFNGGHMVPFDVPENALSMVNEWIHGDFSL

SEQ ID NO: 10820 - protein, 228 aa, Enterococcus faecalis
MPKLVFSRHGLSEWNALNQFTGWADVDLAPEGVEEAKEGGRKIKEAGIEFDVAYTSVLTRAIKTCNYLLEYSDQLWVPQIKSWRLNERHYGKLQGLNKKETAEKYGDEQVHIWRRSYDTLPPLMEATDEGSAANDRRYAMLDQRDIPGGENLKVTLERALPFWQDEIAPALKDNKTVLVAAHGNSLRALAKHIEGISDEDIMDLEIPTGKPLVYELNDDLTVKEKYYL

SEQ ID NO: 10821 - protein, 272 aa, Lactococcus lactis subsp. lactis Il1403
MKLNNQIEIPELGLGVFQIPNDETADVVKNAIVNGYRLIDTAKIYENEEGTGQGIKEGLAMTGLSRDDLFITSKLWGDNHSYEETVQNFEKSLKKLDLDYLDLYLIHWPGTHYAYKEAWNAMEDLYKAGKIKAIGVSNFQKSHLEELLSYAKITPVLNQIELHPKLSQEELRNFLELHDIKVQAWSPLMQGQLLDNEVLKKIADKHGKSVAQIILRWDIQQDILVNVKSIKSERMIANRQIFDFSLDSEDMKAINSLNEELRVGPDPEHFNF

SEQ ID NO: 10822 - protein, 123 aa, Zea mays
MESTFIMIKPDGVQRGLIGEIISRFEKKGFYLKALKLVNVERSFAEKHYADLASKPFFQGLVDYINPLASEPGTIRGDFAVDIGRNVIHGSDSIESANKEIVLWFPEGPADWQSSQHPWIYEK

SEQ ID NO: 10823 - protein, 424 aa, Methylobacter marinus
MYVIVPTGRADQTKLSSRSYEAGRLATRLFRSVVMKALCWHGKYDVRVDTVPDPIIVDPTDAIVKITATAICGSDLHLYDGYMPTMESGDILGHEPMGEVVEVGSEVTSLKTGDRVVVPFTISCGHCFFCEKTLYSCCDTSNPNADMARKAMGHSPAGIFGYSHMLGGFAGGQAEYLRVPYADVGPIKITSDLPDDKVLFLSDIFPTGYMAAENAQIEPGDTVAVWGCGPVAQFVIQSCWMLGAGRVIAIDRVPERLTMAQEHGKAEIIDFEEEDVYDRLMAMTNGRGPDCCIDAVGCEAHGAGSFDAVLDKAKAALYLGTDRPHVLREAIMCCRKGGTVSIPGVYVGLLDQLPMGAAMNKGLTLKMGQTHVQRYLEPLLEKIEEDQIDPSFVITHSLGLDEGPQAYKTFRDKEDGCIKVVLKP

SEQ ID NO: 10824 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNTIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 10825 - protein, 401 aa, Streptococcus pneumoniae TIGR4
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAKMLKDLGLQSLHLLTNNPDKVEQLEKYGITISSRISIEIEANPYDSFYLETKKNRMGHILNMEEK

SEQ ID NO: 10826 - protein, 233 aa, Lactococcus lactis subsp. lactis Il1403
MPKLVFARHGESEWNLANLFTGWADVDLSENGTKQAIEAGKLIKEAGIEFDIAYTSVLKRAIKTTNLALEYSDQLWVPVVKSWRLNERHYGGLTGLNKADAAAKHGDEQVHIWRRSYDVLPPAMDHDDKYTAHGDRRYAGLEDSLIPDAENLKVTLERALPFWEDQIAPALKEGKNVFVGAHGNSIRALVKQIKKLSDDEIMDVEIPNFPPLVFEFDDNLNVQNEYYLAPKKA

SEQ ID NO: 10827 - protein, 133 aa, Zea mays
GIFVMDVYGGISSERKLRLQRKFPSFTYFWEQDEFDIISRQTRISLHFQGGKKQMLRYAFTYHWRLWSIPEIKDCLEEAGFKWVHVWMREMPNTQSGGNAKEYNANRDVKYEESQHFNQGDAWNAYVVGVANV

SEQ ID NO: 10828 - protein, 270 aa, Kineococcus radiotolerans SRS30216
MDTPWNDLARPPLRSAALRRALVGPGPWSRLDVVASTGSTNADLLADEDAPDGAVLVADHQTGGRGRLGRTWSAPPRSGLAVSVLLRPQRPVAEWSLLPLVTGLAAVDALEALGVRTRLKWPNDVLVEGPDRPGKVCGILAEARTGAGGARVVLGAGINVSLRTEELPVDTATSLALAGARSCDRDTVLRRYLRALRARVDAWGAGESPLGDYRALSATIGQDVRAHLPDGSVLEALAVDVDEEGRLVVEGSGGARTSLSAADVVHLRRR

SEQ ID NO: 10829 - protein, 292 aa, Triticum aestivum
  misc_feature (240)..(240): Xaa can be any naturally occurring amino acid
  unsure (1)..(292): unsure at all Xaa locations
ATHAVSLTSPSLLSSPLTSRGALVFNKPSASSLAVSTARRGVRVVAEAAAVSSPASSVSAQRTQPSAAEVARTVVELAPSGTLSVVGADGWPLGVGARFVADAAGAPVLCLAAAGVTVPDARASFHVEFRQSGARTPQCTFLGALTKPSDKYELKKLSTRWETKFGEEIDEDRLYLISVERILHMEDFNEGRVWVVPSEYSDAEPDPLRNFAESVVEEMNSEHAEDVHRIYNIYAESDFXGIFAVRIPFSRQVSDQKAVKSSFNMMAHHAWEVDKSYATPEVEKVQFLKKVI

SEQ ID NO: 10830 - protein, 279 aa, Thermoplasma volcanium GSS1
MFIKIFLITYRYKLTVISIIGGGTIGSSIAIPLKRSGFEVIVTRRNTAVLKHLESYGISVMSDNKTASKEADVVFLTLKPVDIIPEVRKIEENIRGKLLISMAAAIPLKLIKDAAPHSIVVRAMTNIAAKVGAGFTPFCVDDGDQEVAKRASSILSALGEVYLVEEKYMDALTALSGSGPAYILTIIEAMMYGGLKLGLPRDLALKASYQTVMGSAKLLAESGEHPSELKEKVITPGGTTIDGIYELEDARVRTAIMKAIEVSTMKANKISESIKKLEQ

SEQ ID NO: 10831 - protein, 351 aa, Staphylococcus aureus subsp. aureus Mu50
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGVFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDIIRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 10832 - protein, 328 aa, Triticum aestivum
RHWFYCINNKERSCLETGEVLIRVAASGICGTDLHICKGETPQATKNVVVGHEFCGYVEEIHPETMAVVKVGDLVAIDPNMPCNQCTFCRNKKYHLCLNLFCIGVTVDGGMSQYVAVPARAAITVPAHVPPEVACLSEPLSCVVHAVDKGHVKSGDSVLVIGAGPIGLMTTALVNASGGKVTVIEPNEFRRKEALEIFGAAAAYGPGELGPVNGALGEGYDVVFECVGRPNTADDAVKFAKAGGTVVWVGVAKVEDRVSISPYDVYRRELTITSTFTNPYGIDRAVKILAEGRVNWRALVSHSFKLSEFDKAWEVFTAGTGLKVVVKP

SEQ ID NO: 10833 - protein, 129 aa, Solibacter usitatus Ellin6076
MESDILVVDDSAAIRKILQRVLRQTGMAIRAIHEAGDGQEALALLAEHRVDLVLTDINMPKMDGLQLLASLKASAQWHNTPVVMITTEGGETKVAEAVKLGAAGYVRKPFTADQIKEKLVGILEPALPL

SEQ ID NO: 10834 - protein, 335 aa, Aspergillus fumigatus
MPSALLIGAITHARKEWKDLSSILTLKEFPEGTRDEFIRNCKDGQYDDVVVIYRSNASTKFTGPFDAELLSVLPKSLKYICHNGAGYDNIDIPACSEKGIAVSSTPVAVNHATADVGIFLMIGALRQAYIPLSALRAGQWQGKTTLGHDPQGKVLGILGMGGIGREMANRARAFGMKIQYHNRSRLSPELEGDAQYVSFDELLANADVLSLNLALNAKTRHIIGEKEFQKMKDGVVIVNTARGALIDEKALVAALDSGKVMSAGLDVYENEPEIEPGLVNNPRVMLLPHIGTATYETQKEMELLVLNNLRSAVEKGEMITLVPEQKDIFKGQNGK

SEQ ID NO: 10835 - protein, 246 aa, Triticum aestivum
  misc_feature (142)..(142): Xaa can be any naturally occurring amino acid
  misc_feature (180)..(180): Xaa can be any naturally occurring amino acid
  misc_feature (187)..(187): Xaa can be any naturally occurring amino acid
  unsure (1)..(246): unsure at all Xaa locations
MSAYCGKDKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNVETTTQGFDDLGKRCAKYYEAGARFAXWRAVLKIGAPEPSQLSIDQNAQGLAPLCIICQENGLVXPIVEPKXLLDGPHEIDGGAYRPENVPGWPAKKPSHDQYVPPRGPPSWNPKRAPPGFPTPRRGPREG

SEQ ID NO: 10836 - protein, 104 aa, Glycine max
MSAAAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 10837 - protein, 367 aa, Photobacterium phosphoreum
MALSSAKEIIDDIRQGKMVILMDDEDRENEGDLIIASEKITPETINFMAMYGRGLICLTLSKARCQKLGLPLMVQDNTEQFGTPFTISIEAATGVTTGISAADRARTVQAAVAADATAANIVMPGHIFPLMAQEGGVLTRAGHTEAGCDIARLAGLEPSSVIVEILNEDGTMARRPQLEIFAEKHGLKLGTIADLIEYRNHHETTIERVGECKLNTEFGEFDMITYRDKIDDQIHYALCKGDIEADAATLVRVHLQDTFKDILQSGATQWTLPAAMQRISAENGVLVILSKQESTDSIINKVKNIAAEKEGRPQVKMSPYNPSRQVGVGSQILSDLGIGKMRLLSSSTQRYHSLSGFGLEVVEYICE

SEQ ID NO: 10838 - protein, 448 aa, Listeria monocytogenes
MAKHRYLPMTEQDEKEMLDVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVAQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNKSLLDEGIIGGYDLGFYEEKYKHHMLVAVTEMRTKEEIDAFVASLEGAK

SEQ ID NO: 10839 - protein, 315 aa, Glycine max
MAAAIEIPTIVFPNSSAQQRMPVVGMGSAPDFTCKKDTKEAIIEAVKQGYRHFDTAAAYGSEQALGEALKEAIHLGLVSRQDLFVTSKLWVTENHPHLVLPALRKSLKTLQLEYLDLYLIHWPLSSQPGKFSFPIEVEDLLPFDVKGVWESMEECQKLGLTKAIGVSNFSVKKLQNLLSVATIRPVVDQVEMNLAWQQKKLREFCKENGIIVTAFSPLRKGASRGPNEVMENDVLKEIAEAHGKSIAQVSLRWLYEQGVTFVPKSYDKERMNQNLHIFDWALTEQDHHKISQISQSRLISGPTKPQLADLWDDQI

SEQ ID NO: 10840 - protein, 964 aa, Acidovorax sp. JS42
MQMPSPLPLAALENAAEFLPRHIGIDAADEAHMLSVIGEASRRALIDSIVPRSIARQRPMDLPAPATEAAALAELQAIASKNRILKSFIGQGYYGTHTPGVILRNVLENPAWYTAYTPYQAEISQGRMEALLNFQTMVCDLTAMPIANASMLDEATAAAEAMTLAKRSVKSKSDVFIVAGDAHPQTIEVIQTRAAPIGITVVVANSQEEWQAALAGDFFAALIQYPASSGWVQDWQADVDAIHAKQAAAIFVTDLLALTLLKAPGEWDADIVVGSTQRFGMPMGAGGPHAAFMACRDEFKRSLPGRLVGVSVDVHGKPAYRLALQTREQHIRREKATSNICTAQVLPAVIASMYAVYHGPEGLTRIARRVARFTAILSRGLAQLGFTSRHHGSAFDTLSLHTKDATDSIAARAVQMGANLRKAWNDYLCISLDETTTRADIELLWKIFARDGQQLPTIEAMDAAGAPALFPDTLARTSRFLAHPVFNTHHSETGMLRYIRQLSDKDLALDRTMIPLGSCTMKLNATSEMIPITWPEFANVHPFAPADQLEGYRLLDEQLRAWLCQATGYAGVSLQPNAGSQGEYAGLLAIKGYHEARGESHRKVCLIPSSAHGTNPASAQMVGMQVVVTKCDENGNVDMADLQAQCEKHSANLACVMITYPSTHGVFETQVKALCELVHRHGGRVYVDGANMNALVGVAAPGEFGGDVSHLNLHKTFCIPHGGGGPGVGPVCVVEDLVPYLPGHATGGIASKTGAVSAAPLGNAAVLPISWMYIRMMGADGLQAATETAILSANYISARLKDHYPTLYASANGHVAHECILDLRQLKDTSGVMAEDVAKRLIDYGFHAPTLSFPVPNTLMVEPTESETLFELDRFIDAMIAIRREIRQIEAGTWPQDDNPLKNAPHTAECLLVADWQHPYPRDAAAYPVAALRQNKYWSPVGRVDNVYGDRNLFCSCVPVSELG

SEQ ID NO: 10841 - protein, 1208 aa, Magnaporthe grisea 70-15
MEVRPQARVPPRPVLEEASMRTNYSISQNSATPPNYQHGGLKTENIRPAQPQKTRRDIPVSSSHVPLNPRLYEIREEAQSTPQSKRESQASTASYKSSSSNTFRKPKTHVGPWQLGKTLGKGSSARVRLARHTSTHQYVAVKIVAKSTCKMTQAGSLAKLDEIDSAAPEKVEGMRRMPIALEREVAILKLIEHPNIVKLYDIWENSNEIYLILEYVERGDLFDFISKHGPMPEEEAIFVFRQIMSALEYCHSYGICHRDLKPENILLKSNGQVKIADFGMAALHQGPRTPLWTFCGSPHYAAPELLREKAYRGEKSDIWSMGVILFAMMAARLPFDDEDMNLMFAKARKAIYHMPSFFSDEAKDLIHRLLQVDPRKRLSMRQMWQHPVVWKYGYLDELGGEGIPEVPNPRTRQEIKPLDLCDIDPQILRPIQSMWHTLSEDELVKKLISDDYRERQLENYDPSLTHSPSDYHHIRPPLWLTKVSTRQFMTNKANGQGRSISKFTVISNVTETGTGANLGTVRSYDPYKSPAVKQPQATHARIVIHRDSTDTDRNAASLGSTSHRRPRANSTGSWKRPARRSQLGSRILTPRSTASSVQSSRKFHARSRTSSRQKRAMDFSTARRKAAAAKLSNQQTLLGTDGSKTVTGWNIQCSSDPDIPGDTADSSNARLRSKDRLHEELRHFSSSIAKDCDEAFNSSLLSVSQFDGDRSRQGSPFSLSLGTPVSATPVTPVVTPTIPRPSARPWDSRPLPPTPPSSSHEKESAVNFGENPSILARRGQPPTQGYNLRSGPVAMTPTPSDRRVVSAPVHGGQYGGCATGKLPSIEEATPNTIQDEVNRSRIVSLPAKPVATAPTSNEARGLEFLSNAEQTIRIVHSPSAQRESGITRRPHPIQANAKPSKMVGTSTGPVKQASIDLYHADDSIISHRNAQLAQTSSHGSASTFAMRKKTSSWFKRLSRESKGSKGSLCDELDDTKSIDVPHGLTSGPIKNERDNSSINMSHRPPEKTSNKKKSFFLPFWRHKSEPRMSLAEPDFEESPSPETNAAVKSHKTSGNNLLNFGDAESAERMIKPQQNWLARLFRVKPVTRVICLSISRRRARQEVAILLRDWRKYGIRDVEVDKKRNVVFARLSSKNHLNIKEVALACEIITVIEHGKRNHLSIVRFTQEKGAASSFQRVVDTMRDVLGNRNLLVTDKSKAKMMIKTLNS

SEQ ID NO: 10842 - protein, 446 aa, Thermus thermophilus HB27
MGYTKAEILKALKGENVKFLRLQITDILGVVKNVEVPESQFEKALDGEIMFDGSSIEGFTRIEESDMLLRPDYNTFVILPDLVEDPKRGRVARLICDVYYPDGRPFEGDPRYVLKRQIERLKKLGFDNLYAGPEPEFFLFLRTPEGLPTTETHDRAGYFDLAPIDKGEEARRDMVNALVAMGFEIEAAHHEVAPGQHEIDFKYADALTTADNIATFKWVVKRIALNHGLHATFLPKPIRGINGSGMHTHLSLFKDGENAFYDPNAEYQLSQTALHFIAGLLEHAAGMVAVTNPLVNSYKRLTPGYEAPTNIAWSASNRSAMIRIPARRGVGTRAELRMPDPSCNPYLALAVMAAAGADGIERKLLPPPPIQRNIYQMTVRERRKHKIRELPGTLREALEALRKDPVIREALGEHVYTHFLQAKQMEWDDYRVTVHQWELDRYLATY

SEQ ID NO: 10843 - protein, 414 aa, Nocardia farcinica IFM 10152
MTRFDTIERAVADIAAGKAVVVVDDEDRENEGDLIFAAEKATPELVAFMIRYTSGYICVPLTGEDCDRLGLPPMYATNQDKHGTAYTVSVDAREGITTGISAADRATTMRLLADADAKADDLTRPGHVVPLRAKDGGVLRRPGHTEAAVDLARMAGLRPAGVICEIVSQKDEGHMARTEELRVFADDHDLALISIADMIAWRRKHEKQVVRVAEARIPTAHGAFTAVGYQSIYDDVEHVALVRGDIGDGEDVLVRVHSECLTGDVFGSLRCDCGPQLDAALEMVDQEGRGVVLYMRGHEGRGIGLMHKLQAYQLQDSGRDTVDANLDLGLPADARDYGTGAQILVDLGIRSMRLLTNNPAKRVGLDGYGLTITERVPMPLRANAENLRYLRTKRDRMGHDLVGLDDLDLGETAQ

SEQ ID NO: 10844 - protein, 266 aa, Bifidobacterium adolescentis
MSNPTIGFIGYGNMAQAIAEGLVAAGAIDGTDIVACAAHYDKLEKTTAKVGATPLRTAAEVADAADVVIIAIKPYQIESVIKPIAGALANESTFVVSIAAGWDLAKYRELFGADFGAMHIQCTIPNTPMAVGKGVLVTETDNTLTDAQNETFEKLFSSISLIERVDSAHMGIGMCIAGCAPAFTDMYIEALGDAGVKYGLQRATAYRLAAKMVEGVGALYLANETHPGAMKDAVCSPGGTTIKGVASLEESAFRGAVIKAVDAIEA

SEQ ID NO: 10845 - protein, 279 aa, Halorhodospira halochloris
MATRYDDQAIETARQYYNSEDADNFYAIIWGGEDIHIGLYNDDEEPIADASRRTVERMSSLSRQLGPDSYVLDMGAGYGGSARYLAHKYGCKVAALNLSERENERDRQMNKEQGVDHLIEVVDAAFEDVPYDDGVFDLVWSQDSFLHSPDRERVLREASRVLRSGGEFIFTDPMQADDCPEGVIQPILDRIHLETMGTPNFYRQTLRDLGFEEITFEDHTHQLPRHYGRVRRELDRREGELQGHVSAEYIERMKNGLDHWVNGGNKGYLTWGIFYFRKG

SEQ ID NO: 10846 - protein, 479 aa, Nicotiana tabacum
MAGTTTAGDTSTSSRSNLAPTKSLSKKENQGLLSGRYEIGKLLGHGTFAKVYHARNVKTNESVAIKVIDKEKILKVGLIDHIKREISILRRVRHPNIVQLYEVMATKAKIYFVMEYVKGGELFNKVAKGRLKEEVARKYFQQLISAVAFCHARGVYHRDLKPENILLDEDGNVKVSDFGLSAISEQIKQDGLFHTFCGTPAYVAPEVLARKGYDAAKVDIWPCGVILFVLMAGYLPFHDQNIMAMYKKIYKGEFRCPRWFSPELTKFLRQLLDTNPETRITIQEVMNNRWFKKGFKHVKFYIEDDKLRSVNDDDYDGGVDYSSDRSESESEMEMRRKPATLPRPASLNAFDIISFSRGFDLSGLFEEGGDGARFVSGAPVPKIISKLEEIAKVVSFAVRKKDCRVSLEGSKEGEKGPLTIAAEIFELTPSLRVVEVKKKAGDRVEYEEFYHKELKPGLQNLTLEVDGPVDSSHLPSDTE

SEQ ID NO: 10847 - protein, 106 aa, Brassica napus
  misc_feature (81)..(81): Xaa can be any naturally occurring amino acid
  unsure (1)..(106): unsure at all Xaa locations
MEKNDEDRTALIFLGTGCSGAVPEFRCLLQPSDPPCHVCSQSLSLLPHLNPNYRCNTSLLIDYCCEEENGRHYYIIIDVGXSFREQVLRWFTFKIPRIDSIILTHE

SEQ ID NO: 10848 - protein, 204 aa, Triticum aestivum
  misc_feature (197)..(197): Xaa can be any naturally occurring amino acid
  unsure (1)..(204): unsure at all Xaa locations
MPGGGEMPETKQIPKNKACLICIDGWGISPEEDHKGDAIYNAETPVMDKLEKEHPFTSIAAHGLAVGLPDGLMGNSEVGHLNIGAGRVVYQDIVRIDLTMKKKEFGQVENIKNAFERAKSTNGRLHFMGLVSDGGVHGHINHLVSLLEAARDAGVPKSFIHFFGDGRDTAPKSAAGYMKQLLESLDKLQYGKIADVXGRYYAMD

SEQ ID NO: 10849 - protein, 408 aa, Rhodococcus sp. RHA1
MCNPRRHTDYAAVMPATPRNRTVQRLQPFASTIFAEMTALAVRHHAINLGQGFPDTDGPASMLDTARRAIADGLNQYPPGPGMPVLRQAVAADRLARYGLDHDPDSEVLVTVGATEAISAAILGLVEPGEEVVLIEPYYDSYAASVALAGAVRRSVPLARSGTKFVVDLDALRAAITPKTRMLVINTPHNPTGTVFTPEEIAAVAEVACEHDLLVLSDEVYEHLVFDGRTHTALATLPGMYERTVSVSSAAKTFNVTGWKIGWACGPAELIDAVRTAKQYMSFVGGGPFQPAVAHALSHEQQWVKELRDSLQAKRDVLYDALVASGLEVHSGGGTYYLCADITAIGERDGIDFCRRLPERIGVAAVPVSVFTDHPVPWNPLVRFAFCKQDHVLEEAARRLRTLGEPGS

SEQ ID NO: 10850 - protein, 484 aa, Rhodococcus sp. RHA1
MTDFERLRATLPTGLWIDGAQTDPIDGGTFPVYDPATGTLIADVADAGGKDAMRALDSAAAVQEEWAATAPRQRSIILRSAWEKVIERTDDLALLMTMEMGKALPESRGEVNYGAEFLRWFSEEAVRIQGRYTTSPSGSGRIMVTKVPVGPTLAVTPWNFPLAMGTRKIGPALAAGCTIIVKPAEDTPLTMLLLAEIFAEAGLPAGVLSVLPASNAAAVTEPLLADPRLRKVTFTGSTRVGKILIEQSAQQVLRTSMELGGNAPFVVFDDADIDAAVEGAMAAKMRNGGEACTAANRLIVANSVREEFTTKLTDRIAALTVGPGSEEGTNVGPLVNEKQRRNVASLVDDAVAAGARVRTGGKSVDGPGYFFQPTVLDEVPANARIVREEIFGPVAAITGFDTEAEGVAAANDTEYGLAAYIYTQNVDRAFRVADKLESGMVGVNRGVISDVAAPFGGVKQSGLGSEGGTEGIEEYLETKYVGFA

SEQ ID NO: 10851 - protein, 137 aa, Geobacter metallireducens GS-15
MERTFAIIKPDAVERNIVGKVLEKIEAAGFRIVGMKKIQLSKKEAEGFYYVHSERPFFGDLCSFMSRSPVVVLALERENAIAKWREVMGATNPANADAGTIRKEFGLSIEENTVHGSDSPESAAFEIPYFFSQLELL

SEQ ID NO: 10852 - protein, 473 aa, Pseudomonas syringae pv. syringae B728a
MSSSSTSAAAGQQGRQRAASNRLIFISVLVATMGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 10853 - protein, 337 aa, Antirrhinum majus
MAPIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 10854 - protein, 331 aa, Gibberella zeae PH-1
MPLPAKPLDAISQAFPPKPHFTESNVPDLTGKVTIVTGANTGVGREIAQVLYSKNATVWVAARNEKKGLDAIEGIKKQHPASKGSIKFLKLDLADLTTIGPSAKEFLAQETKLDILFNNAGVMTPPEGSKTEQGYELQLGVNCLGHFLFTKHLTPLLQSTAKSAPKNSVRVIWVSSSAADVLSPKNGFERDNLDYHQPRNLMHKYATSKAGNYYHNTEFARKYKNDGIVSVSLNPGNLASELDRTSPWYMYYPRMFTTYPSINGAYTELFAAFSEEITTENSGIWVVPWGRFMPIRPDVQKGALPESEGGTGMAEFFWNWSEEQIKPYFST

SEQ ID NO: 10855 - protein, 305 aa, Hordeum vulgare
VNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCPAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYEQIKAAIKEESEGNLKGILGYVDEDLVSTDFQGDSRSSIFDAKAGIALNDNFVKLVSWYDNEWGYSTRVVDLIRHMHSTK

SEQ ID NO: 10856 - protein, 311 aa, Saccharomyces cerevisiae
MTASTPSNVMTLFLLRHGQSELNHENIFCGWIDAKLTEKGKEQARHSAELIEQYCKANNLRLPQIGYTSRLIRTQQTIETMCEEFKLKPQLQVVYDFNKIKLGDEFGSDDKDNMKIPILQTWRLNERHYGSWQGQRKPNVLKEYGKDKYMFIRRDYEGKPPPVDLDREMIQQENEKGSSTGYEFKEPNRQIKYELECSNHDIVLPDSESLREVVYRLNPFLQNVILKLANQYDESSCLIVGHGSSVRSLLKILEGISDDDIKNVDIPNGIPLVVELDKNNGLKFIRKFYLDPESAKINAEKVRNEGFIKNP

SEQ ID NO: 10857 - protein, 323 aa, Yarrowia lipolytica CLIB122
MAGGPTLKLNSGHEIPQIGLGTWLSKPNEVAKAVESALKDGYRHIDGATIYQNENEVGAGWKASGVPREEIFLTTKNWNNARTKEGVKKQLDQSLKELQTDYVDLLLIHWPVVFKTGEELFPHNADGTVALGEVPVEETWEAFEELVKEGKVKSIGVSNFTEERIEKLLKTAKIPPAVNQIEYHPYLQQPGLAKYLASKNIVLEAYSPLGNNTYGFPRAIDDERVIDLAKKKGKDAAALIVNWIRSKNHVVLPKSVTPSRIKSNFEVFDLSPEEIKFLDSLDEESRRNDPIEWGVDIFGTATPEEIKKRVDEAAKKYLAEQKK

SEQ ID NO: 10858 - protein, 265 aa, Coccidioides immitis RS
MGIEDAVYLAKLAEQAERYEEMVQNMKVVASADKELSVEERNLLSVAYKNVIGARRASWRIVTSIEQKEESKGNEAQVTLIKEYRQKIESELAEICEDILDVLDKHLIPSAQSGESKVFYHKMKGDYHRYLAEFALGDRRKKSADNSLEAYKNATEVAQTDLAPTHPIRLGLALNFSVFYYEILNSPDQACHLAKQAFDDAIAELDTLSEESYKDSTLIMQLLRDNLTLWTSSEAEPAPESAAAPPAPAEQPKEGAPAEEPKAAE

SEQ ID NO: 10859 - protein, 504 aa, Haloquadratum walsbyi
MQTALVILDGWGLGDHDRRNAVQTASTPTFDRLIEKGANGTLDVSGRQVGLPAGQMGNSEVGHLNIGAGQVVKQAYTRVEDAIDNGSFQTNAAINAAFNHAVATNGRVHFMGLLSDGGVHSEQEHLHALIELAGDRNIDAITHVFTDGRDTNPHSSEQYLTTLEEVIHTHGTGDIATVSGRYYAMDRDKNWTRTRMSYDAIVNRTAEHTTSTALEAVSESYDRGDTDEFIEPTLIDNTPAVEDGDAVFVFNFRPDRVRQLVRMLADIDPAWSFETDPPTTELATMAQYDETFSLPVAFPPNEQHDTLGEVIATAGLTQLRIAESEKYAHVTYFLNGGREIAFEDERREIIKSPDVSTYDQQPSMSSNEVTDTAIEQINTTDPDVLILNYANPDMVGHTGDFTAAIEAIESVDTQLDRLLETIYAAGGHVIVTADHGNADNMGTAANPHTAHTTNPVPIVYTRPDGNGDGDTIRDGGSLCDIAPTVLELLSVEQPAAMTGSSLIE

SEQ ID NO: 10860 - protein, 519 aa, Caulobacter crescentus CB15
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 10861 - protein, 163 aa, Brassica napus
METLPISAESFKVGFIGAGKMAESIARGVVASGMLPPNRISTAVHSNLNRRQVFESFGVNVFSSSEEVVRESDVVIFSVKPQVVKKAITEVRSKLSKDKVLVSVAAGIKLKDLQEWSGQDRFIRVMPNTPAAVGEAVSVMSLGTAATEEDGALVAKLFGSVGK

SEQ ID NO: 10862 - protein, 411 aa, Synechocystis sp. PCC 6803
MPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 10863 - protein, 356 aa, Clostridium perfringens str. 13
MLYSLILAGGKGTRLYPLSRSSNPKQFLSIHNNGKSFLSNTVDRIRPIIHKDNIYVVTNQEYEDKTRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADVILREIEKYIPKMYKCLMEIYQHIGEDDEEEIIKEQYSLIDGISIDFGVMQKTRRSFVIKCDFSWDDIGTFSALSRFLGHNGNNRTSDNVFLEECENCSVFGKEKLIIGFGIKDLVLVDAGDVILVMDKGRDQEIKHLLNSISGKKEFKEYL

SEQ ID NO: 10864 - protein, 343 aa, Cryptococcus neoformans var. neoformans JEC21
MPAETRSADRVSNYNKFWEKKSANDNDTHRANRLDQYTEVVNGYYDGATELYEYGWAESFHFCRFYKGEAFLQALARHEHYLASMMQLKPGMRVLDVGCGVGGPAREIARFSDATIVGVNNNDFQIGRATAKSKKAGLSDKVSFVKGDFMKLSEQFGENSFDAIYAIEATCHAPNFEGIYGEIFKCLKPGGVFGVYEWCMTDAWDPSNPEHKEIAHGIEVGDGIPEMRNLAAARSALKTVGFEIEHEEDLADRDDAVPWYYPLEGDIWKAQTTWDMFTCWRTSKMGYTITQNAVWFLEKFGLVPKGTYSVGQSLIVASKALVAGGRTKLFTPMALWVARKPAN

SEQ ID NO: 10865 - protein, 80 aa, Triticum aestivum
FFSDYFEFSFPPGVIVQPYVERVVLVYHNLGELSEKYYPLPGYTYLSPILGLLVYDAANLSAVGLSELSIVASGSPISVS

SEQ ID NO: 10866 - protein, 460 aa, Clostridium acetobutylicum ATCC 824
MEKKELSRGLKARHIELIALGGTIGVGLFMGSASTIKWAGPSVLLAYGVAGIAMYIIMRIMGEMLYLEPLAGSFANYANKYISPLAGYITAWCYWFMWIAVGMSEITAIGIYVKFWFPALPAWIPALIGVAILAAANMASVKFYGEFEFWFSLIKVVTIVVMLIVGVGLIFFGIGNHGVPIGFKNLTAHGGFFAGGLKGWLFALCMVTASYQGVELIGITAGEAQDPKNTLRKATKNIIWRILIFYVGAIFVIVTIYPWDKISTLGSPSVLTFAKIGIAAAAGIINFVVLTAAMSGCNSGIYSCGRMLYTLATNGQAPKFLGKLNKDGVPANGIRTTLVCLLIGVILNYIYPNSKLFVYIYSASVLPGMAPWFVLCISQIKFRKEHAEEMKMHPFKSRLFPYANYIVVAYLCLVLIGMCFNSSTQIPLFIGAVFCAIVTIAYFAFGIHKGKVSKVEELQE

SEQ ID NO: 10867 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 10868 - protein, 409 aa, Shewanella oneidensis MR-1
MAKHSLDKDKIKILLLEGVHQSAVDVFERAGYTNIEYHKASLGDEALHESIKDAHFIGIRSRTQLSADVLKRAEKLIAIGCFCIGTNQVDLATAESLGIPVFNAPFSNTRSVAELVLGEIIMLMRGIPERNAIAHRGGWMKTAAGSYEVRGKTLGVIGYGHIGTQLGILAETLGMRVVFFDIEDKLPLGNAQQIHSMEQLLAQADVVSLHVPETPQTKDMISTAEFAAMRKGSIFINASRGTVVDIDALTVALKERHLAGAAIDVFPVEPQSNDDEFISPLRGLDNVLLTPHVGGSTAEAQENIGIEVAGKLAKYSDNGSTVSAVNFPEVSLPMHKGTSRLLHIHQNRPGVLIKINKAFSEKGINIAAQYLQTTAEIGYVVMEVDTHQAEEALVELKAIDGTLRTRVLF

SEQ ID NO: 10869 - protein, 406 aa, Arabidopsis thaliana
MTETGLILMWFPLIILGLFVLKWVLKRVNVWIYVSKLGEKKHYLPPGDLGWPVIGNMWSFLRAFKTSDPESFIQSYITRYGRTGIYKAHMFGYPCVLVTTPETCRRVLTDDDAFHIGWPKSTMKLIGRKSFVGISFEEHKRLRRLTSAPVNGPEALSVYIQFIEETVNTDLEKWSKMGEIEFLSHLRKLTFKVIMYIFLSSESEHVMDSLEREYTNLNYGVRAMGINLPGFAYHRALKARKKLVAAFQSIVTNRRNQRKQNISSNRKDMLDNLIDVKDENGRVLDDEEIIDLLLMYLNAGHESSGHLTMWATILMQEHPMILQKAKEEQERIVKKRAPGQKLTLKETREMVYLSQVIDETLRVITFSLTAFREAKSDVQMDGYIIPKGWKVLTWFRNVHLDPEIYP

SEQ ID NO: 10870 - protein, 442 aa, Carboxydothermus hydrogenoformans Z-2901
MSYTKNDIMDMVREQNVKFIRLQFTDIFGVLKNVAIPVEQLEKALNNELMFDGSSIEGFVRIEESDMYLRPDPNTFAVFPWRPRNGAVARLICDVYNPDGTPFEGDPRYVLKRALAEAKELGYTMYVGPELEFFLFQVDAEGKPTLVTHDNAGYFDLSPVDLGENARRDMVLALEQMGYEVEASHHEVAPGQHEIDFKYSDALDVADKIVTFKVVVRSIAQRHGLHATFMPKPLFGVNGSGMHTNQSLFKDGQNAFYDPNGELQLSETAYYYIGGIMKHIKAITAIANPVVNSYKRLVPGYEAPVYIAWSARNRSPLIRIPAKRGSSTRIELRSPDPSANPYLALAVMLKAGLDGIKNKIKPPAPVNQNLYEMTAEERKALGVDTLPGSLKEAIDCLLEDKVIQEALGKHVFERFVEAKLKEWDEYRVQVHEWEVKKYLTMY

SEQ ID NO: 10871 - protein, 459 aa, Lactococcus lactis subsp. lactis Il1403
MENLQEKHEAQRGLQNRHIQLIAIAGTIGTGLFLGAGKTIQMTGPSVIFAYILIGIAMFFFLRTIGEMLYNDPSQHSFLNFVTKYSGVRTGYFTQWSYWLVIVFVCISELTAIGTYIQFWLPQVPLWLIEIVMLALLFGLNTLNSRFFGETEFWFAMIKVAAIIGMIVTAIILVAGNFHYSTVLSGKTVHDSASLSNIFDGFQLFPHGAWNFVGALQMVMFAFTSMEFIGMTAAETVNPKKSLPKAINQIPVRILLFYVGALLAIMAIFNWHYIPADKSPFVMVFQLIGIKWAAALINFVVLTSAASALNSSLFSATRNMYSLAQQHDKGRLTPFTKLSKAGIPINALYMATALSLLAPVLTLIPQIKNAFDFAASCTTNLFLVVYFITLYTYWQYRKSEDYNPKGFLTPKPQITVPFIVAIFAIVFASLFFNADTFYPALGAIVWTIFFGLYSHYKKI

SEQ ID NO: 10872 - protein, 337 aa, Mesembryanthemum crystallinum
MAKVKVGINGFGRIGRLVARVILQRDDCELVAVNDPFISTDYMTYMFKYDSVHGQCKSHEIKLKDEKTLLFGETPVAVFGCRNPEEIPWGQAGADFVVESTGVFTDKDKAAAHLKGGAKKVVISAPSKDAPMFVVGVNEHEYKSDLNIVSNASCTTNCLAPLAKVINDRFGIVEGLMTTVHAMTATQKTVDGPSMKDWRGGRAASFNIIPSSTGAAKAVGKVLPALNGKLTGMAFRVPTCDVSVVDLTVRIEKAASYEQIKAAIKEESEGKLKGILGYTEDDLVSTDFIGDNRSSIFDAKAGISLNDNFVKLVSWYDNEWGYSTRVVDLIMHISKCQ

SEQ ID NO: 10873 - protein, 306 aa, Gibberella zeae PH-1
MASVNFSPDTDIPSLNGKVILITGGNSGLGLESTRQLLKHDPAKIFLACRSKAKYDQAIAELQEQGSKTDAVSFLSLNLASLESIKSAVRQFQQESTRLDVLLNNAGIMMTPEGLTEEGYEIQIGTNHMGHAFLTHLLLPVLEETTKINPDVRVICLASMGEAMAPKNPYQFEQFKTTMSNFSTSARYYISKLANVHYAAALAERHPSLKIISIHPGIVQTNLTGPAVSNSLIMGTLTRLFFSVVGVNSSKGALNQLWALSDPKAESGVFYHPVGVTGKGSKLSQNKDARESLWEWTEKEIKQHLS

SEQ ID NO: 10874 - protein, 330 aa, Geobacter metallireducens GS-15
MGERTRIVILDGYTINPGDNPWTPVEEYGDCTIHDRTPPELKLERARDAEIILTSKVKLDEATIAALPRLRYISLLATGYNNVDVAAAGRRGIPVSNVPAYSTESVAQTAFALLLELTTRVGLHDAAVRGGEWSHCPDHSFWKTSIVELDGLTLGIVGYGAIGRAVARIAQAFGMRTIAHAPRIPADPGPVPVRFVSLEELFATADVVTLNCPQTPENTEFVNEGLLSLMKRSAYLINVARGGLVNEADLARALRDGTLAGAGLDVVAHEPMLPDNPLLAAPNCIFTPHLAWASLAARRRLTGVVAANVAAFLAGSPINVVNGPWLAGGR

SEQ ID NO: 10875 - protein, 264 aa, Shewanella oneidensis MR-1
MSKVTSSTLLKYKQEGRKFTALTAYDASFASAFDGEGIDVLLVGDSLGMVLQGHDDTLPVTTADIAYHTRCVRRGIERSLLIADMPFMSYATPEQAMENATTLMQAGANMVKLEGGHWLLETVTKLTERGIPVCAHLGLTPQSVNVFGGFKVQGRDAENAQRIIDEAKALEAAGAQLLVVECIPASLATAITQALTIPVIGIGAGATTDGQILVMHDVLGISSGYIPRFSKNYLKQTGEIRSAVRAYIEEVANGSFPSAEHTFN

SEQ ID NO: 10876 - protein, 282 aa, Alkaliphilus metalliredigenes QYMF
MAKKKSILDLMKMKKAEEQVAWVTAYDFPTASFAEQAGMEMILVGDSLGMVVLGYQGTIPVTMEDCISHCQAVRRGAPNTWVIGDMPFGSYQVSDEDAVRNAVRFMKEADVDCIKLEGGDRVKSRIRAITDAGIPVMGHIGLTPQSSGQLGGFKAQGRRVDNARVLIQDALVVQEAGAFSLLVEAVPPEVTKFIADKLDIPVYSIGAGPCDGQLVISGDMLGKFQAFTPKFIKKYANVAEVETNAFKEYVAEVKAGQFPTDDHVYHILDTQEEFEKLFQEFK

SEQ ID NO: 10877 - protein, 326 aa, Nicotiana tabacum
GRIGRLVARVALQRDDVELVAVNDPFISTDYMTYMFKYDSVHGQWKHHELKVKDEKTLLFGEKSVRVFGIRNPEEIPWAEAGADFVVESTGVFTDKDKAAAHLKGGAKKVVISAPSKDAPMFVVGVNEKEYKPEYDIVSNASCTTNCLAPLAKVINDRFGIVEGLMTTVHSLTATQKTVDGPSMKDWRGGRATSFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKNFVKLVSWYDNEWGYSSRVIDLICHMASVA

SEQ ID NO: 10878 - protein, 246 aa, Zea mays
MPQGDYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRTGKRKTKQWKRMVTKATFVGPGFTRKPPKYERFIRPTGLRFTKAHVTHPELKCTFNLDIISVKKNPNGPMYTSLGVMTRGTIIEVNVSELGLVTPASCSCLSEYAHFTN

SEQ ID NO: 10879 - protein, 586 aa, Chlamydomonas reinhardtii
MAELEKTFALIKPDAVRAGKAQEIMQLIELNGFTIIAKQKLQLTRARAEEFYGEHKGKEFFPKLVNFMTSGPIWALVLAKPGAILAWRALMGPTNVFKARAEQPKCLRALYGTDGTQNATHGSDSPISAAREIKFFFPTLSGDPTIYAEPTAAAEYITKRIQPALAKALAALAREKPSADKFEAITFVAGYLLQNNPNKPKVLMPDEWDPALMGDDEDDEADFINARLAAPTGNDGATKAEFDAMVEAAKADTGGAAPAQEFVYPDSKPTTPVVPAPPAPGSKPPSASGARPQSARPTSARPPSASAAPPAPLAPVPPPASSSRPASGSGRPPSATARPPSATPPPPPPAVELEEADDPAQLDEAATKVQAAFRGYQARKEVAVMRSEAQPGEAAAEPEQEAELQPEAEPEPQPEGEQEPQPQASASSSFLPDGVTEEMAAEAATRVQAHMRGHLARKQVAAIKAQQAAPAVAESSEALAEPEPQPEAEAEPQPQASVSSSFLPDGVTEEMAAEAATLVQAHMRGHLARKQVAAIKAQQAAPAVAESSEAQAEAEQTEAEAEPQPDAEAEAGAAEGEAEPEPEAAE

SEQ ID NO: 10880 - protein, 376 aa, Hypocrea jecorina
MEEEVAALVIDNGSGMCKAGFAGDDAPRAVFPSIDGRSRHHGIMIGMGQKDSYVGDEAQSKRGILTLRYPIEHGVVTNWDDMEKIWHHTFYNELRVAPEEHPVLLTEAPINPKSNREKMTQIMFETFNAPAFYVSIQAVLSLYASGRTTGIVLDSGDGVTTVVPIYEGFALPHAIRRVDMAGRDLTDYLMKILAERGYTFSTTAEREIVRDIKEKLCYVAHDFEQEIQTAAQSSSLEKSYELPDAQVITIGDRFRAPQALFHASVLGLESAGIDVTTFNSIMKCDVDVRKELYGNIVMSGGTTMFPQGISDRMQKEITASAPSSAMKVKIIAPPERKYSVWIGGSILASLTTFQQMWISKQEYDESGPSIVHHKCF

SEQ ID NO: 10881 - protein, 275 aa, Oceanospirillum sp. MED92
MDKQPVLAFIGAGNMARAIIGGLISNGYPANKIWASEPDAERLSDLKVQGLQTTTDNNQAVMAADAVILAVKPQVLKPVTEAMKDAVQAKQPVIISVAAGILSTSIDRWLGGNTAIVRCMPNTPALVGTGASGLYANSQVSDEQRSAAETILKATGITLWVDEESQLDAVTAVSGSGPAYYFLVMESMIQAGKKLGLSEEVATKLTLQTALGAAQMASSSDVDPAELRRRVTSPNGTTEQAIKTFMDEGLPATFEKALQACNDRSEELAKELGDA

SEQ ID NO: 10882 - protein, 330 aa, Gibberella zeae PH-1
MAVAISEEQATDLSKQYDTPLGLAHSTMQVLKDRIKLHYDLASDYYLSLWGEHIHHGYWPTEESEATQTKEEAQANLIQLLLDISKIPSKSSVLDVGCGIGGTSRYLASKHGSSVTGITISTKQVEIADRLTKAAVEDGASLPDVSDAHGFIKLGGGKVKFLELDAEKMGDSFSGQQGSFDAVWISEALSHFPNKALFFENVMKVLKPGGKLVLADWFKAEDLDDTTFINDIKPIEDGMLLPPLCTQQGYLDLAKQAGLQVFAEPKDISQQVRKTWDITWSLVQNPSLWAFAFTQGRDGIAFLQSFRAMRRGYANGSFRYSVMAFQKEMA

SEQ ID NO: 10883 - protein, 99 aa, Glycine max
  misc_feature (43)..(43): Xaa can be any naturally occurring amino acid
  unsure (1)..(99): unsure at all Xaa locations
MAPSTISNPGAGFVDRAVPSMIATITGLRIMAGFPTRKTNKDXTFIDCNGGRVHCMHVWPPVGKKKCENLSYLTDLEDAQWAKEAEYLVREGMDINARN

SEQ ID NO: 10884 - protein, 393 aa, Nicotiana tomentosiformis
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNFFRIGGVAADLPYGWINKCLDFCDYFLTGVAEYQKLITRNPLFLERVEGVGIIGGDEALNWGLSGPMLRASGIEWDLRKVDHYESYDEFDWQVQWQREGDSLARYLVRISEMTESIKIIQQALEGIPGGPYENLEIRRFDRLKDPEWNAFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 10885 - protein, 101 aa, Arabidopsis thaliana
MEMKLLFTSAFTQMFGYSNHMDQASNCQSTRNKIIKMMKKEEFPSGFQVPLHYPKYSKSDYEVMDDLRLDLLLKQYGFSFEGSLEDKRVFAIESFLWPDQL

SEQ ID NO: 10886 - protein, 469 aa, Clostridium acetobutylicum ATCC 824
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 10887 - protein, 117 aa, Nostoc sp. PCC 7120
MGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 10888 - protein, 455 aa, Clostridium acetobutylicum ATCC 824
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 10889 - protein, 251 aa, Zea mays
  misc_feature (231)..(232): Xaa can be any naturally occurring amino acid
  unsure (1)..(251): unsure at all Xaa locations
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGSLVGXXSQPAFVDIITLPAVTINSK

SEQ ID NO: 10890 - protein, 356 aa, Tropheryma whipplei TW08/27
MRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 10891 - protein, 334 aa, Oryza sativa
  misc_feature (83)..(83): Xaa can be any naturally occurring amino acid
  unsure (1)..(334): unsure at all Xaa locations
ARGESHPPPRRGESWRNDDDGGGGPSRIRRAESIIRIALVTGGNKGVGLETCRQLASRGLRVVLTARNEARGLEAVDGIRRSXGAADSDVVFHQLDVTDAASVARLADFVRDQFGRLDILINNAGISGVDRDPVLVAKVKDQIEGMDVDQRVEWMRENSKETYDEAKSCITTNYYGAKLVTEALLPLLLLSSSGRIVNVSSGFGLLRNFTSEDLRKEFDDIDSLTEKRLEELLDLFLDDFKVNLIEAHGWPTGGSSAYKVAKAALNAYTRILAKKSPTLRINCLTPGYVKTDISMHMGVLTPEEGASNSVKVALLPDDGPTGAYFDWNGEASFV

SEQ ID NO: 10892 - protein, 471 aa, Solibacter usitatus Ellin6076
MARLTAPFYGAFECVDDLWIGEFHRVSQKLRQTSLTWVGIFHNENAASVAISFAGILKLSIRNAHGLAVRLPLKYPRRVSTTAAAFRNRFRSQRISRFTESVIREMSRLAIRHGATNLAQGFPDFPAPEALKRAAAEAIDSDINQYAITWGAKPFRDAIAAKYQRTYGMEFDPEREITVCCGATEGMVASLLAVVDPGDEIVLFEPFYENYGPDSQLCGAVPRYVKLQAPDWNFDPDELRAAFGPRTKAIILNSPNNPTGKVFTRQELEFIAGLCQEFDVLAITDEIYEHILYDGAVHIPIMSLPGMRDRSILVNSMSKTYSVTGWRVGWVLASPDLTDSIRKVHDFLTVGAAAPLQQAGVLALSLPEDYYEHLSTEYSGRRDHIVESLEAVGFKCFVPHGAYYVMTDVSGFGFSDDTSFVRHLITNLGVAAVPGSSFYAHPATGSQQVRFCFCKKYETLELARSKFLKLQ

SEQ ID NO: 10893 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLISYISKVDAQ

SEQ ID NO: 10894 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 10895 - protein, 380 aa, Thermobifida fusca YX
MKAVVYKEPFTVAVEEVADPRIEDPNDVIIRVTTSAICGSDLHMYEGRTGATPGMVFGHENMGIVEEVGSGVASIRKGDRVVLPFNVACGFCKNCLAGKTGFCLTVNPGFAGGAYGYVAMGPYQGGQSEYLRVPFADFNCLKLPPGTEFEDDFALLADIFPTGYHATELAQVSPGETVSVFGAGPVGLMAAYSAILRGASRVFVVDRVPSRLSLAERIGAIPIDYSKGDPVAQIKEHTNGEGTDKGIDAVGYQATAPEGEEQPALVLNTLVDTVRPTGALGVVGLYVTEDPGAPSESAKQGELLFAMGKLFEKGQRMGTGQANVKAYNRQLRDLIIAGRAKPSFVVSQRIPLQRAPEAYEKFDKREEGWTKVLLKPQQES

SEQ ID NO: 10896 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNAPCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 10897 - protein, 765 aa, Synechococcus elongatus PCC 7942
MSTYQQQHVKVVCYLSAEFLMGRHLENCLINLHLHDRVQQVLDELGLDFEQLLEKEEEPGLGNGGLGRLAACFLDSMATLDIPAVGYGIRYEFGIFHQELHNGWQIEIPDNWLRFGNPWELERREQAVEIKLGGHTEAYHDARGRYCVSWIPDRVIRAIPYDTPVPGYDTNNVSMLRLWKAEGTTELNLEAFNSGNYDDAVADKMSSETISKVLYPNDNTPQGRELRLEQQYFFVSASLQDIIRRHLMNHGHLERLHEAIAVQLNDTHPSVAVPELMRLLIDEHHLTWDNAWTITQRTFAYTNHTLLPEALERWPVGMFQRTLPRLMEIIYEINWRFLANVRAWYPGDDTRARRLSLIEEGAEPQVRMAHLACVGSHAINGVAALHTQLLKQETLRDFYELWPEKFFNMTNGVTPRRWLLQSNPRLANLISDRIGNDWIHDLRQLRRLEDSVNDREFLQRWAEVKHQNKVDLSRYIYQQTRIEVDPHSLFDVQVKRIHEYKRQLLAVMHIVTLYNWLKHNPQLNLVPRTFIFAGKAAPGYYRAKQIVKLINAVGSIINHDPDVQGRLKVVFLPNFNVSLGQRIYPAADLSEQISTAGKEASGTGNMKFTMNGALTIGTYDGANIEIREEVGPENFFLFGLRAEDIARRQSRGYRPVEFWSSNAELRAVLDRFSSGHFTPDQPNLFQDLVSDLLQRDEYMLMADYQSYIDCQREAAAAYRDSDRWWRMSLLNTARSGKFSSDRTIADYSEQIWEVKPVPVSLSTSF

SEQ ID NO: 10898 - protein, 1029 aa, Oryza sativa (japonica cultivar-group)
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 10899 - protein, 369 aa, Vibrio fischeri
MAISSAKDIIEDIRLGKMVILMDDEDRENEGDLIIAAEKITPEAINFMATHGRGLICLTMTKDRCEKLGLPPMVQDNNAQFTTNFTVSIEAAEGVTTGISAADRSRTVEAAVAKNAVAADLVQPGHIFPLAAQEGGVLTRAGHTEAGCDLARLAGYEPAGVIVEILNDDGTMARRPDLEIFAEKHGIKLGTIADLIEYRNNNETTIERVAECKLPTEFGEFDLVTYRDTIDNQLHYALKKENTSSEAPLVRVHLQDTFTDILHSDRCAERSWTLPTAMQRIANEGGVLVILGNEESTDNIVHKVKVLERQDSGEAPTMAKKQGTSRRVGVGSQILADIGISDMRLLSSTSKRYHALSGFGLNVVEYVTK

SEQ ID NO: 10900 - protein, 294 aa, Citrobacter freundii
IVFRAAQERSDIEIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 10901 - protein, 482 aa, Bacteroides fragilis NCTC 9343
MNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICVIAALFVWRWVPETKGKTLEDMSKLWKKR

SEQ ID NO: 10902 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 10903 - protein, 359 aa, Zea mays
  misc_feature (325)..(325): Xaa can be any naturally occurring amino acid
  unsure (1)..(359): unsure at all Xaa locations
MAASEGVLLGMGNPLLDISAVVDDAFLAKYDIKLNNAILAEEKHSPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAAXVIIQRPADLPGEPASTSAKIRPVIKGAVIGPLYC

SEQ ID NO: 10904 - protein, 137 aa, Oryza sativa
  misc_feature (21)..(21): Xaa can be any naturally occurring amino acid
  misc_feature (52)..(52): Xaa can be any naturally occurring amino acid
  misc_feature (109)..(109): Xaa can be any naturally occurring amino acid
  unsure (1)..(137): unsure at all Xaa locations
VQRGLNGEVFGRLENKGFCLXASKLITVEKSFPEKHYPYLSSKTFFGGFVKXMVSGPVVPMVWKGKKVVSSGRKLVGTTNPLGAEPGTILGELAVDIGRKVIHGRFSVXNASKKTALWFLKGIAEWRSKQHPWIYEV

SEQ ID NO: 10905 - protein, 319 aa, Shewanella oneidensis MR-1
MSDNWVRKRQILGLLSNEHFVSGEELATQLGISRAAVSKHVDTLEDYGVAIFSVKGRGYKLANPISLIDSSRLIQAIDNRCFYFDEIPSTNGFMLGHTSELKSGDLCVAEYQSAGRGRRGRTWVSPYGHHLYFSQFWSFPQGMAQAMGLSLVVACSLVEVLKSFGVENVGVKWPNDIYLNFKKLAGILIEMSGQADSECQLIIGIGVNMAMSEGQGKGIDQPWSDLSGLTCIPNKTDLVIALHKQLKRDIQLFEREGLVAFKTRWQEADLFHGKEIRLLMGENHLDGICRGIDEQGAVLLENADGIQAYIGGEISLRPI

SEQ ID NO: 10906 - protein, 238 aa, Zea mays
FLGFIIVCKRAIVLDEMKSAVFSAAVVSIGYALLGWDFAALSEANHHMEKEFELLNGPSIEGITLAASTFGAIVITIFSGALLDWLGRRVILVYSSLVLFSGGVLMLWSPNIYIVLLARLIVGSGSGLVFTCVPIYISETSPSNMRGLLGTMPQFMFFIGTIFSYCLIFWLTLMSSPSWRIMIGAIFAPSIVYFALLVYYLPESPRWLASDGKISEARVSLQWLRGKKHDVSGEIVAT

SEQ ID NO: 10907 - protein, 412 aa, Burkholderia vietnamiensis G4
MKPIQKSNKLLNVCYDIRGPVLEHAKRLEEEGHRIIKLNIGNLAPFGFDAPDEIIQDMIRNLPASSGYSDSKGVFSARKAVMHYTQQKGVVGVGLDDIYIGNGASELIVMATQALLNDGDEVLLPAPDYPLWTAAVSLSGGTPVHYVCDEQNAWMPDPDDIRRKITPNTKALVVINPNNPTGALYSDELLLELLEIARQHGLIVFADEVYDKIVYDGLEHTALGSLSEDVITVTFNSLSKSYRSCGYRAGWMSVSGLGGDNRRRANDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWAQPDHFRVVFLPNLDDLADSISRIARFLDGYRKRHSV

SEQ ID NO: 10908 - protein, 414 aa, Geobacter metallireducens GS-15
MGATTEQSNGNILIIEDSPTQSAQLRHIMETNGYHVISACNGREALALLSGQTPSLIISDVIMPGIDGYELCRRIKEREDSRNIPVILLTSLSDPHDVIRGLECGADNFITKPCNEKHLLSRVSYLLESRNPCQIEARSGLEILFGGERYCITADRRQILDLLLCTYETAIQKNDALIRAQDELSRLNQQLETTNRELEAFNYTVSHDLRSPLTNISGYCQVLQELHGDTLDPTCQDYIQEIYRATMRMNDLIGDLMEFSRLNHQELQRQEVNLSTMARIIAVELKSKDRERRVEFRIADGIVGNGDSRLLQLVLVNLLGNAWKYTGKKENAVIEFGVTNTEGKEVYFVRDNGAGFDMAEAHRLFGTFQRLHSKQEFEGTGIGLATVQRIIQRHGGSIRGEGEVGKGATFYFTL

SEQ ID NO: 10909 - protein, 294 aa, Enterobacter aerogenes
IVFRAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNRSCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 10910 - protein, 294 aa, Escherichia blattae
IVFRAAQERSDIEIVAINDLLDAEYMAYMLKYDSTHGRFNGTVEVKDGHLIVNGKKIRVTAERDPANLKWNEAGVEVVAEATGLFLTDETARKHITAGAKKVVMTGPSKDSTPMFVRGANFDTYAGQDIVSNASCTTNCLAPLAKVVNDNFGIVEALMTTVHATTATQKTVDGPSHKDWRGGRGASQNIIPSSTGAAKAVGKVLPELNGKLTGMAFRVPTPNVSVVDLTVRLAKPATYEEIKKAMKAASEGAMKGVLGYTEDDVVSTDFNGETCTSVFDAKAGIALNDNFVKLV

SEQ ID NO: 10911 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 10912 - protein, 294 aa, Escherichia hermannii
IVFRAAQTRSDIEIVAINDLLDAEYMAYMLKYDSTHGRFDGTVEVKDGHLVVNGKKIRVTAEKDPANLKWNEVGVDVVAEATGIFLTDETARKHITAGAKKVVLTGPSKDDTPMFVKGANFDKYNGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEDIKKAIKAAAEGEMKGVLGYTEDDVVSTDFNGEVCTSVFDAKAGIALNDNFVKLV

SEQ ID NO: 10913 - protein, 259 aa, Helianthus annuus
MAAASSPREENVYLAKLAEQAERYEEMVEFMEKVVAAADGGEELTIEERNLLSVAYKNVIGARRASWRIISSIEQKEESRGNEGHVSTIRDYRSKIESELSSICDGILKVLDSKLIGSASGGDSKVFYLKMKGDYYRYLAEFKTGDERKLAAENTLSAYKAAQDIANAELAPTHPIRLGLALNFSVFYYEILNSPDRACNLAKQAFDEAIAELDTLGEDSYKDSTLIMQLLRDNLTLWTSDMQDDTAEEVKEAPKPDDQ

SEQ ID NO: 10914 - protein, 303 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 10915 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 10916 - protein, 306 aa, Porphyromonas gingivalis W83
MTKVLVATEKPFAKVAVDGIKRIIEEAGLEFALLEKYTDKKQLLDAVKDANAIIIRSDQIDAEVLDAAKELKIVVRAGAGYDNVDLAAATAHNVCVMNTPGQNSNAVAELVMGMLVFMYRNLFNGASGSELMGKKLGILAYGNVGRNVARIAKGFGMEIYAYDQFVSAADIEKEGVKAVASRDALFETCDIVSLHIPKTPETVKSINAELLSKMPKGACLINTARQEVIDEEGICKFMAERTDFKYATDIKPTNDAEMAKFEGRYFTTPKKMGAQTAEANINAGLAAARQIVDFIKNGNEKFRVNK

SEQ ID NO: 10917 - protein, 178 aa, Oryza sativa
MFASRPAVHPVEAPPPPDPAEQPRGVLMKDLPGMPGTAGGLGLRLAQFAFAAVALAVMASTNDFPSVTSFCFLVAAAILQCLWSFSLAIVDIYALLVKRCLRNRRAVCLFAIGDGITAALTFSAACASSGITVLIDNDLDLCSENHCASFESATAMAFLSWFALSPSFLLNFWSMASG

SEQ ID NO: 10918 - protein, 113 aa, Glycine max
  misc_feature (28)..(28): Xaa can be any naturally occurring amino acid
  unsure (1)..(113): unsure at all Xaa locations
MASSMIWSAAVTTVNRAGAGMVAPFTGXLKSLLGFPTGRPTIAFTSMVGTVGGVHCLQVWPPIARKKFGTLSYLPDLDDAQLAKEVEYLLRKGWIPRLEFELEHGFVYREHNR

SEQ ID NO: 10919 - protein, 685 aa, Zea mays
MAPPFACAMHGRALLAAAAAALLASAVTLTLLPSAAAQPWVGPWPTCDDTTGNYSAGSAYAKNIKQLILSLQANASNTPALFATGSAGAGADAVYGLILCRGDLSPTDCFDCGTNAGQDVYRVCNGTRDAALVYNQCYVRLAPTDFLATTNNTGMRDLINGNSVPAGVNVTAYDGAITRLLNATARYAVDSSAPSLSPRKYFATGQMAGVDPRFPTGIWSMAQCAGDISPVQCRSCLDDLLAQWWQKFDSKEIGARLDGSRCNLRFETGNFYTGSPMVKLQMNGEEAAPAPVPSTDVLPGTTGGKKNSVGKLLGIILPIVFVAAIAAIALCIWIVRKKRTYQGTNLPQTDTTYMAEDIESIKSILLSLPSLQAATNNFDESNKLGEGGFGTVYKGNLSGQEVAVKRLPKGLDQGLEELKNELGLMAKLHHRNLVRLEGFCLEEGERLLVYEYMPNKSLDNILFDHEKKRQLDWRKRFNIIEGVARGLQYLHEDSQNKIVHRDLKASNILLDSNMNPKIGDFGLARLFLQDQTRGITNHIVGTFGYMSPEYVMRGQYSIKSDVFSFGILVIEIVTGQKNNGHYFDEQNEDVVSIVWKHWSEGTLAEIIDDSLGRNYSETEVLKCVNIGLWCLQQNPMDRPTMSDVMVMLNDDDTSSLPAAAKPTFFLDASSGYSYTSGTISHPSAR

SEQ ID NO: 10920 - protein, 158 aa, Zea mays
  misc_feature (85)..(85): Xaa can be any naturally occurring amino acid
  misc_feature (139)..(139): Xaa can be any naturally occurring amino acid
  unsure (1)..(158): unsure at all Xaa locations
MGSSPGSTAADKTRPSNKCQRPLAVAAMESTFIMIKPDGVQRGLIGEIISRFEKKGFYLKALKLVNVHNDAAWRHRTVFIQFSIXEMGIIMKDFDQPGHLLPTVLVLYPTNYMVIQGECDAVMRGKKASCPITVKKTGXSSAVVIYVELMTPVECTLL

SEQ ID NO: 10921 - protein, 444 aa, Bacillus subtilis
MAKYTREDIVKLVKEENVKYIRLQFTDILGTIKNVEIPVSQLEKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKDGVNAFYDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 10922 - protein, 454 aa, Oryza sativa
MNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 10923 - protein, 497 aa, Ozonium sp. BT2
MDSFIFLRSIGTKFGQLESSPAILSLTLAPILAIILLLLFRYNHRSSVKLPPGKLGLPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSSSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGGHVTPYTYVPFGGGLRTCPGWEFSKIEILLFVHHFVKNFSSYIPVDPNEKVLSDPLPPLPANGFSIKLFPRS

SEQ ID NO: 10924 - protein, 476 aa, Prochlorococcus marinus str. MIT 9312
MEKLKLQPVILCGGSGSRLWPLSRESFPKQFLKLVGNNNQSLLQNTILRLKKLKNIESPILICNEKHRFIVAEQLREINVKPKSIILEPEAKNTAPAVAVGAIRSKNDLKDSILFVLAADHSIQNVDKYVEVVKQGYEVACKGKLVTFGIIPTSPETGFGYIESAEKLTTDIKSSSIIRFIEKPDIKLARKLILDKHFSWNSGMFMFKASNIIGEFTKYAPKILESCHKSLEFAESDLDFLRLNENYFSKCQEISIDNAIMEKTSFGSVLPLSAGWSDIGSWQALWENEEKDKNGNFISGKVISNNIKNCYVRSENRIIACLGVEDLIIIETSDSILVSTKSDSQKIKSIVKSLNENGYQEAKSHKQAYRPWGNYISIAQDKRWQVKKITVNPGSSLSLQMHHHRSEHWIVVKGTALVQIDESKKLLSENESVYIPLGSKHRLSNPGKLDLILIEVQSGSYLGEDDIYRFKDNYGR

SEQ ID NO: 10925 - protein, 93 aa, Zea mays
ERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 10926 - protein, 164 aa, Zea mays
MSAVNITNVAVLDNPTAFINPFQFEISYECLVPLDDDLEWKLIYVGSAEDENYDQQLESVLVGPVNVGTYRFVLQEFMRVGYYVNNDYGDEQLREEPPAKVLIDRVQRNILADKPRVTKFPINFHPEPSTGTGRQQQQQEPQTASPEKHAGSGEGNGSKPEADQ

SEQ ID NO: 10927 - protein, 297 aa, Glycine max
MSLSLLRIYSSPHLLSSSLFFPTPPLSSFLPKLPNAPRTPHIVLCHRRDASSASKQRVPEDTEYEQPMRTSYDDDEEEEEEFLGSLVLPERWDVLGLGQAMVDFSGMVDDNFLKNLGLEKGTRKVVNHEERGRVLQAMDGCSYKAAAGGSLSNTLVALARLASRSQKVPAINVAMTGSVGSDLLGGFYREKLRRANVQFLSAPMKDGTTGTVIVLTTPDAQRTMLAYQGTSSTVNYDASLASAVSKTNILVVEGYLFELPDTIKAITKACEKARTNGALVAITASDVSCIERHFDDF

SEQ ID NO: 10928 - protein, 286 aa, Arabidopsis thaliana
MLSFHLSPLFHFQASQRFGEKKPWTLMLRVAWFYMSPYLSSTHDVVSHNFSEIPVGSVCVSDIQLKGRGRTKNVWESPKGCLMYSFTLEMEDGRVVPLIQYVVSLAVTEAVKDVCDKKGLSYIDVKIKWPNDLYLNGLKIGGILCTSTYRSRKFLVSVGVGLNVDNEQPTTCLNAVLKDVCPPSNLLKREEILGAFFNKFENFFDLFMEQGFKSLEELYYRTWLHSGQKVIAEEKNEDQVVQNVVTIQGLTSSGYLLAIGDDNIMYELHPDGNSFDFFKGLVRRKL

SEQ ID NO: 10929 - protein, 128 aa, Arabidopsis thaliana
  misc_feature (91)..(91): Xaa can be any naturally occurring amino acid
  misc_feature (98)..(98): Xaa can be any naturally occurring amino acid
  misc_feature (100)..(100): Xaa can be any naturally occurring amino acid
  unsure (1)..(128): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRXKWIPCVXFXEFEHGFCVVSTGNTLGTFTYDKCGKALE

SEQ ID NO: 10930 - protein, 352 aa, Methanosarcina barkeri str. fusaro
MKGFAMLEIGKVGWIDTERPSAGPYDAIVRPIAVAPCTSDVHTVWEGALGNRKNMILGHEAVGVIEETGSEVKDFKPGDKVIVPAITPDWRSIEAQDGMPMHSNGMLSGWKFSNFKSGVFAEFFHVNDADMNLALLPKGMPLEQAVMLSDMATTGIQGAEMAKIKMGSTVAVIGIGPVGLMAVAGATILGAGRLIAVGSRKVCVDLALEYGASEIVDYRKGGLVEQILEKTNGKGVDSVIIAGGNENTISDAVKIVKPGGTVSNVNYYGTGDILPIPRIEWGSGMSQKDIRGGLTTGGRLRMERMADLCTYGRIKPEKMATHVFKGFDKMEEALMLMKEKPRDLIKPVVLLD

SEQ ID NO: 10931 - protein, 116 aa, Zea mays
  misc_feature (43)..(43): Xaa can be any naturally occurring amino acid
  misc_feature (73)..(73): Xaa can be any naturally occurring amino acid
  unsure (1)..(116): unsure at all Xaa locations
MECTSVMIMPDCGHRGLIGQTINRGEQKGYYLKVLELVNVERXFAHKHYSGLASKTFYQGLVDYMMSGPLVAXMVWAGKIVAQLAHRSVALLTLWVLSLGNIRGDSAGYIGLNDNH

SEQ ID NO: 10932 - protein, 426 aa, Escherichia coli
MRKSENLYQAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 10933 - protein, 717 aa, Cryptococcus neoformans var. neoformans
MGKGKNHDRKANPGFGKVKSKSGTSTGEFTLKRVKGENFYRDAKSAARVKMLNGGKAVRDRDGKIVEAAAFQKGEKDAEPGRVKPDRRWFGNTRVISQSALDHFRTALKEQKTDPYSVLLKRNKLPMGLLQDDTKDGGRRPHIVETEPFGNTFGPKAQRKRPKLDIGSIEELGESSAAAAAETAAATAESQGSGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKIWQYITLMRRIYLIDCPGIVPVSAKDSDTDTVLKGVVRVENLATPAEHIPALLERVRPEYLERTYGLERVEGGWHGEEGATVILTAIAKKSGKLLKGGEPDQEAAAKMVLNDWIRGKIPFFVAPPSKPEPGAASAHASSATATATTEADKKAEEAQEQKELAEEKETKEMLEEQERSLGKVLGIKRVKGVEQPISKIVTMAKFLGDDARRYVEEEEEASVDDEDREMAEEEEEESGEDQEEEELAWDDVFPEEAAGGDAADGEEVVEEEEEEDDEEDEDVPSAKQLGKRKAIDSDEEEQTATKAKRMTTSKQKASNFYTHANVKNRNRDRKVPKNPGKRSRGDDEPTGKKAKKRR

SEQ ID NO: 10934 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 10935 - protein, 329 aa, Zea mays
MTVDRLSHQSPVKNPHQISSSQPPIFGHVVVSVAFPALIAAPLLRHPLLQEASVLAPRLHLDRQGSVAAAAEVSAARVRPSAAEVARTVVELAPSGTLSVVGPDGWPLGIGARFVADAVGAPALCLATTGVSAPDAPCSFHVEFWQSGARTPQCTMLGTLTKPTDESVLKKLSTRQERKFGEEINQDLLYLISVQRVLHMEDFNEDGMWVVPSEYTSAEPDPLRNFAENIVEEFNSKHAEDVHRIYNIYVESDLQVADVKMIWVDRLGFDLHVHSGDGVFDVRVPFSREVSDEKGVKSSFNMMSHHSWEVERSYAGPEFEKVQFLKKVR

SEQ ID NO: 10936 - protein, 346 aa, Neisseria meningitidis Z2491
MQAVVVNKNVAGDVEVVEREVRPLEYGEALVEVEYCGVCHTDLHVAAGDYGEKPGRVLGHEGIGLVKEVADGVKHLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHR

SEQ ID NO: 10937 - protein, 175 aa, Triticum aestivum
MAPTVMASSATSVAPFQGLKSTAGLPVSRRSNGASLGSVSNGGRIRCMQVWPIEGIKKCETLSYLPPLNTEALLKQVDYLIRSKWVPCLEYSKVGFIFREHNTSPGYYDGRYWTMWKLPMFGCTDATQVINEVEEVNKEYPDAYVRIIGFDNMRQVQCVSFIAFKPPGCEESGKA

SEQ ID NO: 10938 - protein, 399 aa, uncultured archaeon
MFFFIWEESVKMLSKRLSRIEESATIKMGQIAKKLQEEGKEVLSFTLGEPDFKTPEHICEAAKHALDLGYTHYTSSAGIDELREKIAKKTTEENKVDCAMENVIVTPGAKQAIYELMMSVLDYGDEVILLDPAWVTFEAAVKLAGGTPKWVKRIEEEVKYESLEAASSENTKLIVINSPNNPAGYVLSENELKEIAEFAVEHDLLVLSDEIYEKILYGRRHISIASFDSMQERTVIINGLSKTYAMTGWRIGYAVAPTAIQKGMLKIQQHSVSCASSIAQYAALAAFEESQECVNEMVAEFERRRDVIVKRLNNVGLRCLDPEGAFYAFVNTSNYGNGAEFTERLLKDAYVVVTPGSAFGAAGKDYIRFSFAASMENILAGMDRIEAMCTLPSSSKYSR

SEQ ID NO: 10939 - protein, 293 aa, Crocosphaera watsonii WH 8501
MAKIRVGINGFGRIGRLVFRAGINNPDFEFVGINDLVPAKNIAYLLKYDSTHGRFDGTVEATDEGIVVNGKLIPCFAIRNPEELPWGQLEVDYVVESTGLFTTHETASKHLKAGAKRVVISAPTKDPEKVNTFVVGVNDDQYDPTKDYIVSNASCTTNCLAPIAKVINDNFGLAEGLMTTVHAMTATQPTVDGPSKKDLRGGRGAAQNIIPASTGAAKAVTLVIPELKGKLTGMALRVPTPDVSVVDLTFKTEKATSYEAICAAMKAAANGELKGVLGYTDEDVVSMDFNGRS

SEQ ID NO: 10940 - protein, 175 aa, Glycine max
  misc_feature (84)..(84): Xaa can be any naturally occurring amino acid
  unsure (1)..(175): unsure at all Xaa locations
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 10941 - protein, 293 aa, Tropheryma whipplei TW08/27
MLPKRAYPVQDSNVHSQEKKIIAGNWKMNINHSQAVSYLQELNWRLIDNGHDFDACEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 10942 - protein, 141 aa, Triticum aestivum
  misc_feature (58)..(58): Xaa can be any naturally occurring amino acid
  misc_feature (69)..(69): Xaa can be any naturally occurring amino acid
  misc_feature (91)..(91): Xaa can be any naturally occurring amino acid
  misc_feature (111)..(111): Xaa can be any naturally occurring amino acid
  misc_feature (117)..(117): Xaa can be any naturally occurring amino acid
  misc_feature (128)..(128): Xaa can be any naturally occurring amino acid
  misc_feature (131)..(131): Xaa can be any naturally occurring amino acid
  unsure (1)..(141): unsure at all Xaa locations
MAPTVMASSATSVAPFQGLKSTAGLPVSRRSNGASLGSVSNGGRIRCMQVWPIEGIKXFETLSYLPPLXSTEALLKQVDYLIRSKWVPCLXSTSWVHLPVEHNASPGYYDXRYWTMXELLCFGCTDAXQVXNEVEEVKKDT

SEQ ID NO: 10943 - protein, 585 aa, Bacillus thuringiensis serovar konkukian str. 97-27
MRKTKIVCTIGPASESIEKLEQLIEAGMNVARLNFSHGSHEEHGARIKNIREASKKTGKTVGILLDTKGPEIRTHDFVDGQAELVTGAEVVLSTEQVLGTAEKFSVSYAGLYDDVDPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 10944 - protein, 457 aa, Glycine max
MDPCPFSRLTVRNLALKIPVASKPARSVVHPSSSPCFCKIQLKNFPLQSAVVPFIPPDSLFPDSLVHPIAATFHLSKSDLDKLAGKSIFSAKLCLKISIYTGRRGSTCGVSSGRLLGRVSVPLDLTGTVAKTTVFHNGWIRIGKDAKGSSAQFHLNVKAEPDPRFVFQFDGEPECSPQVFQIQGNISQPVFTCKFSFRNNGDRNHRSRSLQSEPGGSRSWLSSFGSERERPGKERKGWSITVHDLSGSPVAAASMVTPFVASPGSDRVSCSNPGSWLILRPSDGTWKPWGRLEAWRERGGSDGLGYRFELIPDTNGGMSAAGIVLAESTLSSNKGGKFVIDLSCRNAVNGSGNGGSNGRATPGSATSPACSPRSSGDYGYGLWPYCMYRGFVMSASVEGEGRCSKPTVEVSVPHVNCTEDAAAFVALAAAVDLSVDACRLFSQRLRKELCQQLDLLG

SEQ ID NO: 10945 - protein, 284 aa, Crocosphaera watsonii WH 8501
MTNTSNLSEKIAKFYDTSSNLWEKTWGEHMHHGYYGRGGNYKLDRRQAQINLIEELLIWADIKEVSNLVDVGCGIGGSTLYLAERFNTKATGITLSSVQANRATERASEFKLEETVQFQVADALNMPFPEDNFDLVWSLESGEHMPDKKKFFQECYRVLKPGGTFLCVTWCHRPTNSWAGELTEEEKQHLEEIYRVYCLPYVLSLPEYETIAQDCGFSNIKIDDWSMEVAPFWDIVIDSALNLETIAGLLNSGWQTVQGALSLGLMSRGYERGLIRFGLIYGQK

SEQ ID NO: 10946 - protein, 304 aa, Thermoplasma volcanium GSS1
MLPNFLPVGEIRKLAASVLPDINIITDLDFKSDESDILIVTAFTKVDKALLDKFPRLKFIQVASTGYDNVDVTEVKSRNILMCNSPSSNKESVAEHVIGMALYFLKDFGHLDREIRNGNWPILTFSRDLMGKVFGIIGMGAIGRKLAERLIQFGVGIIYYDVKRLPEEVEDELGITYVTLDELISSADIISIHVPLTETTKGMIGRKEFEKMKDGCIFINTSRAEVVVTKDLVWALKQGKIKAGIDVYDREPPDFSSELFQMDNALFSPHIAGVTVESQRRFIEETVANVIRYMQGVDPLNRVL

SEQ ID NO: 10947 - protein, 968 aa, Prochlorococcus marinus str. NATL2A
MSKAELKDFTFKSRHIGPTNEDEALMLQHLGYENAEEFISSVIPNEIFDSENNGVSIPDGCDQNKALTEINIISKKNVEHRSLIGLGYHSTVIPPVIQRNVLENPNWYTAYTPYQAEISQGRLEALFNFQTLISELTGLPISNASLLDEATAAAEAISLSLTVRKNKNANKFLVDQEILPQTLDVLKTRCEPLGISLEMFDNNNFEIDKNVFGILIQLPGKNGRIWDPTKIINDAHKCNAIVTIAIDPLAQVLIKPMGEFGADIVVGSAQRFGVPIAFGGPHAAFFATKEIYKRQIPGRIVGQSVDVEGNQALRLALQTREQHIRRDKATSNICTAQVLLAVLSSFYAVHHGPKGLKQIAENVVKYRSNFESILMNLEYPIEKYSAFDSVDVYCSEASEVIQLASEEGYNLRVLPIGSDFENAKGFGVTFDELTCDEEIYKLHQILAQVKGKKTHDLSNFIFENASLIDIPLREKSWLEQSVFNQYQSETDLMRYIHCLVSKDFSLVQGMIPLGSCTMKLNAAAELLPIEWREFSSIHPFAPHTQLTGFHEIINDLENWLSALTGFQGVSLQPNAGSQGEFAGLLVIRSWHQSLGEGHRNICLIPTSAHGTNPASAVMSGFKVVSVKCDEYGNVDLEDLKNKSKIHSKNLAALMVTYPSTHGVFEPNIREMCQVIHQEGGQVYLDGANLNAQVGICRPGSYGIDVCHLNLHKTFSIPHGGGGPGVGPIAVADHLVPYLPGHSIIKCGGQKAISAVSAAPFGSAGILPISWMYIRMMGSDGLRKASSIAILSANYLAKRLDPYYPVLFKDPNGLVAHECILDLRPLKSQLGIEVEDVAKRLMDYGFHAPTISWPVAGTLMVEPTESESLPELDRFCDAMIGIREEIEQIKLGKIDPINNPLKQSPHTLKTVTSDDWDRPYSRKEAAYPLPDQEKYKFWPSVSRINNAYGDRNLICSCPSVQDLEDINSV

SEQ ID NO: 10948 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 10949 - protein, 436 aa, Ralstonia metallidurans CH34
MGLLDDRKSGLLPGGHAAFERIDLTVPGFLQGCLSLARALAVLAYHDDGDGLILCKTARPVGQVVEWRALRLRHVALGELGSVADIHHHRIALVDQLRGGGRIDAFSARAALDRRPGQQAARDHGDGDQGQVIVIGEEIHVGIPLGWVGGIIKYAVSCPRRYLSVASRPPPALRRIVRTAGHLLPGSSMYKLVLIRHGESTWNLENRFTGWVDVDLTDTGAAQAKQAGTLLKEAGFAFDVAYTSVLKRAIRTLWHVQDEMDLMWIPVRNEWRLNERHYGALAGLNKAETAKKYGDEQVLVWRRSYDTPPPALEPTDERASFGDPRYANVPRAEIPLTECLKDTVARVMPLWNESIAPDIKSGKRVVIAAHGNSIRALVKYLDQISDDDIVGLNIPNGTPLVYELDADLRPLRHYYLGDQEAIAASLAAVASQGKAR

SEQ ID NO: 10950 - protein, 320 aa, Burkholderia xenovorans LB400
MTTQQQPLISGFGVETQPEEVMAGIDLHGKVAIVTGGHSGIGLETTKALVKAGAKVVVGARGVDKAMESLAGLENVDVVELNLADPDSVDNFATSYLRTHNSCDILVNNAGIMATPLTRDSRGYELQFATNHLGHFQLTVQLWDALAVAGSARVVALSSLGHRFSAINFDDLNYLTRPYDPWRAYGQSKTANALFAVHLDRLGKGAGIRGFAVHPGRIPTTNLSRHMTDEEKKAATQAVQVGPDYVPSPLKSIAQGASTSLWAATSAQLSGKGGVYCADCDISPIVADDSPDVRGVRRWAIDPDQAVRLWDVSLDLVARR

SEQ ID NO: 10951 - protein, 458 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGI

SEQ ID NO: 10952 - protein, 432 aa, Ashbya gossypii ATCC 10895
MITTQSTVQNTASKRRESVHKNVYDHLVLKVPEAPVTPPPRLIDAPLPWKATAGRIVPASLRKYLPEIDLKVTVTCLVWYVTSSVSSNLSKAILHEFPHPVGLTELQFLTNGLMCLGFLVLVNYLHRPSWKATWVSQNMRNFPDGILPPYLNGSFCECIQQRFLVVDRKAVIATLPMGMFQFMGHFTSYKATSLIPVSLVHSVKSLSPIVTLCWYRFAKKKQFHRITYCTMLPLVAGVILISSPSGGSKSVGASVEDLRLVLGLFFAAVSMAIFVSQNLFAKSILTVRKRELLPSQKSLAGLGGASPFQLDKITILFYCSCIGFLLMLPVFLVGEAFAASSVFADISLRVLCLMGVYGFTHFLQAMLAFQLIGMLSSVNYSIASIMKRVVVIGVALTWESQLSGRQLLGLVMTVIGLYGYDKWGNKTQPHPS

SEQ ID NO: 10953 - protein, 210 aa, Zea mays
  misc_feature (138)..(138): Xaa can be any naturally occurring amino acid
  unsure (1)..(210): unsure at all Xaa locations
YDVLRTAASSWIASSAYWLAEHPFIVLSRRSPTHLWFSTWAFLLGSLAAYVALCLALDVALALAAQRLRRRLAVPLGPVPAAHALLMAGASSAIFAGTLLSAVAEIRDTRWSWRRRSRSTPLRRLLCFPAGTRSSGRXVFFWAYAYYLSRYLHAARGVLAVLRRRRSAAPRVFAHAASVAMAFLWLEFSQSFQVLAILGSTLTHAVALGY

SEQ ID NO: 10954 - protein, 400 aa, Bradyrhizobium sp. BTAi1
MSFLAAALDRVKPSATIAVTDKARVLKAAGRNVIGLGAGEPDFDTPDNIKDAAIKAIQAGKTKYTAVDGIPELKEAIIGKFQRENGLTYKPNQVIVGVGGKQVLYNALMATINPGDQVIIPAPYWVSYPEMVALAGGEPVPVVCTAAHGFKLQPEALEKAITPKTKWLILCSPSNPTGAAYTKAELKALTEVLVKHPHVWIMTDDMYEHLVYDDFVFTTPAQVEPSLFDRTLTVNGVSKAYCMTGWRIGYAGGPANLIKAMATIQSQSTSNPCSIAQWAAVEALNGPQDFIPANNKVFKERRDLAVSMLNQASGIECPRPEGAFYVYPSCAGTIGKTAPSGKVIDNDETFVTELLETEGVAVVHGSAFGLGPAFRISYATKTSDLEEACKRIQRFCGNLR

SEQ ID NO: 10955 - protein, 493 aa, Ustilago maydis 521
MMNTKLKDLSLLEASDFLKAPDSLDTSDNESFDVMDPGSGRPICRLTASNLKDVDYAIQAASQAFPSYSAIPARERAMLLLNFDKLIRDNLDDLAWILVYETGKPLEEARAEVQYALTFSWWYVGETERVQGQVVKSATNPSLRYLTVWQPVGPVAILTPWNFPVALFVRKAVSALAAGCTIVAKPSPETPLSTLAVANLLHRAGFPSGSVNIVLASYRNTPAIGQALCTDLRIKKLSFTGSTRVGRLLMQQCAPTLKKLTLELGGLGAYLIFDDADIEAAATALVANKLRHAGQTCISAQRTFVHESIVDRVLKCIIELLDRVTLGHGAQPSTTLGPLQTERSQQKVREHIEDARAKGATVYTSKAAVPSSGYFVAPTLIVGCTAEMLVFQEESFGPLISLTSFATEQEAVALANKTDMGLTSYVFTKDSARLWRMFEQLKAGNVGLNVGGSTTAAEIPFGGVDQSGFGKEAGIGAGLKEYMVEKSATMSIA

SEQ ID NO: 10956 - protein, 404 aa, Zea mays
  misc_feature (261)..(261): Xaa can be any naturally occurring amino acid
  misc_feature (271)..(271): Xaa can be any naturally occurring amino acid
  misc_feature (286)..(286): Xaa can be any naturally occurring amino acid
  unsure (1)..(404): unsure at all Xaa locations
MPSPIAACFRCAAAPSSGAGAAGPSLTTSVYETHLGLVALSWSRTSLGLSLRAVLRLSPPPSPGFSSASGAGYLDDDADEETLAFRVRPWLLWRWRGSKRFRADDRIVDLAWDLSRARFPGSGSPEPSSGFFVAVIIDGEMVLAVGDLSDAAYRRTRARRPSGPRPVLLSRREHVSLRDAGAGRGRSHTTCVTVQGKEREISVDLVARGLGTDRVAAGREKAKDRADVGMSVSVDGERVLHVRRLRWKFRGSERVDLGGGXGVQVSWDLHXWLFRPREPGSAEASXTPTPTPVFVFRFDVSSGGEDLGKDPCPDNATGRNTDVVWGGYLARWRQRDWSETGSNAERRKGRGRRLAKESSSSSASVASSTASWASGSTVMDWGSPEEAEMQRGDGLTLLIYAWKS

SEQ ID NO: 10957 - protein, 494 aa, Anaplasma marginale str. St. Maries
MSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 10958 - protein, 576 aa, Medicago truncatula
MSQVRSIQTSFSRPTSGSTHDRSQTLLKPPSFSSKIFPPKSNNPPKLCFTTSPINARKSSSAEVVPVSPEDDSKIEEELQKLHVLQQVGNVSGGIWSKPMIKRKTNIVCTIGPSTNTKEMIWKLAEAGMNVARMNMSHGDHASHKKVIDLVKEYNAQSKDNVIAIMLDTKGPEVRSGDLPQPIMLKTGQEFTFTIQSGVGTADCVSVNYDDFVNDVEEGDMLLVDGGMMSFLVKSKTADSVKCEVIDGGELASRRHLNVRGKSATLPSITEKDWDDIKFGVDNEVDFYAVSFVKDAQVVHELKNYLKSCGADIHVIVKIESADSIPNLHSIITASDGAMVARGDLGAELPIEEVPLLQEEIIRICRSMGKAVIVATNMLESMIVHPTPTRAEVSDIAIAVREGSDGIMLSGETAHGKFPIKAAKVMHTVALRTEAALPNGQMPPNIGQVFKNHMSEMFAYHATMMSNTLGTSTVVFTRSGFMAILLSHYRPAGTIFAFTDQKRVQQRLALYQGVCPIYMEFSDDAEETFTKALDLLQKNGMVKEGEEVALVQSGRQPIWRFHSTHNIQVRTVAATN

SEQ ID NO: 10959 - protein, 264 aa, Nocardioides sp. JS614
MATSRTPLMAGNWKMNLNHQEAVVLVQKLAWTLADKKHDYARAEVVVVPPFTDLRSVQTLVDGDRLLVKYGAQDVSTHDGGAFTGEISAGMLAKLGCSYVVVGHSERREYHTEDDQEVNAKAHQALGAGMVPIVCVGEGLDVRQAGGQVAHCLAQVDGSLAGFTAEQIAGLVIAYEPIWAIGTGEVATPDDAQEVCAAIRERIREVHGDEAADGVRVLYGGSVKAANVAGIMAKDDVDGCLVGGASLQADEFGGICRFYDMPVI

SEQ ID NO: 10960 - protein, 392 aa, Prochlorococcus marinus str. MIT 9312
MSQVNLSERALSIEPSLTLQISAKANQLSAEGVDICNLSAGEPDFNAPKEVIEATSKAIFDGFTKYGPAAGNLDLRKAIANKLRIQNNLNYEFENVMVTNGAKQAIYNLFQVLLNIGDEVIIPSPYWLSYPQMVRLAGGKPIFTNSSAEDGFKIDIKDLKSKISSKTKFIIINSPNNPTGRVMSKEELLQIADIVRENPNINILSDEIYELILKKEFKHYSISSQANDLKDRIFIINGFAKGWAMTGWRIGYLVGPKDVIKASSALQSQSTSNVCSFVQKGALEALKINNEFFSMINSHYDQRRSLLYEGLKNINGIYIEEPNGAFYAFPRLPNSSITSVDFCNKALQDYGLVVVPGKAFGADECIRISCATSEIKIKDGLERFKKAISKYF

SEQ ID NO: 10961 - protein, 190 aa, Oryza sativa
MTIPRRRLFAATDEIFCLFQGTIENIAVLKQQYGLHNKGSTEINIIIEAYRTLRDRGPYPADQVVRDINGKFAFVLYDCSNNSVFMATDADGSVPFYWGVDPDSRLVVSDDDEIVNKACGKSSAPFPKGFFFTTSGGLQSYEHPMNEVKPVPRLDSKGEVCGTTYTVDAKAKKDSSIPRVGSAADWSSQY

SEQ ID NO: 10962 - protein, 471 aa, Tropheryma whipplei TW08/27
MRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVESVVRQVSLSWGVRCFLIERLHQTDQMMRKAEHVLLTNNLAEIGEKIVIISGSPVGVPGSTNHMRIHELGSTS

SEQ ID NO: 10963 - protein, 490 aa, Bordetella parapertussis
MTISPLQLLNDPSLLRTDALVDGRWIAASQRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLREPIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 10964 - protein, 456 aa, Streptococcus thermophilus LMG 18311
MVFIKETPIMAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFVSQWEIDNYLDLY

SEQ ID NO: 10965 - protein, 559 aa, Burkholderia thailandensis E264
MRIESFHIPGQTRMASAAGQPRVVFASVDADAWVRAADTIREAGGRLVTLWGGEPAAGRFEVCAAYELDDGLLWLRLPAEPAANEAREAGDAQEHDDAGERSGDYPDLSTIFAGAARMQRAIRDLVGLRARGAHDMRPWLDHGAWPRGYHPLRRRATGRERFEAATADYPFVPVAGDGVHEIAVGPIHAGVIEPGHFRFSVVGEKVLRLEERLGYAHRGIERLLERADALAGSRLAARIAGDSTVAFTWAYCMALEQAMKIRVPDRALRLRALLLERERVANHLGDLGALGNDAGFAVGLAHFSRLKEDWLRLSDRIFGHRHLMDRIVPGGVRHDLSADDAEAIVAQCDRIEHEVRAMQTIYDDQSGLQDRLAGTGLLTARTAAHFGVCGLVARASGQPRDVRADHRLAPYDAVPIDVASDARGDVAARVAVRFAETYESMRVIRALLAGLPGDGIAAEVALAANVPSNPAGAAEAHGEGHAGNAAPEARRGIGWVEGWRGPVLVALELDARGGVARCHCHDPSWHNWPALEHAIIGNIVADFPLINKSFNLNYAGHDL

SEQ ID NO: 10966 - protein, 105 aa, Magnetospirillum magnetotacticum MS-1
MRLLDATPELLAAHYAEHEGKPFFQPLVDFMLSGKILAVVAEGQGVVPGFRSLAGATNPTEALPGTIRGDLGRDWGLKVQQNLVHGSDSPESAAREIALWFPELG

SEQ ID NO: 10967 - protein, 399 aa, Thermus thermophilus HB8
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEATAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 10968 - protein, 900 aa, Ashbya gossypii ATCC 10895
MPPSPRPMLSTTTSNDLITGEQFRPRKLARRLTGFLPQEIKSIDSMIPLQSRELWKKHEVKKFGDSEEFQGKFIQHVETTLARSLYNCDEFAAYQAASESVRDNLVIDWNKTQQRITARDPKRVYYLSLEFLMGRALDNALINLNTSEEGDSTSREMVKASVEQLGFRLEDILEQEPDAGLGNGGLGRLAACFVDSLATGDYPAWGYGLRYQYGIFSQKIIDGHQVETPDYWLNFRNPWEIERSEIQVAVSFYGYVERAHGGSTLAPTEWIGGEQVLAVPYDMPVPGFNTSTVNNLRLWSAKPTTEFDFSKFNSGDYSNSVADQQRAESITAVLYPNDNFHSGKVLRLKQQYFWCAASLHDIVRRFKKTLRPWSEFPDQVAIQLNDTHPTLAIIELQRILVDLEHLDWHTAWDIVTKTFSYTNHTVMQEALEKWPVGLFGHLLPRHLEIVYDINWFFLQEVEKKFPKNVDLLARVSIIEESSPERQLRMAFLAIVGSHKVNGVAELHSELIKTTIFRDFVDIYGPSKFTNVTNGITPRRWLKQANPELAGLIADTLDDKDDSYLLEMSRLTKLANYADNPEFQRRWDDVKYHNKLRLANWLRDHNGGVDIIDRESIRDTLFDVQVKRIHEYKRQQLNVFGIIHRYLSIKDMLATGAALEEVRAAFPPRVCIFGGKAAPGYYMAKLIIRLINAVAAVINDDAAIGNLLKVVFIPDYNVSRAEIIIPASDLSEHISTAGTEASGTSNMKFVMNGGLIIGTVDGANVEITREIGEDNIFLFGNLAEDVEDLRYRHRYHRQELPAPIARVLETLSSGAFSPQDLREFQPLVDSVAQHGDYYLVSDDFDSYIACQALVDRVYHGDRRAWLQKSILSVANVGFFSSDRCIEEYAEMVWNVEAVKQE

SEQ ID NO: 10969 - protein, 448 aa, Streptococcus agalactiae A909
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 10970 - protein, 556 aa, Synechocystis sp. PCC 6803
MFDAIDAALADIKAGKAVVVVDDENRENEGDLICAAQFATPALVNFMAVEARGLICLAMTGDRLDELDLPLMVSKNTDSNQTAFTVSIDAAPHLGVTTGISAEDRARTIQIAINPVTRPEDLSRPGHIFPLRAKTGGVLKRAGHTEAAVDLSRLAGLYPAGVICEIQNADGSMARLPELVEYARKYDLKLISIADLISYRLQHDRFVQRETICEFPSQFGEFKLYAYRNLLDQTEHIAIVKGDPSEFGQQPVMVRMHSECLTGDALGSLRCDCRMQLQAALKMLENHGLGVVVYLRQEGRGIGLVNKLKAYSLQDLGYDTVEANERLGFPADLRDYGMGAQMLNDLGVKQIRLITNNPRKIAGLKGYGLEIVERVPLLIEANDYNSHYLTTKAEKLGHWLVKNYLLAIAIKFTPNVASAQQRYEKLEKIRALLQGTPLMVHEDNRPVAIALFGKNSLIFHVGLDQNLPSGQPWQKHDHSPYPALVKDFLVQLKQWPDLQALAFLIAQGKDPMETLQVSLDRENVSFADLTADALNQWQPQTVYTYSKQGSGEMTNR

SEQ ID NO: 10971 - protein, 564 aa, Cryptococcus neoformans var. neoformans JEC21
MQPPAIYNHHRLPPAGTPSQPSVLAQPSTARLNELFDLIRQEYETLGTDGNIWKQQRDEYEAKVQSQINELGMIRQSLYELEANHAKIRQEYETEIARLRRELESRGGPSSSAPSGAAAALNNPSSPSDLHRPGEDRPPFGMTLPGPTLNGLDAGRSRSPYPNPTAGPPILRPPSAADRDRERRITRPPQFNAPPSPPVHLSDLDPDNVSRELRKEGSDWQAMWSSQMRKQLDVTLVHTLEHETVVCCVKFSNDGKYLATGCNRTAQIYDVKTGARVSTLQDDLANRTGDLYIRSICFSPDGKFLATGAEDRQIRIWDLKQRRICHLLQGHMQEIYSLDFSRDGRFLVSGSGDKSARIWDVEKGTCVFNLQIEDFIHNEHGPIDAGITSVALSPDGKLVAAGSLDTMVRVWNVSTGQQVERLKGHKDSVYSVAFSPDGKCLVSGSLDRTLRIWDLTGTKREVESLPPGKEAQKNLGTCQSTLNGHKDYVLSVAISPDGQWVVSGSKDRSIQFWHISTGQAQLMLQGHKNSVISIDLARSGGYLASGSGDCMARIWKYEPIPGRD

SEQ ID NO: 10972 - protein, 588 aa, Candida albicans SC5314
MIEEDENTSLLSRRPSHSFLDTPIGSFKGPNSLHNFASSFTRAQSFAANKIDNSIHKKRSFFVSGDGGTVEDDETFDPELLVPSYRGERLSTVMHDIQSRNQLFMNPPNQLDQSVSPNNDVFFHDDVMNALNESRSRQNSTFGNSQFKHRIYSAPSFSSFRSSISAATTPSIFQVRKIEDEDGNVVTVLAGQSTAPQTIFNSVNVLIGVGLLALPVGLMKAGWVYGIPILLVCGLTTYWTACLLSKAMDTDDTIMTYADLGYAAYGSMAKLVISVLFSIDLLGAGVSLIVLFSDSLYALLGDDQVWTRTRFKILSFIVLTPFTFVPLPILSIISLFGILSTISITILVMVCGLLKPTAPGSLLETMPTNLYPKSLPDLLLAIGILMAPFGGHAIFPNLKSDMRHPYKFTQTLRSTYSITLLTDCSMAVLGFLMFGQNCSNEVTNTLLTTAGYPKWCYPLISGLICLVPLAKTPLNAKPIISTLDVLFGVANISTNKIRETVNSLGRFVIRIGVNAVFVVLAILFPEFDKIIGMLGASICFIICIILPCLFYVRLCGSKIRGFERFMVYSAIFISCVLASAATWAVLNY

SEQ ID NO: 10973 - protein, 245 aa, Hordeum vulgare
MAMRAISLCLILGLLAAAAPASATSFDFYYLILMWPGAYCADSDYGCCVPKYGYPAEDFFVEGFMTFDLSLNKAIVRCNSDKPFDVNKLEPIENNLNHYWSNIHCPRNDGTGTWKSEWRSYGVCSGLKLVDYFRAALNLRKKADVLGALAEQGINPDYRLYNTEHIKWAVNQKLGVMPGVQCRDGPFGKKQLYQIYLCVDKDGQIFIDCPKLPKLHCPEEVLFHPFHTWMLNATSPAKITLPTEA

SEQ ID NO: 10974 - protein, 278 aa, Cetraria islandica subsp. islandica
VEHGAVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 10975 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 10976 - protein, 526 aa, Dehalococcoides sp. CBDB1
MKKVLVSDALSATGLAPLKEIAQVDVKTGLKPEELISIIGEYDALLVRSQTQVTADIINAGKKLQVIGRAGVGVDNIDLKTATGNGIIVVNAPTGNTISATEHTLALMLAMARHIPRANASLKSGQWKRNEFVGSELKGKTLGIVGLGNIGSEIAKRALALEMRVIGYDPFISMERAKKLQVELLPFEDLLKRADFITLHVPMTGQTKGLIGPKELEMMKPTVRLINTSRGGIIDEEALAKAVKEKRIGGAAIDVFSKEPCTESCLFECDNIIVTPHLGASTAEAQELATSDVVKQVIDVFEGRPARYAVNAPYISAESLPVVGPFMPVARTVGSLVSQLTDGHMKNVTIKYCGELAAYDTTALKALVLGGILEHISEERVNVVNADIVASQRGLGVTEQKESTCQNFSSLITVTIDTDNGKSNTVAGSLVRGDVHIVKLNDYWIDIVPTGGYFLFADHIDRPGLIGSAGKITGDADINISYMHLSRQKARGQALMILALDEPLPEKQRQQLLSLPDVQMVQVVKI

SEQ ID NO: 10977 - protein, 297 aa, Salinibacter ruber DSM 13855
MSGTVCVVTGANSGIGKATAAELARLGARVVMVCRDEGRGREAQAELRAEARTAHPSRADTIDLRIADLSVQEEVYHLGETLRADYDRLDVLVNNAGVFLESREETVDGVEATFAVNHLAPFLLTHLVLPRLRETAGRAGEARIVTLSSEAHRGVSMDFDDLNAETGYNPLQAYAQSKLANILFTHELSRRLQDEGVVANVVHPGIVNTNIWRGSGWISRIARLFSWLYKRPEEGARNVVYLAASPDVEGVTGQYFKETEVVNPSPEAYDEKAEARLWRISREMTGLAEVDEDGAPG

SEQ ID NO: 10978 - protein, 327 aa, Zea mays
MFGLRARAAAQLQRPTPSPSSASSASFSLARLGCASPLAALAPLASAPPSPSARETQPTSLSARWPAAPMRPWGTRGHSRPTTRVLCTAAGSVQREGKELLVQHLLVGEKDVRLLVDLEKNIIAEGADLSDLAVEHSLCPSKENGGMLGWVRRGQMVPEFEEAAFSAPLNKVVRCKTKNNQKKKKKKPNPPNPSLRPGGRIIIVLAERDQCVLQDIDPEELHAKLQDPSFLEEAQLIDVREPDEVFHCLSLNLHFGDYLPLRQFGTWGPVMTDEFNPQKDTYVLCHHGMRSMQVAKWLQSQGFKKVYNVAGGIHAYAVKADSSIPTY

SEQ ID NO: 10979 - protein, 66 aa, Brassica napus
MPPKQQPKADLAKKQKQVEDKTFGLKNKNKSKNVQKYVQSLKQSVQPKPDASKAAAKKKEEEEKAR

SEQ ID NO: 10980 - protein, 584 aa, Symbiobacterium thermophilum IAM 14863
MLRKTKIVATIGPASEQVEVLTRLIEAGVDVCRLNFSHGTLDEQRRRIENIREAGRRVGKDVAIMIDLKGPEIRIGTFENGKVTLRDGDLFTLTTEPCVGNQERVWVQYPGIVHDVAEGGYLLLDDGNLTFQAVEVTPTEIRCRVIVGGVLSDRKKVNLPGTKVSLPALSEKDIEDIRFGVEMGVDFVAGSFIRKAQDVLEIRRVIEEAGGHQQIISKVESQEGFDNLEAILQVSDGLMVARGDLGVEVPTEEVPLMQKRMIERANAMGKPVITATQMLESMVNRPRPTRAEASDVANAIMDGTDAIMLSAESAAGKYPVEAVRTMATIARRTEEALDHSQLMARRGRFGRMDSVTEAISHATVTTAHDLGATAIVSATTSGFTARMVSKYRPGCPIIAVTPDPRVARQLRLVWGVFPVVEPVASGTEDLTQRAVEGALVSGLVKNGDLVVITAGLPVGVKGTTNLLKVHTVADVLAQGTGIGRQPVTGRAVIVRSEEDLARVQPGDILVSRLTDADCVPAMERAAGIITEEGGLTSHAAVAGISLGKPVIVGAEGATRRIPDGAIITMDVAHGLVLRGEATVK

SEQ ID NO: 10981 - protein, 541 aa, Zea mays
RDLELVEKEREARRLSSATDDSLDGSGSRNVGRVRVRQYGKACKELTGLFMTQELAAHSGSVWCINFSLDGRYLATAGEDRVIHVWEVSEGDRKGELLGECSLAKENGGGCSPFLTVLGNDSPEIAALSFTCADMDKKRRLRKQSNRKSVGSDHLVVPECVFGFRDKPVCSLLGHAADVLDLSWSKSQYLISSSMDKTVKLWDITTSTCLKTFSHTDYVTCIQFNPVDDNFFISGSLDEKVRIWNVRDRKIEDWNDLHEMVTAACYSPDGQVAMVGSHKGSCHIFDTSEKLQYKSQIDLRIRKKKSGQKKITGFQFAPGSSSEVLITSADSRIRVVNGDEFVHKFKGFRNTSSQISASVAQNGKYVICASEDSHVYVWRHDNSSHPSRSRSTVDVTNSYEHFHCHGVTVAVTWPGAEARCSFGPGSSRHSDSDGAVNSGRDLPVENTRHSSDAADIRCNESPACEGVTSRSTSRHPGDGASTSWPDEKLPSAKSSPGHCSSDLCIGAMDVQRRSAWGLVIVTAGRGGEIRVFQNFGFPVQV

SEQ ID NO: 10982 - protein, 464 aa, Oryza sativa (japonica cultivar-group)
MAYVYPVPSPLMRFFFLSLGLGPAFLCTETLLLRRPPPNPTRRSAKGETGQPEEEEEEEEEEEEEEEGRMPPKKAAPSKADLAKKQKVVEDKTFGLKNKNKSKNVQKPSSPSPTRPRPPPRHAGCSDRSSSYPIFRLLCFSDVRCFFFLFAVDVDAQKKKEEEKAREKELNDLFKVAVSQPKVPVGVDPKSIVCEFFKVGQCQKGFKCKFSHDLNVQRKGEKIDIYTDKRDAETMEDWDQETLEKVVASKGAEYQQNKPTDIVCKYFLDAVEKKQYGWFWVCPNGGKDCHYRHALPPGYVLKSQMKALLEEESEKIAIEDEIEDQRKKVKTTTPMTTDLFMEWKRKKAEEREAGLAALRAERAKNDRMSGRELFMADSSVFVDDAEAYDVYERQEESEANEEPSNKNQDEGPSSSTSNGKEVEESDDEDINIDDDLDIDELNELEASLSRTSIQIREPGEGTSS

SEQ ID NO: 10983 - protein, 278 aa, Cetrariella delisei
  misc_feature (26)..(26): Xaa can be any naturally occurring amino acid
  unsure (1)..(278): unsure at all Xaa locations
VEHGEVKVVAVNDPFIEPHYAAYMLXYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDLEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 10984 - protein, 278 aa, Cetraria commixta
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 10985 - protein, 278 aa, Cetraria sepincola
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSNTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 10986 - protein, 295 aa, Mycobacterium bovis AF2122/97
MLFGMARIAIIGGGSIGEALLSGLLRAGRQVKDLVVAERMPDRANYLAQTYSVLVTSAADAVENATFVVVAVKPADVEPVIADLANATAAAENDSAEQVFVTVVAGITIAYFESKLPAGTPVVRAMPNAAALVGAGVTALAKGRFVTPQQLEEVSALFDAVGGVLTVPESQLDAVTAVSGSGPAYFFLLVEALVDAGVGVGLSRQVATDLAAQTMAGSAAMLLERMDQDQGGANGELMGLRVDLTASRLRAAVTSPGGTTAAALRELERGGFRMAVDAAVQAAKSRSEQLRITPE

SEQ ID NO: 10987 - protein, 369 aa, Pseudomonas syringae pv. phaseolicola 1448A
MAFDRIEDIIEDYRQGKMVLLVDDEDRENEGDLLLAADCCSAQAISFMAREARGLICLTLTDEHCQRLGLEQMVPSNGSVFATAFTVSIEATMGVTTGISAADRARTVQAAVNPHAVREDLVQPGHIFPLRARDGGVLTRAGHTEAGCDLARMAGFSPASVIVEVMNDDGTMARRPDLELFAEKHGIRIGTIADLIHYRLSTEHTIVRIGERDLPTVHGTFHLFSYEDRIEGGVHMAMVMGDIRRDDPTLVRVHVVDPLRDLVGAEYTGPSNWTLWAALQRVAQEGRGVVVVLANHESSQALLERIPQLTQPPRQYTRSQSRIYSEVGTGAQILQDLGVGKLRHLGPPLKYAGLTGYDLEVIENIPFPG

SEQ ID NO: 10988 - protein, 1425 aa, Eremothecium gossypii
MTAGHRDERPDREGGSERDEHLNRVVQSVSDATKRLSQISNSSTAHTKTGKRKNRDTVGPWKLGKTLGKGSSGRVRLAKNMQSGKLAAIKIVPKRNVRHNQKQVTALPYGIEREIIIMKLITHPNIMALYEVWENKSELYLVLEYVEGGELFDYLIARGKLPEQEAIHYFKQIVQGVSYCHNFNICHRDLKPENLLLDKKNKTVKIADFGMAALETTNRLLETSCGSPHYASPEIVMGQKYHGSPSDVWSCGIILFALLTGHLPFNDDNVRKLLLKVQHGRYQMPSNVSKEAKDLISKILVVDPEKRITVDKILEHPLLVKYDNPGKGGLACPLEKPEERPKVLDIHSIDDIDETILSNLQILWHGAPKEYLVDKLLQSGFTEEKLFYALLLRYQQRQSVEPTSVPSNMASTNGSGAFARASNNDQSVINAPKVTQKSQFSINSLLVSPKKTREGYVASSSRVFKHSVSRRSLHVSPSPMKSSTSCRSLKSSSSKRLQSPNPKAITQPVKVTSPQPRRRTLHNSASKRSLYSLTSISKRSLNLNEFLQEANEVKTPKLPSMPLQDQPRSEAPKTPTKTTYGADSHGGEKPTFISVLHDCPTVDSEGMVFKSSSGTPMIAANAPIIQPAFIFGVGAFPGTKQPSSNSLSKPSLNSQSSPKQAQEATANSMRETIRDRQTLVVEKRVPSKTESVPPAFPRVRPIMERKHGSDLTLVRDTRSVAKEKRSSLSLDPRRTAPEPPRGIETLLRRYSLKNSIKSRSSLKKKRDSGAWSITDKTIFQDLGQVPEDEEQEKDSEEKGNDTFISTTETSDTPSSKFKVTTSTPIKKDDATAISAENAAVGTEQSGSEDEATNFDSNAHSYPISTDLKTEDDLTPIKPQGQTDLLRMPSSFMNSSNTFANLNNFISNIDKEYSPENSDSGRIEKDEPAGKAQPEQITVKKRQRTLAPGGYLSPSIPRMESENSLNQELGSRISDLSDLSFANDMPTYTNTAHAVSISPGTRNVCSFSPLEPRSPQDVSNNGKMRSNLHIPLRQLSEDMCDKTITTQEGESVNIFEDAPEEEGSLTTSTSGSVPNIHQKAISIDTMNTSCALVPVSHVRTSIHMNGDSSVLDWSTSDGILSKARPLPTSNHVRKKSGNRLSNNLTLSKSMMSMFKNLDQINVTDIQDPMPVSDLLSKGVDPIEPIEPLKNDQVTLKAESIGAESDSINMDLADRKHVTIFHDNVSDKNFKSTRMENSDKGSLGSGAPQATHLFHTGNKDMKSHETLLSPITETPAAALSATSLTRKESISSDGKSVKDETKKSGKGNWFMRLIMSFTKPKKTVIQEHMTVLPFDDVNIITLQQFSYQGVEYEIRQMERRKDKQKVEYDCRLLDGDFKFKINIYGENSAATKVSVKQKGRSDELAFTKLNTDIEALIKAKENAANVK

SEQ ID NO: 10989 - protein, 461 aa, Xanthomonas axonopodis pv. citri str. 306
MSIRTRSRKTTSTQPESALRRWLKERSITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLDAYAQAELQPVVAPELEFFLVQKNTDPDFPLLPPAGRSGRPETARQSYSIDAVNEFDPILDLMYDYCDAMELDVDTLIHESGAAQLEVNFTHADPMSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDVPQNMRVESRFAGSDANPYLAMAATLACGLLGIGEKLEPTAPISSNGKEQGYDLPRSLGEALDELEGCQALQEMLGRRFVRAYISVKRKEYETFFRVISSWEREFLLLNV

SEQ ID NO: 10990 - protein, 262 aa, Wolinella succinogenes
MKNITVSSIKKKKNQEKITMITAYDALFARLFDGEVDILLVGDSLAMSFGGEEDTLPIGMDEMIYHTKAVCRGAEKSLVVIDMPFGSYDTKEKALHNAIRAYKESGASAVKLEGGIQKAETIALLSENGIAVMGHIGLKPQFVRAEGGYKVKGKEEGEAQSLLRDAKALEESGVFALVLEGVKAEVAQEVARSVSVPVIGIGSGSQVDGQVLVWSDMLGFFEGFTPKFVRRYLEGASLIRQGVREYAKDVREGRFPSEAESY

SEQ ID NO: 10991 - protein, 501 aa, Ustilago maydis 521
MPHMPQGIVKGGKEDVKLNNQSLWQTKAYINGVWTDADNKSTLKVFNKATGAEIGQVPDMGANETAAAISAADEAFKSWSKTTAKHRHDLLMKLYYAHQENAEDLAKIIVAENGKALPEAKGEISYSNGFLEWFAEEATRTYGHTVPSPLPGVRNVVQMQPVGVAGLITPWNFPAAMITRKAAPALAAGCTVVVKAPAETPFSALAFAHLAEKVGFPKGTINVVTCAKGDNEIAVGKQLCENPAVRKISFTGSTRVGKILMSQSASTLKKLSMELGGNAPFIVFEDADLDKAVEGAIACKFRGSGQTCICANRIYVHASIKDEFLQKLAAKVNDFKVGYGMDKGTTHGPLVSEAGLSKVEEHVNDSVKKGAKVIVGGKRGEGLFFEPTIITDLPEDVPTDREETFGPLAAVYTFTSEQEVVRKANNVDVGLAGYFFSKDTARCWRVAEELQVGMVGINTGLISQHAVPFGGVHESGFGREGGRTGIDEYLVQKLMVFGGVN

SEQ ID NO: 10992 - protein, 529 aa, Bradyrhizobium sp. BTAi1
MSKPKVLISDALSPAAVQIFKDRGVEVDFQPNLGKDKDKLADIIGDYDGLAIRSATKATAKIIERAKRLKVIGRAGIGVDNVEIPAATAKGIIVMNTPFGNSITTAEHAITMMLSLAREIPQADASTQAGKWEKNRFMGVEITGKTLGVIGCGNIGSIVCDRAQGLRMKVIGFDPFLTEERARDLGVEKVELDELLKRADFITLHTPLTDKTRNIIDAAAIAKMKQGVRIINCARGGLIDEQALLAALNSKHVAGAALDVFAEEPATSNPLFGHPSVICTPHLGASTTEAQENVALQIAEQMSDYLLTGAISNAINFPSITAEEAPKLKPFIALAEKLGSFAGQLTESSITKIQITYEGQVAEMKTKALTSAVLAGLLRPMLGEVNVVSAPVIAKERGMIVDEVLRAGESDYESLITVAVTTEQQERAVSGTVYADGKPRLVDIKGIRVDAEFGKSMIYVTNEDKPGFIGKFASLLGDAKINIATFHLGRVAAGSDAIALVEIDGAVPAELLAKIQALPQVKQAKALTF

SEQ ID NO: 10993 - protein, 366 aa, Bacillus thuringiensis serovar konkukian str. 97-27
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSAEEAISYSLSGANLRCTGVNWDLRKDEPYSIYDRFDFHIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 10994 - protein, 539 aa, Blastopirellula marina DSM 3645
MPKILVLDELSPEGLALLDAAEGFEYEIRLKLAGEELRKSLAEFDGAICRSGVKITAESLEGNTRLRCIARAGVGTDNIDKDAATRLGIVVMNTPTGNTVSTAEHAFCLMMALSRNVASANQSLVEGRWDRKKYMGSQLADKTVGIVGLGRIGQEFAKRALAFEMRVIGFDPFISPERAAELGIELYASVKEMLPLVDYLTVHTPLTAETKGLINQDALEIIKPGARLINCARGGIYDEAALVAGLKSGKLGGVALDVYAAEPCTDSPLFGMENVVCTPHLGASTEEAQTQVAIEAVQLVTNHLNTGEIRHAVNVAPIDPKTLDSMRGYLDVAYRIGLFAGQLHGGKLKACKLNYRGEVAGKDTKLLTASFCAGLLEQAMDEGGANIINAQMLLAERGVTISTESSTEMGSFSSSITATLEEEGRTSQVGGTLFGNDMPRLILVDGQRLEAYLDGTLFLFAHNDVPGIIGRVGTIFGNHNVNIAQMAVGRSSTGGAVGVLNLDGAPPQSAVDEVLKSADITTARIIELPQAGELPTWLR

SEQ ID NO: 10995 - protein, 604 aa, Kluyveromyces lactis NRRL Y-1140
TQTDRNVKRKKTSSMTITKFVSEHPQTDPKWWKEAIVYQVYPASFKDSNHDGWGDIKGIDSKLEYIKELGANAIWICPFYDSPQEDMGYDISDYEKVWPRYGTNEDIFNLIDRAHGLGIKIIVDLVINHCSSEHAWFKEARSSLDNPKRDWFIWKAPKGFDSNGKPIPPNNWRSFFGGSAWEYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKEQEITQLFEFEHVSVGRKPGNVGVVNFKLSEFKDGIAAAFQFIDKTDSWSTVYIENHDQPRSVTRFGDDSPEYREISAKLLALLETSLTGTLYVYQGQELGMINFRDWPIEKYEDVEVKGMYKMMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANEKLFAFTKKYGEKVLYVVLNFSKEEIEFSFLEGYNSYDYIFGNYPEAEIDTGSNKLQPWEGRFYYAN

SEQ ID NO: 10996 - protein, 138 aa, Crocosphaera watsonii WH 8501
MVQTKENKKSEVAAIPFSVAHTGVAATEMRPWGSFTTLEEGPGYKIKRIEVNPGHRLSLQMHHHRSEHWIVVSGTAKVTCGDKEEILAANQSTYVPQCTSHRLENPGVIKLILIEVQNGEYLGEDDIIRFQDDYSRHK

SEQ ID NO: 10997 - protein, 250 aa, Salmonella typhimurium LT2
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPLKHYYLGNADEIAAKAAAVANQGKAK

SEQ ID NO: 10998 - protein, 506 aa, Arabidopsis thaliana
MSVLIVTSLGDIVIDLHSDKCPLTCKNFLKLCKIKYYNGCLFHTVQKDFTAQTGDPTGTGAGGDSIYKFLYGEQARFYKDEIHLDLKHSKTGTVAMASGGENLNASQFYFTLRDDLDYLDGKHTVFGQIAEGFDTLTRINEAYVDPKNRPYKNIRIKHTHILDDPFDDPPQLAEMMPDASPEGKPKEEVKDDVRLEDDWVPMDEELGAQELEEVIREKAAHSSAVVLESIGDIPEAEVKPPDNVLFVCKLNPVTEDEDLHTIFSRFGTVVSADVIRDFKTGDSLCYAFIEFENKESCEQAYFKMDNALIDDRRIHVDFSQSVSKLWSQFRQKDSQKGKGNGCFKCGSTDHIAKDCVGGPSSKFIVKDQNRQHGGGEGYEMVFEGDVHETPKHNSHERERSEKIQRRSPHGNGEGKRQHRDERDDGRRQHDREDARELERKHRERKERESREDEDRRRRRRREESRDKESRRERDEDDHRSHRDYKERRRERDDRHGREARHERRDR

SEQ ID NO: 10999 - protein, 317 aa, Triticum aestivum
  misc_feature (244)..(244): Xaa can be any naturally occurring amino acid
  unsure (1)..(317): unsure at all Xaa locations
MLPWIFSRKGASGFSWASTADQVTAGISAAGLTAIVTGASSGIGAETARVLAARGAHVVMAVRNLAAAEAVRQAVLAETPGGSVEVMELDLSSLASVRNFAADFAATGLPLNILVNNAGVMATPFSLSKDGIEMQFATNHVGHFLLTNLLLETMKKTSRESNVEGRIVNVSSEGHRFAYKEGIRFAKLNDEEEYSTIAAYGQSKLANILHANELARRFKEEGVNITANSLHPGAIITNLLRHHXSIIDALHRTLGKLVLKNAKQGAATQCYVALHPDAKGVSGKYWCDSNLYEPSDKAKDAELGKKLWDYTLDLVAA

SEQ ID NO: 11000 - protein, 245 aa, Burkholderia xenovorans LB400
MSDEQQKKIALVTGATRGLGFETVRQLAASGVRVLLGARDTHAGEAKAAELRAEGLDVRPIAIDLNNAATFDQAAKEIDALFGRLDILVNNAGVMSDADGFPSVANPQAMRDVIEINFIATVIVTQNMLPLLRKSKHGRIVNVSSRVGSLWWNSDPDNPVPDNKWLGYAASKAAVNMLTVELAYELRDTPIKVNAICPGYVKTEMNKGGGFLTIEEGARPAVHYALIGDDGPTGGFFGGDGPIAW

SEQ ID NO: 11001 - protein, 154 aa, Arabidopsis thaliana
MGNRCARTSCCRKLWSCICCCSNNNNNSYGQTRSQHGSKGKVHPVSRIEKWEEKITEANNHGKILVVNFSAPWCVPCKKIEPVFRDLASRYPSMIFVTVDVEELAEFSNEWNVEATPTVVFLKDGRQMDKLVGAETSELQKKTAAAADLFLRKP

SEQ ID NO: 11002 - protein, 583 aa, Yarrowia lipolytica CLIB122
MIPFTKINLELLLLPLLIIPITLFLLVLNVQVNTVHRRYKEYRLKLARCPQQSTGLFGWWLIYAVVRCNRDRFYSAKVVDYFTKLRTFIVSLGGELVIYTSESENIKALLATQFSDYDLGKTRHALLFTLMGDGIFTLDGQGWAHSRALLRPQFSKETVSPLSSLETSLQQLMAIVKRRVALKGEVDIQELFFMLTMDTATNLLYGESVDSLGDCLKETKKETHVMTDGKRNLLQSRDHHSNVPNEWEPIYGTYEKKGLGIGSENSLQSGVSPRDSPVFEVSVSEDIRKAYPAALTTALEFSAMRSKLQRFYWIWGDVLYRQKFHSAVNTVHAFSNHFVNQALKLTPQELQMKSAEKYTFLYELAQRTRDPVAIRDQLINILIAGRDTTAALLSFVFLCLVANPEKLAKLREGIMTDFGTSTDSITFESLKRCVYLRYVINEALRLCPPVPINMRQANKDTTLPTGGGKNHDEPIFVAKNQIVTYSVLFMHHNQNIWGPDASEFRPERWGEPACPKGWEYLPFNGGPRICLGQQYALTEAAYVIVRLVQEFTEIEWRDRKGLPVLFKTHITMSLGEGLRVHMK

SEQ ID NO: 11003 - protein, 278 aa, Flavocetraria cucullata
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 11004 - protein, 278 aa, Ahtiana pallidula
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIVEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 11005 - protein, 432 aa, Bacillus halodurans C-125
MSESYYGLLDEEKVFKDPVHRYIHVRDELIWALIGTKEFQRLRRVRQLGTTFLTFHGAEHTRFNHSLGVYEITRRIIEVFQGRPYWNEEERLLTLCAALLHDIGHGPFSHSFEKVFDTDHEEWTRRMIVGDTEIHNVLLKMGDDFPQKVADVIEKTYPNKLVTSIISSQIDADRMDYLQRDAYYTGVSYGHFDMERILRVMRPMEDQVVIKQSGMHAVEDYIMSRYQMYWQVYFHPVTRSAEVILSKVFKRVKDLYEQGYKFKQEPKHFYSLFEGNMSLDDYLRLDESITMYYFQIWQEEEDRILSDLCVRFINRQLFKYIEFNPNLQMNDWPRLQQLFAQAEIDPEYYLVVDSSSDLPYDFYRPGEEEERLPIHLIMPNGKLRELSRESDVVEAISGKKRTDHKLYFPMDCLTDQSDHKEIKQEILSLLFK

SEQ ID NO: 11006 - protein, 273 aa, Campylobacter lari RM2100
MIKAKKHFGQNFLCDKSVVDKIIQAIPKDTKNIVEIGPGLGDLTQELLKIPQAHIRAYEIDKDLIPILNKKFQNEIEGGNFELIHQNASDAFDQGSLSDKEYFLVANLPYYIATNLILKALEDQNCLGLIVMVQKEVAQKFCANEKESNFSALGVLCALICQRQMLFDIQPQSFNPPPKVTSAVMKLIKTTHYQQKCENIEAFKEFLRACFQNPRKQLLSNFKNKKEKILKAFEALDISSTSRAHEISVDSYLKIYDYLKDDYERRKQNSRTK

SEQ ID NO: 11007 - protein, 276 aa, Glycine max
PSPGTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 11008 - protein, 432 aa, Haemophilus somnus 2336
MTTSATLFYRAQQVIPGGVNSPVRAFKGVGGTPVFIEKANGAYIFDIEGKQYIDYVGSWGPMILGHNHPSILSAVLKIAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDIERFNLFFHKMLEQGVYLAPSAFEAGFMSLAHTDADIDRTLQAADIAFASLRSSSFS

SEQ ID NO: 11009 - protein, 272 aa, Bacillus cereus ATCC 14579
MDKQIGFIGCGNMGMAMIGGMINKNIVSSNQIICSDLNTANLKNASEKYGLTTTTDNNEVAKNADILILSIKPDLYASIINEIKEIIKNDAIIVTIAAGKSIESTENAFNKKVKVVRVMPNTPALVGEGMSALCPNEMVTEKDLEDVLNIFNSFGQTEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 11010 - protein, 390 aa, Archaeoglobus fulgidus DSM 4304
MRKTGGLPLSRRLARRVEELKPSGIRRFFDLVVGRDDVISLGVGEPDFPVPWRIREEMIYSLEKGYTSYTSNLGLPELREGIAEYYTRFGVKALPEQVMVTSGVSEGVDIAIRALIEPGDAALIPEPCYVSYKPLVEICGGEAVTIPTAPEFRLTYEMLMQYRDAKAKILVLNYPANPTGVSYSKKELEEIADAVNELDLIVLSDEIYAELTYTGRHVSMAALNGMEDRVVIFNGFSKAFAMTGMRVGYVIAPPDIFAGMLKIHQYCMLCAPITGQIGAIEALRSLDEVERMRAEYMRRRNFVVKRLSEIFEIKKPEGAFYAFPKISSTGMSSEEFAEKLLLEKSVAVVPGNAFGECGEGYVRLAYAVKFEKLKEAMDRIKEFVEEHGEG

SEQ ID NO: 11011 - protein, 388 aa, Oryza sativa
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGMFQKGYTY

SEQ ID NO: 11012 - protein, 443 aa, Blastopirellula marina DSM 3645
MTSRLFYWSLTSALAGFLFGFDTVVISGAEETIEKLWDLDKVTHGLAMSAALWGTVIGSLIGGWPTDAWGRRKTLLSIGVLYFISAVWSALANDVSAFMIARLVGGLGVGISTVVAPLYISEISPPERRGRLAAMFQFNIVFGILIAYASNALLAGIGPNSWRWMLGVEAFPAIIYTLMCFTLPESPRWLITKKNDREAGLRVLQMVAPERTPAEIDALANEIAEAATVEKQSLSSFWSAKMKTPIMLAFLVAFFNQMSGINAILYFAPRIFKEAGQSGEAALQTSVSIGIVNLIFTFAGLWLIDRLGRKTLLWIGSVGYIVSLVGCSWASWNDQYVVLAACVNIFIASHAIGQGAVIWVLISEVFPNRYRAMGQSLGSSTHWVFAALITALFPLFAEQLGMGAIFLFFCGMMVLQLIWVVTMVPETKGVPLEEMERKLGVTP

SEQ ID NO: 11013 - protein, 579 aa, Wolinella succinogenes
MKCDSLIEALSQRVKVLEVTRQYEDQVTALVELNDLPEAVSFLYYGKGGYLSTMVANDEREINKHYALYYALSMEGGKMFEGDELAQEEKCFITIKALIPADNPTYPSVTPLVPACVWYEREAYDMFGLVAEGLPDKRRLALSDDWPNDLFPLRKDAMDYRYRPDMREHYMEPEFEFLRPEGSGIIDVPLGPLHITADEPGHFRLFCDGDTIIDADYRLFYQHRGMEKLAENRMNYDQMGYLAERVCGICGYAHAIACIEAAEKAINLQIPLRAQAIRIVCLEIERLHSHLLNIGLACEVTGNYNAFMHIFRIREYSMKLAELVTGGRKTYGNVVMGGLRRDMTGTEIKESLKILQIIETQVEEVWDAVMDDKRQISRWKGVGILDKQVARDFSPVGPNIRGCGIKRDTRYDHPYDFFNQIEFEVATAQGGDVFAREMVRYMELKSSVSIIRQCFELMPQTPIMIDPTFHVQPENFALAYVEAPRGDNVHWIMQGSAQKVYRWRCRAATYNNWPSLRFQFRGNTIADAALIVCSLDPCYSCTERVTVVDVRSKKSKILTRLDLEDFSKTLKGNPLKDLK

SEQ ID NO: 11014 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 11015 - protein, 502 aa, Burkholderia sp. 383
MLVDELHSRKNEVIDPSALRARLRDGALLETRAWLASGWQEGTDGRSFPVTNPATGDILARVASLGAAEVEQAIESSALAQQGWQKRTSHERAKLLRAWFDLILANADDLALIMTSEQGKPLAEARGEITYAASFVEWFAEEAKRVYGDVMPHPQGDKRILVIRQPIGVCAAITPWNFPAAMITRKVAPALAAGCSIIVRPADLTPLTALALAVLAERAGIPAGVLQVVCGPSREIGAVLTASPVVRKLSFTGSTEVGRVLMSQSSGTIKRLSLELGGNAPFIVFDDADLDAAIEGAMASKYRNSGQTCVCANRFLVQAGIHDRFVEALTRRVQALKVGNGIEPGVQQGPLIQKSACDHLNQLIDDAVSKGARIVTGGKGHPLGGTFFEPTVIADATPAMRLAREELFGPVGPVFRFDDEAEAIAMANDTEYGLAAYLYTRDNSRIWRVGEALEYGMVGLNTGVISNEVAPFGGVKQSGLGREGSRYGIEEYLEIKYMCSQV

SEQ ID NO: 11016 - protein, 95 aa, Triticum aestivum
  misc_feature (9)..(9): Xaa can be any naturally occurring amino acid
  misc_feature (18)..(18): Xaa can be any naturally occurring amino acid
  misc_feature (24)..(24): Xaa can be any naturally occurring amino acid
  misc_feature (71)..(71): Xaa can be any naturally occurring amino acid
  misc_feature (87)..(87): Xaa can be any naturally occurring amino acid
  unsure (1)..(95): unsure at all Xaa locations
TRETRISLXFQVGKKQMXRHAFTXHWRLWSIPEIKDCLEEAGFKSIHVWIREMPDTKSSGNAKEYTADRDXKYEELQRFNQADAWNXYIVGVANM

SEQ ID NO: 11017 - protein, 474 aa, Tropheryma whipplei TW08/27
MFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 11018 - protein, 290 aa, Streptococcus thermophilus LMG 18311
MRIADYSVTKAVLERHGFTFKKSFGQNFLTDTNILQKIVDTAEINKNVNVIEIGPGIGALTEFLAENASEVMAFEIDERLVPILEDTLRDHDNVKVINEDVLKADLQTRVKEFENPDLPIKVVANLPYYITTPILMHLIESKIPFSEFVVMMQKEVADRISAEPNTKAYGSLSIAVQYYMTTKMAFAVPRTVFVPAPNVDSAILKMTRRKQPLVEVKDEDFFFRVSKASFLHRRKTLWNNLTSHFGKSEEVKNKLDQALENAAIKPSIRGEALSISDFARLSDALREAGL

SEQ ID NO: 11019 - protein, 269 aa, Tropheryma whipplei TW08/27
MSRKPSPTRRTRIHRFHKGSCGRKLVGLTCYDFSTARVLSDCELDFLLVGDSASGVIYGYENTGSVCLDEIIYLAAGVVRGAPNSFIIVDLPFGTYEKSDELAVETAIEVIKRTGASAVKLEGGARMACRISAIVRAGVPVMGHIGFTPQTINALGGYKIQGRDNADLIYLDAQAVEQAGAFAVVMEMVTEDLAKTITSEIKIATIGVGAGRYTDGQLLVINDLIGLSEKKITFAPRYASIDNTVASCVKLWRKDVLEGNFPQKDHIPA

SEQ ID NO: 11020 - protein, 56 aa, Brassica napus
  misc_feature (11)..(11): Xaa can be any naturally occurring amino acid
  unsure (1)..(56): unsure at all Xaa locations
LQKYEKNFKKXGLLTDPTLPLLTDSALRDVSIPPGPRLLILDHIQRDPEINGKRGK

SEQ ID NO: 11021 - protein, 106 aa, Arabidopsis thaliana
  misc_feature (42)..(42): Xaa can be any naturally occurring amino acid
  misc_feature (68)..(69): Xaa can be any naturally occurring amino acid
  misc_feature (85)..(85): Xaa can be any naturally occurring amino acid
  unsure (1)..(106): unsure at all Xaa locations
MASSMLSSAAVVTSPAQATMVAPFTGLKSSASFPVTRKANNXITSITSNGGRVSCMKVWPPIGKKEFXXLSYLPDLTDRADLVKXGYLPFSKKVLVFEFVGTFFLW

SEQ ID NO: 11022 - protein, 418 aa, Geobacter metallireducens GS-15
MAQKKGIVIICNLDTRGEDIIFVKQLIETRGHNAYFLDFSMEEPPPFAGDITCEHVAERGGMTIEAVRECYRSDRDRAMENQIRGASAIVADMMKEGKIQGVFGVGGGTSSLVGTSVMKGVPFGIPKLMASPMAAHPSYVGKYVGTHDITMHHTVLDVVKMNPLLKAQITNAVGAICGMVEMTQGTNITFDKPCVAISSFGFGEMAVQTALGMLDEAGFTPIVCHAQGKGDKAMEDMIRAGAFHGVLDICTGGIVENLFKGNRDPGPDRFMAAVETGIPMVLAPCGLDILSYGGRPDMLEKTKDRPQYVQDSLRVQVRTTADELRQAADVIAERLNRANGEWTFLIPLKGWSSQDLEGRIIYDPAADAAFVARLKEKLDEPERVKEVDLHLYTKEFARVAVDEFVRLYEGTPAQAVAG

SEQ ID NO: 11023 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTNINVLSNASCTTNCLAPLAKVINDKFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 11024 - protein, 658 aa, Neisseria meningitidis Z2491
MNEFSLAPIVIVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSLEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVVTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGETGETVRHAFPLAAEAYAVGKTVGTLPMAAYGIKLLFVRRRTGRIENPDASFTLEGGDVLVVAGKKEEIISFENWSLQGI

SEQ ID NO: 11025 - protein, 455 aa, Oryza sativa
MAIGGAAPPHPPRGGGGGSPEDSSTARRPDFEQPLLQAHAAVPARGKQEPVERDHEAQCSPEADGDGATFVRTCFNGLNALSGVGLLSIPYALSEGGWLSLVLLLAVAMVCCYTGLLLRRCMAASPAVRGYPDIGALAFGAKGRLAVSAFLYAELYLVAIGFLILEGDNLDKLFPGTSLAVGGLVVSGKQLFVVVVAVVILPTTWLRSLAVLAYVSASGVLASVVVVFCVLWAAVFDGVGFHGKGRMLNVSGLPTALGLYTFCYCGHAIFPTLCNSMQEKDKFSRVLVICFVACTVNYGSMAILGYLMYGDDVKSQVTLNLPEGKISSKLAIYTTLINPFSKYALMVTPVATAIEEKLLAGNKRSVNVLIRTLIVVSTVVIALTVPFFGHLMALVGSLLSVMASMLLPCICYLKIFGLTRCGRGETLLIAAIIVLGSLVAATGTYSSLKKIFYEF

SEQ ID NO: 11026 - protein, 267 aa, Flavopunctelia flaventior
NDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKPDIEIISHASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDLKGIMSYSEDALVSTDLNGDNHSCIFDATAG

SEQ ID NO: 11027 - protein, 273 aa, Melanelia stygia
VEHGDVKVAAVNDPFIEPHYAAYMLKYDSQHGQFKGTIEVKGSNLVVNGQTVKFYTEKDPANIPWKDTGAYYIVESTGVFTTTEKAKAHLKGGAKKVVTPAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIF

SEQ ID NO: 11028 - protein, 76 aa, Zea mays
  misc_feature (31)..(31): Xaa can be any naturally occurring amino acid
  unsure (1)..(76): unsure at all Xaa locations
MAWRASLSRSLKEIRVLFCQSSPASAGARDXISRIFDFTLLRVGTPSLPFLVREGSRGQPQLWGRYHMGGERCVNL

SEQ ID NO: 11029 - protein, 737 aa, Frankia sp. EAN1pec
MCSLSWSTYSGPPGVIVNESRVAAALPDYELGAQLGQGAFGLVLAGRHRELHRDVAIKILSGGPEETAGYGRAEARLLAALDHPHIVRIYHAVATDDLHLIVMELLAGGTLTRRRADMTGETACAVGLAVATALSAAHARGVLHRDIKPDNILFDATGLLKVTDFGIAKMMEGTATTASAVIGTPRYMAPEQLLGTRLGPATDLYALGVLLYELLTGAPPFALALPAPVLIHHHLHVRPEPPAGVPGPLADVVMRTLAKDPADRPGSARAFARELTQAAAEAYGPGWTSQTGIALRFDDDIRALAEATTPAVAVPTMPTSPPPPVPAPPAPAPASIDELPTRWAAPQPSAPSQRGADAGAARPTQRAGQAVPIWLRRRLPLAAVGLLILVTVVILALSRSGKQPGVPSASEGSGSTASTNSRTLGAPLAGHTSTVRAVAFSPDGRILASASDDEPVRLWDVTDPGDARPLDASLTGHSGWVHSVAFSPDGHTLASAGDDHTVRLWNVTDPANAHPLGAPLTGHTSTVWAVAFSPDGRILASAGNDETVTLWDVADPAQARPLDVISETRAVRSVAFSPDGRILASAGDDGTASLWNVADPTNPRPLGTPLAGHTNTVWVVAFSPNGHTLASAGDDHTVRLWNVTDPANAHPLGAPLTGHTSTVRSVAFSSDSRTLASGSDDHTVRLWDVIDPANAHPRGASLTGHSSWVRSVAFAPDGRTLASGSDDHTMRLWDVTS

SEQ ID NO: 11030 - protein, 478 aa, Mycobacterium leprae
MTEKTSDDVLKLAKDENIEFVDVQFCDLPGIMQHFTIPASAFDKSVFEDGLAFDGSSIRGFQSIHESDMLLFPDPDTARIDPFRAAKTLNVNFFVHDPFTLEPYSRDPRNIARKAENYLISTGIADTVYFGAEAEFYIFDSVSFDSRSNGSFYQVDAISGWWNTGAATESDGSPNRGYKVRHKGGYFPVAPNDQYVDLRDKMLTNLTNAGFVLEKGHHEVGTGGQGEINYQFNTLLHAADDMQLYKYIVKNTAWQNGKTVTFMPKPLFGDNGSGMHTHQSLWKGGTPLMYDEIGYAGLSDTARHYIGGLLHHAPSLLAFTNPTVNSYKRLVPGYEAPIKLVYSQRNRSACVRIPITGKNPKAKRLEFRCPDASGNPYLAFSAMLMAGLDGIKNKIEPQAPVDKDLYELPPEEAADIPQAPTQLAAVIDRLEEDHDYLTEGSVFTPDLIETWINFKRENEIEPVNIRPHPYEFALYYDV

SEQ ID NO: 11031 - protein, 331 aa, Kluyveromyces marxianus
MVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVAKN

SEQ ID NO: 11032 - protein, 152 aa, Prochlorococcus marinus str. MIT 9312
MTKERTFIAIKPDGVQRGYVSEIIGRFEKKGFKLVGLKQLIPSKDLAQNHYGVHRERPFFGDLVDFISSGPVVAMVWEGEGVILSARKLIGATKPLEAEPGTIRGDLAIDIGRNIIHGSDGEDTAKFEIDLWFNEEELCEWYTSDSKWRSEN

SEQ ID NO: 11033 - protein, 331 aa, Kluyveromyces marxianus
MVRIAINGFGRIGRLVLRIALSRKNIEVVAINDPFITVDYAAYMFKYDSTHGRFDGEVSHDGKALIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 11034 - protein, 457 aa, Zea mays
  misc_feature (222)..(222): Xaa can be any naturally occurring amino acid
  unsure (1)..(457): unsure at all Xaa locations
MLGVGTAAAVLLGAVALVLADAAARRAHWWDREAAEVVLVGGVALVVVDAAARRAHGWFGRTRTGVYQGFMFSSLTVLMTTAEACKQVLMDEDAFVTGWPKATVALVGPRSFVAMPHDEHRRLRKLTAAPINGFDALTTYLGFIDRTVVATLRGWSDAGEIEFLTELRRMTFKIIVQIFLTAADDATTLALESSYTDLNYGMRAMAINLPGFAFHRAFKACXILQAKYNQWRLLLDLKKARKKLVSVLQGVLNERRARKRLPRSSVDMMDRLIDAEDEHGRRLDDEEIIDILVMYLNAGHESSGHICMWATVYLQKHPEIFAKAKVIDETLRLVNISYVSFREATKDVFVNGYLIPKGWNVQLWYRSVHMDPEVYRDSKEFNPSRWEGYTPRAGTFLPFGLGTRFCPGNDLAKLEISVFLHHFLLGYKLTRTNPNCRIRYLPHPRPVDNCLAKITRV

SEQ ID NO: 11035 - protein, 265 aa, Glycine max
TVAPSPIIMASSSSTVALRTISSFSLKPATTTRSLLNTSTSSTITLLPFTSANSFLSKTLKLNTSSPHSHLSLPLNKSFTCRSQAEPSSDSAKVQELSVYEINERDRGSPAYLRLSQKTVNSLGDLVPFSNKLYSGCLQKRVGITAGICVLIQNKSEKKGDMYEAIYSFYFGDYGHISVQGSYLTYEDTYLAVTGGSGIFEGAYGQVKLHQIVFPFKLFYTFYLKGIKDLPQELLSKPVEPSPSVEPSPSAKACEPHAVIAGFTD

SEQ ID NO: 11036 - protein, 342 aa, Blastopirellula marina DSM 3645
MDRVPSIRIFAAVLLAALIVGVASAQEPTAMLDRTIQLRPEPGRLHPPVISDISIHPAGAIFAAAGDDHIVRVFEMDSGNELYRLEEHHDWVRAVKFSPDGATLATAGNDRRIILWDVERRAQLRSMGEFPYAVADVAFNKAGTMLAIVGFGPTIAIHDPITGQKLHELEAPINDMRCVSFSPDGAIVAAAGRNGVIRTWDAVSGRPLGDVKAHRQRIHSLVFSSDSSQLISCSDDRTIKVTDLGQNKERTSMSSAPAKVMALTLINDTTLVSAGSDNRLRLWDLTTHAEIAKLEGHSGSVTAIDVYNDVIVSGGFDTTVRIWKIQSGERTAQSPQGSLFTK

SEQ ID NO: 11037 - protein, 426 aa, Blastopirellula marina DSM 3645
MSRTRSHEIFQRALQLMPGGVNSPARAFGGVGGEPLVFERGEGAYLIDVDGNRYIDYIGSWGPMILGHGNEQVRAAIHAAVDQGTSFGAPTERENTLAELIIELVPSVEKVRLVNSGTEATMSAIRVARGFTGRNKIIKFAGNYHGHVDSLLVAAGSAAATLGVPNSPGVTPGTTADTIVLPYNDPAALAAVFEQHGDDLACVIFEPIVGNMGTVIPKPEFLAAIRELCTKHGAVMLMDEVMTGFRVALGGAQQLFGVTPDLTTMGKIVGGGLPIAAYGGRADIMNHVLPAGQVFQAGTLSGNPLATAAGIATLSILKETNPYPRLEQLGERLMTGLAKAAADAGAPYSVARVGSMATLFFGAGTVVDWDTAEKSDTERYADFFWGLIDRGVYFPCSQFEALFISVTHTDEDIDTTIAAARASLQA

SEQ ID NO: 11038 - protein, 410 aa, Kineococcus radiotolerans SRS30216
MTTTTSSGNRAVAYLGPGKVEVQNIDYPTFELKDGPGVNPANVGRKVEHGVVLKLVATNICGSDQHMVRGRTTAPPNLVLGHEITGEIVEKGRDVEFLEVGDLVSVPFNIACGRCRNCKERKTGICLNVNPDRPGSAYGYVDMGGWVGGQAEYVLVPYADFNCLRFPDKDQAMEKILDLTMLSDIFPTGFHGCVSAGVGVGSTVYVAGAGPVGLAAAVGAQLLGAAVVIVGDLNAERLERARSFGCETVDVSKGDPKDQIEQILGVPEVDCGVDAVGFEARGHGSGASGEAPATVLNSLMEITAAGGALGIPGLYVTGDPGGVDEAAKKGSLSLDLGTGWAKSLAFTTGQCPVMKYHRGLMMAILHDKVQIAKAVGATAISLDEAPEAYAKFDAGAPQKFVIDPHGMIPR

SEQ ID NO: 11039 - protein, 415 aa, Salinibacter ruber DSM 13855
MSSSPSSSSPSSEKPFDTIEDALATIRDGGLAIVVDDEDRENEGDFIGAAEAMTPDLVNFMTKEGRGLLCTAIPPERAEELDLDLMVDANSSLYSTPFTVSVDYRQGTSTGISAADRAKTIRALADPDASPYDFARPGHVFPLRARTGGVLRRAGHTEAAVDLARLAGLEPAGALVEIMNEDGSMARVPQLRERAQALDMPLITIQDLIAYRMQNERLIERAAEVDLDTAFGTFQVVAYEETLTGDVHLALLKGDWAEDEPVLVRVHSQNVLGDVLAARRESYSEELAEALLQVEHEGTGAILYMMQSNHGQGLLSKLKDLERHQNQDDGAPTDVSLEMDHRDYGIGCQILRDLGIRKLRLLTNNPRKRIGLAGYGLELVEQTPIELPTEARDHLSTVAADRLTPLLMELIDAGT

SEQ ID NO: 11040 - protein, 320 aa, Kluyveromyces lactis NRRL Y-1140
MGKAVKKKYSGASSGGKEVDAEKHLTTVFKFNTDLGQHILKNPLVAQGIVDKAQIKPSDIVLEIGPGTGNLTVRILEQARKVVAVEFDPRMAAELTKRVHGTPVEKKLEILLGDFMKTELPYFDVCISNTPYQISSPLVFKLINQPKPPRVSILMFQREFAMRLLARPGDSLYCRLSANVQMWANVTHIMKVGKNNFRPPPKVESSVVRIEIKNPRPQVDFNEWDGLLRIVFVRKNRTIAAGFKSTTVLEILEKNYKAFLATQSAVPTTSSGDSLINEVKEKIEQVLSETGLAEKRAGKCDQTDFLKLLYGFHQVGIHFA

SEQ ID NO: 11041 - protein, 187 aa, Triticum aestivum
  misc_feature (180)..(180): Xaa can be any naturally occurring amino acid
  unsure (1)..(187): unsure at all Xaa locations
MMARRQRGFRLGRKLLGLWRRALCNRRRRGYARLQRCQLGAGAKPSHAAVGSAKQQQQQLVVLPRERERDEPRRMLGWGRSLARRMRLLPRRGERLLEEAGEATTPKGQVAVYVGGDEPGGESMRYVVPVVYFNHPLFGELLREAEEEFGFEHPGGITIPCAATRVRARRPPWPAAGGGXGRPPGWW

SEQ ID NO: 11042 - protein, 199 aa, Glycine max
  misc_feature (166)..(166): Xaa can be any naturally occurring amino acid
  unsure (1)..(199): unsure at all Xaa locations
MELLLPSLVMVFALVLCFESLPSVRVQSSTTSPGSSSKREEAKALDALLQQFAYRALVNPKTGIIYNATQLPSNLTEIEVAALRLRSGSLRRKGFQAYNEFEIPKGLIVSPYVERLVLVYQNLDNWSSRYYYPLPNYTYLAPVLGLLAYEGSNLSATNLSELDIRXSEGPILVKFRNVKQAPHGAVAKSIWFDLQGFFQ

SEQ ID NO: 11043 - protein, 452 aa, Frankia sp. CcI3
MVVPSAAPASEELFRRAERVVPGGVNSPVRAFRAVGGTPRFMVAGNGPYLTDADGRTYIDLVCSWGPMILGHAHPAVVEAVSRAVSVGTSFGTPTPGEVELAELIVDRVGPVEKVRLVNSGTEATMSAVRLARGFTGRSTIIKFAGCYHGHVDALLASAGSGVATLGLPDTPGVTGAATADTIVLPYNDLALVEAVFVERGETIAAVITEAAAANMGVVPPLPGFNAGLRRLCDIHGALLILDEVMTGFRISRAGWWGNEGAIEDWSPDLFTFGKVMGGGLPAAAFGGRADVMARLAPAGPVYQAGTLSGNPIAVAAGLATLRACTDEVYATVDTRAADVAGIVSTALTEEGVAHLPSSAGSLFSFFFTDAATVVDYAGAQAQNTARYAAFFHSMLDAGIYLPPSAFEAWFVSAAHDDETVERIAAAAPAAARAAAAVPEPVTVSASPEGRA

SEQ ID NO: 11044 - protein, 455 aa, Geobacter metallireducens GS-15
MLTRTDGKGSKVLLIAAMDTKGTEARYIESWLAKAGFTTLIMDMGIRGKRPGPVAVTRDEVLRAAGKTWDDIQNVTSEGDAVDIMISGGVKCALALYKADLIQGVISLGGTMGTTLGTGVMRAFPIGFPKVMISTIAAKDTEAFIGNMDIFMLNSVSDLAGLNRITRKVLRNGALAIAGLVREREFHDEFSRPLAVLTTLGTTEATAARMRIHFEAWGYESVTFHTTGTGGQAMERMVNFEPVSAVVDLSLHELIDHHFGGAFDPGPERGRAALQKGIPTVIVPGNIDFLVTGPMAQAQIYFPGRRGHKHNANITCVRTSLEEIQRIAEIMAGYCNESTGPVAVLVPMKGFSCLDHEDGPQPDPEGPRVFAETFARALTRTIHFETVPLHINDEAFSEVIVGALQKIGGLRKIEADRLPSRQPATWSPYSSVHTLDRFSGNQHTTTETTGDALAA

SEQ ID NO: 11045 - protein, 304 aa, Triticum aestivum
  misc_feature (180)..(180): Xaa can be any naturally occurring amino acid
  unsure (1)..(304): unsure at all Xaa locations
MALATPLRHLLAAQPEPAAGAAPSLALTQPGRAFPPHRGVRFRARHAAAPLSSPPARAAGVAARAAGGGRPTVLVTEKLGAAGLELLRAFANVDCAYELTAEELRAKVSLVDALVVRSATRVTREVFEAARGRLRVVGRAGVGIDNVDLQAATEAGCLVVNAPTANTVAAAEHAVALLAXMARNVAQADASLKTGKWQRSKYVGVSLVGKTIAIMGFGKVGSEVARRAKGLGMDVIAHDPYGPVDRARAIGVDLVSFDDAISTADFISLHMPLTPSPQKFSTTKTLAKMTKGLRFFKFARGWIG

SEQ ID NO: 11046 - protein, 420 aa, Thermoplasma volcanium GSS1
MSSKELFELAAKLFPMGVNSPVRYFKDYPFYVKEGKGSTILDVDGNKYIDYCLGYGPLILGHSDPDVTRAVIEQAEKGLLFGEPSENEIKLAEMIKETSKNIEMMRFTNSGTEATMHAIRLARAITGRKLIVKMEGGFHGAHDYSLIKSGSGTLTFGSPSSPGIPDEVAQTVIVGKYNDENNIKEIFQKYGDKIAAVITEPIMGNAGVILPKQGFLEFLRDITQKHGSLLIFDEVITGYRFAFSPFQDIMRIDPDITTMGKIIGGGLPIGLFGGSEEIMKNISPSGNVYEAGTFSGNPMSMAAGYAAMEKLSKQDYSILKKRTQKLVSGIDDILDRKHITHTIKYYGTMFQVFFADHVNNYDDALKARKEVYFKLFKALSKNGVYLPPSQYETNFVSFAHSDSDIDATLAAFEKAVAEMD

SEQ ID NO: 11047 - protein, 449 aa, Kineococcus radiotolerans SRS30216
MTKDSRHRAAHVTQDRLTLRSGGLPGRPPTACRSNRVTRSGRGGGDGRARPDRFPPMTDGGQASARSWSAAWSEDDLEDGQIDLSDFHAVVPAGGAGTRLWPLSRSDRPKFLLDLTGRGRTLLQSTWDRLLPLTEASRTWVVTGRSHADAVAAQLPDLPGENLLREPCQRDSAAAIGLAAAVLVRRDPDAVLGSFAADHNISGRDDFESSVEEAVVTARRGFVVTIGIAPSHPATGFGYIRLGKRLRLQGAPNARRVVQFKEKPDARTAAAYLSTGDYRWNGGMFVARADVLLELLAAHAPALHAGLQRIADAWDTPQRDAVLEEQWAALPAIAIDHAVAEPAAEEGRVAVVPATFGWDDVGDFSSLAELLPADVDMPKVLGDPHLVITEGVAGGLVVPGNDRVVALLGVDDLVVVDTPDALMVTTRARAQEVKKLVARAREAGLDHVL

SEQ ID NO: 11048 - protein, 100 aa, Brassica napus
MEMKWLLTSAFTQMFGYSNQISQTSNSLSTRNKIKMMKKEEYPRGFQVPLHYPKYSKSDYEAMDDLSLDLLLKQYGISFEGSLEDKRVFAMESFLWPDQL

SEQ ID NO: 11049 - protein, 278 aa, Hypogymnia physodes
VEHGDVKVVAVNDPFIEPHYAAYMLKYDSQHGQFKGTIEVKGSDLVVNGQTVKFYTERDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTHLNGDNHSCIFDATAG

SEQ ID NO: 11050 - protein, 148 aa, Glycine max
MARQTFIMIKPDGVQSGLIGEIISRFERKGFYLKGLKLVTVDRPFAEKHYADLSAKPFFSGLVDYIVSGPVVAMIWEGNVVTTGRKIIGATNPAQSEPGTIRGDFAIDIGRNVIHGSDSVESANKEIALWFPEGPANWQSSQHSWIYE

SEQ ID NO: 11051 - protein, 76 aa, Brassica napus
  misc_feature (60)..(60): Xaa can be any naturally occurring amino acid
  unsure (1)..(76): unsure at all Xaa locations
MGFLFSLQVLLFLSLSQKLSAQPPPTNVTSSSLDALLQDYSFRAFVRPRTGILYDAAAPXNFTGIKLAAMRLRSGS

SEQ ID NO: 11052 - protein, 351 aa, Xanthomonas oryzae pv. oryzae KACC10331
MATMAAHLLYRLPVPMSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 11053 - protein, 699 aa, Oryza sativa
MVVSVSLPCWTEITHYYSPSPWERTWIELLFAHAGNTPMDRRLILSVAVAVALLAPRAAGEPWPVCGQDFGTFTPKSRFFANLQLIAATLPGNASSSPDLYATAVDVGAVPEQVTAAALCRGDVSASSCLGCLTQAFADLPNACGNSREAATYYDRCMVSYSAINFLSGGAGGEDPARIDAYTVNNENKVTSEQGRYNRLVAALVNATADYAAYNSTRRYAAGEADFDAALPKVYSLAQCTPDLSPARCRSCLAKIVAQELWSYKDDIGGRTLSVRCSFRIETKPFLNGTTMVRLPATSAPSPAPPVNATPSAATPGRETKYKVPRLVLIILLPIIAAVNLVVCFCVWRRKRPVITKAKQTNANYYAEADDVDSVDSMLMDISTLRAATGDFAESNKLGEGGFGAVYKGVLPDGNEIAVKRLSKSSTQGVQELKNELALVAKLRHKNLVSFVGVCLDQHERLLVYEFVPNRSLDLILFDTEKREKLDWEKRYRIINGVARGLQYLHEDSQLKVVHRDLKASNILLDANMNPKISNFGLARIFGQDQTQAVTNRVVDTYGYMAPEYMMRGNYSVKSDAFSFGVMVLEIVTGRKNNDFYNNSHQSEDLLNTIWERWMAGTVDEMVDPAMSRYVSASDVRKCVHVALLCVQENPADRPVMSSVVMMLDSETVSLQVPSKPAFFARNGGAKPGVASDESTASV

SEQ ID NO: 11054 - protein, 355 aa, Zea mays
MTSGAGGAAAGIGGTRVPTWRERENNRRRERRRRAIAAKIFAGLRAYGNYNLPKHCDNNEVLKALCNEAGWTVEPDGTTYRKGCKPLATERPDPIGRSASPSPCSSYQPSPRASYNPSAASSSFPSSGSSSHITLGGSNFMGGVEGSSLIPWLKNLSSSSSFASSSKFPQLHHLYFNGGSISAPVTPPSSSPTRTPRIKTDWENPSVQPPWAGANYASLPNSQPPSPGHQVAPDPAWLAGFQISSAGPSSPTYSLVAPNPFGIFKETIVSTSRMCTPGQSGTCSPVMGGAPIHHDVQMADGAPDDFAFGSSSNGNNESPGLVKAWEGERIHEECASDEHELELTLGSSKTRADPS

SEQ ID NO: 11055 - protein, 584 aa, Sinorhizobium meliloti 1021
MPHTPLIATLVAGLGLAFILGTLANRLRLSPLVGYLLAGVLIGPFTPGFVADQALARQLAELGVILLMFGIGLHFSLHDLLSVRTIAVPGAFGQMALVTSLGFIVTQAIGWPIGAGLVFGLALSVASTVVVLRALQEKRQLETDGGRIAVGWLVVEDVAMILALVLLPAFADVLGGTANRAEPENSGMLTFFEPHTISGALGLTLAKLAAFFALMAIVGRRVIPAILHYVAHTGSRELFRLAVLAIALGVAFGAAELFGVSFALGAFFAGMILAESQLSQRAAQETLPLRDAFAVLFFVSVGMLFNPMILVEQPLLVAATFLIIVIGNAAAASAIAVMFGYSLPIAVTLGLSLAQIGEFSFILAGLGVELNLLPETGRDLVLAGAILSILINPLLFAGLDRLMPRLENRAPVRTEEEGRIDITPKLTTTSLTDHAILVGYGRVGRLVAETLQNAGQPYLIVEERQVVADQLRAGGVDVISGNAAQPGLLEAANVNSAKWLISAIPNPFESGNFIEHARATNPKLEIIARAHSDAEVEYLKRLGANLIIMGEKEIARSISEHILSNINAPDTTTPSDSESRLTSE

SEQ ID NO: 11056 - protein, 278 aa, Everniastrum sp. Feuerer s.n.
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGELKGIMSYSEDALVSTDLNGDNHSCIFDATAG

SEQ ID NO: 11057 - protein, 529 aa, Streptomyces avermitilis MA-4680
MSSKPVVLIAEELSPATVDALGPDFEIRHCNGADRAELLPAIADVDAILIRSATKVDAEAVAAAKKLKVVARAGVGLDNVDVSAATKAGVMVVNAPTSNIVTAAELACGLLLATARNIPQANSALKNGEWKRSKYTGVELAEKTLGVVGLGRIGALVAQRMSAFGMKVVAYDPYVQPARAAQMGVKVLSLDELLEVSDFITVHLPKTPETLGLIGDEALRKVKPTVRVVNAARGGIVDEEALFSALKEGRVAGAGLDVYAKEPCTDSPLFELDEVVCTPHLGASTDEAQEKAGISVARSVRLALAGELVPDAVNVQGGVIAEDVKPGLPLAEKLGRIFTALSGEVAVRLDVEVYGEITQHDVKVLELSALKGVFEDVVDETVSYVNAPLFAQERGVEVRLTTSSESSDHRNVITVRGTLGNGEEVSVSGTLAGPKHHQKIVAVGEYDVDLALADHMVVLKYTDRPGVVGTLGRILGGAGINIAGMQVSRAVAGGEALAVLTVDDTVSQNVLTELAEEIGATSARSVNLV

SEQ ID NO: 11058 - protein, 169 aa, Zea mays
  misc_feature (121)..(121): Xaa can be any naturally occurring amino acid
  misc_feature (139)..(139): Xaa can be any naturally occurring amino acid
  unsure (1)..(169): unsure at all Xaa locations
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIPVGDFAIDIGRNIIHGSDSXVESANREWGRCGSLDGPXVNWQSSLSFLGSTNEFLYRSVIPFGFRVVC

SEQ ID NO: 11059 - protein, 276 aa, Everniastrum americanum
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGELKGIMSYSEDALVSTDLNGDNHSCILDAT

SEQ ID NO: 11060 - protein, 569 aa, Escherichia coli; identical to SEQ ID NO: 371

SEQ ID NO: 11061 - protein, 214 aa, Arabidopsis thaliana
MLFLISFSNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQLLEMTM

SEQ ID NO: 11062 - protein, 331 aa, Beta vulgaris
MAELNNGGHSKELVVSFGEMLIDFVPTSSGVSLAEAPGFLKAPGGAPANVAIAVSRLGGNAAFVGKLGDDEFGHMLAGILKKNGVSADGLSFDKGARTALAFVTLKSDGEREFMFYRNPSADMLLTPDELNLDLIRSAKVFHYGSIRLIVEPCRSAHLKAMEEAKKAGALLSYDPNLRLPLWPSAEEAREQIMSIWDKAEVIKVSDNELEFLTGNSTIDDATAMSLWHPNLKLLLVTLGDQGCRYYTKNFKGSLDGFKVNAVDTTGAGDSFVGALLNKIVDDHSIIEDESRLKEVLKFANACGAITTTKKGAIPALPTVADALELIKKNAS

SEQ ID NO: 11063 - protein, 342 aa, Ashbya gossypii ATCC 10895
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 11064 - protein, 111 aa, Blastopirellula marina DSM 3645
MTDAPMEITVSEVKQLLDSGDKFLLLDCRQPDEHQFANIAGAVLIPMNELPQRIAEIEPFRDAPIVVHCHLGGRSLRVTHWLRQNGFMQSQNMTGGITQWSAEIDSTVPTY

SEQ ID NO: 11065 - protein, 1196 aa, Prochlorococcus marinus str. MIT 9312
MRLVHINQVEFENFKSFGGSVKIPLEEGFTVVTGPNGSGKSNILDGILFCLGLANSRGMRAERLPDLINNSKVKEGKSSETFVSVKFNIQDWSPREDLPPLELEEEEIALKKGQKEWVVSRKLRLMPGGSYASTYTSDGKQCTLQQIQRILRDISVDPEGSNVVMQGDVTRIVSMNNKERRNLIDELAGVALFDTRIEQTNAKLNDVFERQERCEILENELQSSKNKLEKECEKAKRYKELKAKLLQITELEKVLIFDKQVKHVESIEKKETEIEKNKILFNEQKESINKEISVLEGALKILVAELKEKGEDTLIKVNSDIGSINSSLRELDRVSSLNKEEGIKLQKQRDEIAISKRNIESEKMRQENFDENFLNKLNLQIDDLTLKHKLSRKKLSDAAGESGEFSKQSIKLNAELESIKNKINPLEIKKRKVEEETIQNNIQKDAISSQIDALALEKQKLLEGNQIKKETSEINKNNLASNSLEINSLKNEIDLLNKTKLRLNNEQLRLEKDLSRFESRKEALNESRGSYALRILLEAGLEGIHGYVAQLGEVSEKNRYALEIAAGNRLGQIVVDNDHIAAKAIEILKKKKAGRLTFLPLNRIKSQKKNYAISRFENNREHGFIDKAINLITFDEVYSDVFRYVFGDTLVFSDLASARLSKQKNRLVTLSGELLEASGAITGGSKLNKDLAYRFGINNDLDDSSPIKERLLVIEEALRESNNDLIIKNNRLNKLNSNRSHIIEDCASFNKEIEVNKNSVEVVMKRIQDFKLSLNKLDSANNLLVEELDSLKNELKPHHDKFDQLQIILKENYEKNQKSSLIAFNNDFNNLDKKLELHIKERDTLLDKKNQFALNKERINNSLKITLLQEKNLQESIKELAIAHSEWIEKRDKFKKELLVLNNQKNSLEKDLGFLRRKRDELNSSISNKRQEYNNYLLKLEYLERDMHSLKEEMRSEKIKLENYKKDLPNPFPKLEEYEEKSLESVQSEISIINAKLQSLEPVNMLALDELEELIERLNGLREKLAILSNERSELLLRIETVSTMRQEAFMQAFLEVDKHFREIFANLSDGDGFLQLENTNSPLEGGLTLVAHPKGKNVRRLASMSGGEKSLTALSFLFALQKYKPSPFYALDEVDSFLDGINVERLSKLISNQSSNAQFIVVSHRRPMISASERTIGVAQARGANTQVVGLPNAA

SEQ ID NO: 11066 - protein, 329 aa, Arabidopsis thaliana
MDIDASCSLVLYGKSSVETDTATRLKNNNVLKLPDNSKVSIFLQSEIKNLVRDDDSSFNLSLFMNSISTHRFGRFLIWSPYLSSTHDVVSHNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQGLTSSGYLLAIGDDNVMYELHPDGNSFDFFKGLVRRKL

SEQ ID NO: 11067 - protein, 343 aa, Mesorhizobium loti MAFF303099
MARSRLGFLAETLMPDYDVLCIGNAIVDIIAQCEEEFLETNGIIKGAMNLIDTHRAELLYSRMGPAIEASGGSAGNTAAGVASFGGRAAFFGKVSNDGLGEIYTHDIRAQGVAFDTTPLQGEPPTARSMIFVTPDGERSMNTYLGACVELGPEDVEADKASGAKVTYFEGYLWDPPRAKEAIRQTARLAHAAGREVSMTLSDSFCVDRYRDEFLDLMRSGTVDIVFANSHEIKSLYQTSSFDEALANIRKDCRIAAVTRSEKGSVIVRGDETVVIQATAIRELVDTTGAGDLYAAGFLHGYTQGRDLKTCGDLGSLAAGLVIQQIGPRPRQNLRREAEQAGLL

SEQ ID NO: 11068 - protein, 356 aa, Salinibacter ruber DSM 13855
MRYAVIMAGGIGTRFWPVSRKEHPKQFLDIFGDGTLIQNTIARLQGLVPPERCLVVTHERYVEKTKKQLPAVPEENILAEPISRNTAPCIAYAATTLAKRDPDATMAVLPADHVIGNVARFHDTLDVAFDAAQERDALVTIGIDPTYPATGYGYIQYDGSGADPPALEAYPVRTFAEKPDQSTAERFIDAGDFLWNSGMFIWRADTILDQIETHLPDAHEAFAPVRAADGAADSETLTEAFRESPRISIDYGVMEQADTVYVVPGTFDWNDVGDWRAVYDLSEKDEHGNVIEGEVIMQDSSRCYVQTEDRLVVLVGIHDKVVVDTGDAVLVCDRESAQQVKQVVEYLHAHQFEEYV

SEQ ID NO: 11069 - protein, 142 aa, Glycine max
MASSFVGTLLPNHFTQTKHSAVPASRSGAPRRRRVHLATTRAETMTTVIEKLGIKIERNPPESKLTQLGVRQWPKWGCPPSKFPWTYEAKETCYLLEGKVKVFPSGSNESVEIAAGDLVVFPKGMSCTWDVSVGVDKHYNFE

SEQ ID NO: 11070 - protein, 114 aa, Arabidopsis thaliana
MTTKKIEIKVDIDCEKCKHAIMEAVTELEGVNIVSLDQEKSILTVVGTMDPVCVAEQLKKINKKPVVISVGPPKKPDPKPDPKKDPCFIPYCYYTPRDMVSVNTYESGSGCTIV

SEQ ID NO: 11071 - protein, 358 aa, Fragaria x ananassa
MTAYRGKYADELIKNAAYIGTPGKGILAADESTGTIGKRFDSIKVENVEENRRALRELLFTAPGVLQYLSGVILFEETLYQKTAEGKPFVDVLNEGGVLPGIKVDKGVVELKGTDGETTTQGLDGLGARCAKYYEAGARFAKWRAVLKIGPNEPSQLSINENANGLARYAIICQENGLVPIVEPEILVDGPHSIDKCADVTERVLAACYKALNDHHVLLEGTLLKPNMVTPGSEAKKASPEVIAEYTVRALQRTTPAAVPAVVFLSGGQSEEEATLNLNAMNQLKGKKPWTLSFSFGRALQASTLKAWSGKKENVKAAQEALLTRAKANSEATLGTYKGDAKLGEGAAESLHVKDYKY

SEQ ID NO: 11072 - protein, 156 aa, Triticum aestivum
MDASGTGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKTAKSPKKADKKA

SEQ ID NO: 11073 - protein, 224 aa, Pseudomonas fluorescens PfO-1
MTQDQLKQAVAQAAVDFILPKLDDKSIVGVGTGSTANCFIDALAQHKGAFDGAVASSEATAARLKGHGIPVYELNTVSNLEFYVDGADESDEHLNLIKGGGAALTREKIVAAVAQTFICIADASKLVPVLGAFPLPVEVIPMARSHVARQLVKLGGDPVYREGVLTDNGNIILDVHNLQITNPVELEAQINAIVGVVTNGLFAARPADLLLLGTSEGVKTLKAE

SEQ ID NO: 11074 - protein, 272 aa, Salinibacter ruber DSM 13855
MLSNDTVAVIGAGNIGHSLIGGMIGGNLIETEDVIATRRTGSALDALAEEFPGLRTTTDNVEAVQDASIILLTIKPQSRAEVITNIRDHVDRDVLVISVLAGITSERLQLGFGQDQPVIRAMPNTPALVDAGATALSPGTYATDAHLEKARAIFEAVGNAVVVPEDHMDAVTGLSGSGPAYVYMFIEALTDAGVKQGMSREDASTLARQTVYGAAKLAIDTDKHPAILRDEVTTPGGTAIAAVSSLEEHGLRTMLINAVGTATQRSEELNDE

SEQ ID NO: 11075 - protein, 512 aa, Oceanobacillus iheyensis HTE831
MSQNKLAALIILDGFAIRDEVKGNAVKQANTPNFDRFWNQYAHNQLEASGKAVGLPDGQMGNSEVGHLNIGAGRIVYQSLTRVNVSIDEGDFYEVDAFIKSVEHAKKHDKALHLFGLLSDGGVHSHINHLFALLRLAKKHELENVFVHAFLDGRDVGPKTASKYIKETQDVMDELGVGQFATISGRYYSMDRDKRWDRVKKCYDAMVYGEGPSYKSAQEVVDDNYANEIYDEFVIPSVITDDNDEPVATIKDEDSIIFYNFRPDRAIQISRTFANEDFRDFERGDKAPKKLDFVMLTNFSETVDGYVAYQPVNLDNTVGEVLAQNNLNQLRIAETEKYPHVTFFMSGGREKEFPGEKRILIDSPKVATYDLKPEMSVYEVTDALLKELDKGEQNAIILNFANPDMVGHSGKLQPTIDAIEAVDECLGKVIDKITELGGHAIITADHGNSDEVMTLEDKPMTAHTTNPVPVIVTKDDIELRDGGILADLSPTLLDLLNVEKPKEMTGNSLIKK

SEQ ID NO: 11076 - protein, 252 aa, Oceanobacillus iheyensis HTE831
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 11077 - protein, 354 aa, Fusobacterium nucleatum subsp. vincentii ATCC 49256
MIEEVMKKIAGLSDIQVNDVLASEDIYNYRNKIIEPFSVYANKIITGFFKRKSHEVFEVDENILNSKLGNKIIKELKEILNKNKISVYDENTHKGILRNIMIRPNSNNEAMVVLIINSNKITENIKKILFKLRENIKEIKSIYISLNSKKTNTVIGEKNILIYGEKSIKENINGIEFHISPTSFFQINVKQAKRLYDIAISFFDNIDNKYIVDAYSGTGTIGMIIAKKAKKVYAIEIVKSASEDGEKTAKENGIENIEFINGAVEKEIIKLINNNKRIDTIIFDPPRKGLEASIIVTVAKLNLKEVVYISCNPSTFARDVKLFAEKGYTLKKLQAVDMFPQTSHIECVGLIVKE

SEQ ID NO: 11078 - protein, 335 aa, Oceanobacillus iheyensis HTE831
MAVKIGINGFGRIGRNVFRQSLKNNEVEVVAINDLTDANMLAHLLKYDSVHGKLQEEVTVNGSNLVIDGKEIKVLSERDPAELGWGDLGVDIVIESTGRFTNKEDAEKHIQAGAKKVIISAPAKGEDLTIVMGVNDDQYDPSEHNVISNASCTTNCLAPFAKVLNDNFGIKRGLMTTIHSYTNDQQILDLPHKDYRRARAAAENIIPTSTGAAKAVGLVLPELNGKLNGNAVRVPTPDGSLTDLVAELDKNVTIEDVNNAMKEAAEGPLKGILEYSEEPLVSSDIVGNNHSSIFDALSTIVMEDNMVKVVSWYDNEMGYSARCIDLAIFMNNKGL

SEQ ID NO: 11079 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 11080 - protein, 215 aa, Brassica napus
  misc_feature (10)..(10): Xaa can be any naturally occurring amino acid
  misc_feature (66)..(66): Xaa can be any naturally occurring amino acid
  misc_feature (72)..(72): Xaa can be any naturally occurring amino acid
  misc_feature (116)..(116): Xaa can be any naturally occurring amino acid
  unsure (1)..(215): unsure at all Xaa locations
VPYPATTETXSLAQEAHIFEAIQSPYQVLGDHYPSPTALRIKEKAVTNVGDRLTEEKRLEDLRTLXTKLRPXYSPIRKTKTAKIITRAHRCWMQRCPEQLSSVHPSGTKRVVRRTXAGKRTFLRQRVEARLAALLMENKEYVEALALLSTLVKEVRRLDDKLLLVDIDLLESKLHFSLRNLPKAKAALTAARTAANAIYVPPAQQGTIDLQSGIL

SEQ ID NO: 11081 - protein, 627 aa, Yarrowia lipolytica CLIB122
MNLWKLVLTAGLVMCESQAGQPTPSHPAPTLRSFEEWRIHNLLQSGQNLGSTPGSGPGHSNGGGGGSEPEMDPFTGEIDFLFAASDDPGKTYKDRFNYASFDCGATVVKSNKDVKGAGAILVENKDSYLLNKCVAGSKHVIIELCQDILVDQVVVGNYEFFSSMFKDIRISVADRYPVASGEWRVLGDFTADNIRDLQTFDITVPQIWARYVKIEFLSHWGHEYYCPISVVRVHGTTMMEEWKRSGGDGDIVAGEKLDESLQEETAQFEKAEETLHEEKMIQENVVEKSNPSLNHTVIEKGECTPKLSLDKVKLGLNEYCRLDEFYRKIERNNSNNNTDTTTNNQSNNSTTTPPTQESIYKTIMKRLSLLESNATLSLQYVEEQSKVLRDLLYKIEKKQNSKIDDFLFHFNATVLQQLVMFSQQREQKLNRAILELDLQKSQTDKNMAAISQRFAMLADDLVFQKRMSMFQGLILLVVLIFVALTRGTGPELSRRSRLMFNTDDSEDNSDFGSFRRHLRRNFKRNISSLSPRWSLNLTPQSPVSDDGVDEGLGLDSDSEDEHIESPPPPRTLGSPLATPGPKKKKSRSLYDEPVQWAGDTPEPVDYMSPAEDDDDKKDHRRDRNKEE

SEQ ID NO: 11082 - protein, 480 aa, Salmonella typhimurium LT2
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 11083 - protein, 553 aa, Aspergillus oryzae
MTTAIVTGTGRRSSIRQSDLQPPATDFISQSMTTSPIDKFPQFKDDLYEIAAGPRESHSNFATKYTPNDRWEPRKENNFASEYTNGTIRHSKHKPRKSISEAISTIRTRNASVSANAQELAQALRAPVSYKLISLCLIWYMTSALTNTSSKSILNALPKPITLTIVQFAFVSIWCLLLSYLSKILPWLRNSIPALKNGIRYPSRDVIMTALPLAVFQLAGHILSSMATSQIPVSLVHTIKGLSPLFTVLAYRVFFRIRYASATYLSLVPLTLGVMLACSTGFSTNFFGIICALVAALVFVSQNIFSKKLFNETARGESETQVSAQRKLDKLNLLCYCSGLAFILTLPIWVLCEGYPLLSNVLRDGSISLSGKENSLDHGALLLEFVFNGVSHFAQNILAFVLLSMISPVSYSVASLVKRVFVIVVAIVWFGNSTTGMQAIGIALTFIGLYLYDRNSHDDLADQRANADHFHTKENVLPLNIRSTTKTWDSNGYVFPPGKTSERQFLDETHSFPNDLKKDDDRPGRVRPRGSSNTRAWLPPGTKQETTWQPSDS

SEQ ID NO: 11084 - protein, 404 aa, Streptococcus pyogenes MGAS8232
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYLKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 11085 - protein, 143 aa, Arabidopsis thaliana
  misc_feature (20)..(20): Xaa can be any naturally occurring amino acid
  misc_feature (23)..(23): Xaa can be any naturally occurring amino acid
  misc_feature (26)..(28): Xaa can be any naturally occurring amino acid
  misc_feature (33)..(33): Xaa can be any naturally occurring amino acid
  misc_feature (41)..(42): Xaa can be any naturally occurring amino acid
  misc_feature (44)..(44): Xaa can be any naturally occurring amino acid
  misc_feature (56)..(56): Xaa can be any naturally occurring amino acid
  misc_feature (109)..(109): Xaa can be any naturally occurring amino acid
  unsure (1)..(143): unsure at all Xaa locations
QPPSESPQLFRRLGAPGSSXKGXPLXXXKLTSXEKSFAEKXXEXLPSKSFFSGLVXDYIVSGPVVAMIWEGKNVVLTGRKIIGATNPAASEPGTIRGDFAIDIGRNVIXGSDSVESARKEIALWFPDGPVNWQSSVHPWVYET

SEQ ID NO: 11086 - protein, 468 aa, Bacillus cereus ATCC 10987
MKQKRNSLYIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTWKKQTEYIS

SEQ ID NO: 11087 - protein, 430 aa, marine gamma proteobacterium HTCC2207
MTYAGPRSKELFDAAQKHIPGGVNSPVRAFRAVGGTPIFFDRAAGAYMFDADGKRYIDYIMSWGPMILGHGHPQVLDAIREQLEKAMTFGTPTELEILLADKICERVPGMDMVRMVNSGTEATMSAIRLARGATGRDKIVKFEGCYHGHSDSLLVKAGSGALTLGVPSSPGVPISLADHTITLSYNNIEQVRQTFAEIGDQIACIIVEPVVGNMNCVPPIPGFLQALRECCTASGAVLIMDEVMTGFRIGPQGASAYYEVMPDLVCLGKVIGGGMPVGAFGGKRELMEQIAPLGPVYQAGTLSGNPVAMAAGLTTLNLVSEPGFLDPLVRRTGDLVKGLRERAASAGIPLTSNHVGTMWGVFFSEEEKIVNYQQVMKCDTERFGKFFHGMLEAGIYLAPASYEAGFMSAAHTDDDIQFTLDAAEKVFKTL

SEQ ID NO: 11088 - protein, 278 aa, Parmotrema reticulatum
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGPLKGIMSYSEDALVSTDLNGDNHSCIFDATAG

SEQ ID NO: 11089 - protein, 373 aa, Erwinia carotovora subsp. atroseptica SCRI1043
MQMIKTRAAIAWGPNQPLSVEEVDLMPPQKGEVLVRIVATGVCHTDAYTLSGKDPEGVFPAILGHEGGGIVEAIGEGVTSVAVGDHVIPLYTPECGECKFCRSGKTNLCQAIRSTQGKGLMPDGTTRFSKNGQPIFHYMGTSTFAEHTVVPEISLAKVNKEAPLEEVCLLGCGVTTGMGAVLNTAKVKAGDTVAIFGLGGIGLSAIIGAHMAGAGRIIGIDLNTSKFDLARKLGATDLLNPKDYDKPIQDVIVELTDGGVDFSFECIGNVNVMRSALECCHKGWGESIIIGVAGAGEEIATRPFQLVTGRVWRGSAFGGVKGRSELPGLVDRYLKGEFPLNDFITHTMGLDDINTAFDLMHEGKSIRTVIHFG

SEQ ID NO: 11090 - protein, 490 aa, Erwinia carotovora subsp. atroseptica SCRI1043
MQLKQSISLKQQVLFRQHCLIDGEWQDSQSGERLNVTNPATGEVLGTVPLVTVSQTEQAIAAAEQALVEWRKKTGKERAALLQAWARLIMDNQDDLAVLLTAEQGKPLAEARGEIAYATSFIDWFAEEAKRIEGSVLQSPQGQQRLMVIKQPIGVCAAITPWNFPAAMITRKVGPALAAGCTMIVKPAEQTPFTALALAELAQQAGIPRGVLQVIVGDAQSVGKVLCDSPVVRKLSFTGSTEVGRILMAQSAPTVKKLSLELGGNAPFIVFDDADVDQAVKGILASKFRNSGQTCVCANRIYVQNGIYPTLVERLIEEVRKLNVGDGTQPGVTQGPLIDDDAVSKVEQHIADALSHGATLLLGGQRHERGGTFFTPTIVGDVTREMRFAREETFGPVAPLFRFSDEAEVIAMANDTEFGLAAYVYTRDAIRQWTVPEALDYGMVGINTGLISNEVAPFGGVKQSGLGREGSRFGIEDYLEMKYLCVDLSR

SEQ ID NO: 11091 - protein, 297 aa, Arabidopsis thaliana
MDIDASCSLVLYGKSSVETDTATRLKNNNVLKLPDNSKVSIFLQSEIKNLVRDDDSSFNLSLFMNSISTHRFGRFLIWSPYLSSTHDVVSHNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQLLEMTM

SEQ ID NO: 11092 - protein, 271 aa, Parmotrema perlatum
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKKTMKEASEGPLKGIMSYSEDALVSTDLNGDNHSC

SEQ ID NO: 11093 - protein, 422 aa, Burkholderia sp. 383
MDRLAKKNEWFARAEKVIPGGMYGHQSVKYLTEDFPLYFAKAKGTHLWDVDGNKYIDYVCGYGTNLFGYGNERIEQAAALQLQKIDTATGPSEVMVQLAEALTQQVSHADWAMFCKNGSDATSMAMVISRAYREKRKILVARGTYHGASPWNVPYTTGITKEDRAHIVYFEYNDIESLNAAVKSVDGDVAAIYATPFRHEVLYDQFFPSIEYAKECRRLADEQEALLVVDEVRTGLRLSRDCSWSDWGVHPDLSCWGKAIGGGYAIAAVLGSDKAREAATNVFVTGSYWLSAVPMAAAIETLRLVRETDYLEHTKRLADKLRAGIAEQAERHGFELKQTGPSVMPQMLFAGDDELVSRGRAWASEVIKNGAYLHPWHNMFFTASHTDDDIARTLEATEVAFGAIKQKAVAVSRLDILDTVQR

SEQ ID NO: 11094 - protein, 391 aa, Beta vulgaris subsp. vulgaris
MNRQIKNFTLNFGPQHPAAHGVSRLVLEMNGEVVERAEPHIGLLHRGTEKLIEYKTYLQALPYFDRLDYVSMMAQEHAHSSAVERLLNCEVPLRAQYIRVLFREITRISNHSLALTTHAMDVGALTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDLRRAAPYDVYDQLDFDVPVGTRGDRYDRYCIRIEEMRQSVRIIVQCLNQMPSGMIKADDRKLCPPSRYRMKLSMESSIHHFEPYTEGFSVPAPSTYTAVEAPKGEFGVFLVSNGSNRPYRRKIRAPGSAHSQGLDSMSKHHMPADVVTIIGTQDIVSGEVDR

SEQ ID NO: 11095 - protein, 278 aa, Bacillus halodurans C-125
MIQSIQDRVKLANGVEMPWFGLGVYKAAEGEEVIGAVRAALKAGYRSIDTASLYQNEVGVGQAIRESGIPRDEIFVTTKVWNTEQGYDETLAAFERSRKRLGLEVIDLYLIHWPVREKFLDTWRALETLYKERKVRAIGVSNFNIHHLETVMNISDINPMVNQVEFHPFLTQKPLLTFCKAHDIQLEAWRPLTKGEIFTHPVVQALAKKYGKTPAQIVLRWNLEHRVVTIPKSVREERIQENANIFDFHLSPEDVEALDGLNEDRRLGQDPDSFSFDF

SEQ ID NO: 11096 - protein, 286 aa, Arabidopsis thaliana
MLSFHLSPLFHFQASQRFGEKKPWILMLRVAWFYMSPYLSSTHDVVSHNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQGLTSSGYLLAIGDDNVMYELHPDGNSFDFFKGLVRRKL

SEQ ID NO: 11097 - protein, 366 aa, Oryza sativa
MPPKKAAPSKADLAKKQKVVEDKTFGLKNKNKSKNVQKYVQSLHQAVQPKPDPTKTAAKKKKEEEKAREKELNDLFKVAVSQPKVPVGVDPKSIVCEFFKVGQCQKGFKCKFSHDLNVQRKGEKIDIYTDKRDAETMEDWDQETLEKVVASKGAEYQQNKPTDIVCKYFLDAVEKKQYGWFWVCPNGGKDCHYRHALPPGYVLKSQMKALLEEESEKIAIEDEIEDQRKKVKTTTPMTTDLFMEWKRKKAEEREAGLAALRAERAKNDRMSGRELFMADSSVFVDDAEAYDVYERQEESEANEEPSNKNQDEGPSSSTSNGKEVEESDDEDINIDDDLDIDELNELEASLSRTSIQIREPGEGTSS

SEQ ID NO: 11098 - protein, 409 aa, Pseudomonas fluorescens PfO-1
MSKTSLDKSKIKFLLLEGVHQSAVDVLKAAGYTSIEYLTGSLPEAQLKEKIADAHFIGIRSRTQLTEEIFDHAKKLVAVGCFCIGTNQVDLEAARERGIAVFNAPYSNTRSVAELVLAEAILLLRGIPEKNASCHRGGWIKSAANSFEIRGKKLGIVGYGSIGTQLSVLAEGLGMQVFFYDTVTKLPLGNATQVGNLHELLGMSDIVTLHVPETAATQWMIGEKEIRAIKKGGILINAARGTVVELDHLAAAIKDKHLIGAAIDVFPVEPRSNDEEFESPLRGLDNVILTPHIGGSTAEAQANIGLEVAEKLVKYSDNGTSVSSVNFPEVALPAHPGKHRLLHIHENIPGVMSEINKVFAENGINISGQFLQTNEKVGYVVIDVDAEYSELAQEKLQHVNGTIRSRVLF

SEQ ID NO: 11099 - protein, 272 aa, Photorhabdus luminescens subsp. laumondii TTO1
MNNRVHQGHFARKRFGQNFLTDQFVIDSIAAAINPQPGQAVLEIGPGLGALTEPVGERMDKMTVVELDRDLAARLQVHPQLKDKLTIIQQDAMTVNFGELSQQRGKPLRVFGNLPYNISTPLMFHLFSYTDAIADMHFMLQKEVVNRLVAGPGSKTFGRLSVMAQYYCQVIPVLEVPPTAFTPAPKVDSAVVRLVPHKSIPHPVKNIRMLSRITTQAFNQRRKTIRNSLGDLFTVEQLTELGIDPSTRAENISVEQYCKMANWLSEQPEMQS

SEQ ID NO: 11100 - protein, 137 aa, Glycine max
MGCVDLINLTSTNIYRPVLTRTSNKPYITRGPSMAAIRAESVATEKLGIFIEKNPPESKLTQLGVRSWPKWGCPPSKFPWTYDAKETCFLLEGKVKVYPDGSDEGVEIEAGDFVIFPKGMSCTWDVSVAVDKHYQFE

SEQ ID NO: 11101 - protein, 480 aa, Geobacter metallireducens GS-15
MKEYRLFINGEWVPSSTGTMADDINPATGDVYAKVHQASRDDIEQAIASAYRARVDWGKTVPAQREAILIKAAAILEERIPEFAEVLIEEGGATFGKAMFESSFVVTLLRSAAGECRRIFGETIPSDAPGLFSMSVRRPLGVIAGISPFNFPFLLAMKKVALALAAGNTFVLKPASPTPVIGLKIAELFEAAGLPKGVLNVIPVKGSTLGNTLVEDPRIRMVTFTGSTDVGKQLAEVAGRHQKKITLEMGGKSPLIVLKDADIDYAVDAAVFGIFLHQGQVCMANSRLIVEADIYDRFCEKLTAKVKGLKMGDPHKPDTVIGPLIDAKQCAFIDSQVHDALADGARVLSGGRSEGAFYQPTIVADVTRKMRIFDEESFGPVVCVIKAANSEEALALANDSSFGLSAGLITNDLQKAFDLSLRLESGMVHINDSSIFDEPHVPFGGVKDSGVGREGGHYSMEEMTEVKWITVQMGKRQFPF

SEQ ID NO: 11102 - protein, 410 aa, Triticum aestivum
STHASGQNVHGKIKAMEQTLGRIKRMHDGCSGAVNRLRTSLHSTEERLQSHRKDANYLAQLPARSSPVGPRGRPLRLTNEYYSSNSNNKDFPNTEKLEDPELHHYAVFSDNVLAAAVVVNSTLVHAKKPANHVFHIVTDRLNYAAMKMWFLANPLGEAAVQVQNIEEFTWLNSSYSPVLKQLESSSMIDYYFGSGRARPGENPKFRNPKYLSILNHLRFYLPEIFPKLNKVLFLDDDTVVQQDLSALWSIDLKGKVNGAVETCGESFHRFDKYLNFSNPLIASNFNPHACGWAYGMNMFDLSEWRKQNITDVYHTWQNLNEDRLLWKLGSLPAGLVTFWNRTFPLDRSWHLLGLGYNPNVNEKEIRRASVIHYNGNLKPWLEIGLSKYRKYWSRHVNYDQVFIRECNINP

SEQ ID NO: 11103 - protein, 251 aa, Cryptococcus neoformans var. neoformans JEC21
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGKLSAAKDIDGFLVGGASLKPEFIDICKSGKKA

SEQ ID NO: 11104 - protein, 475 aa, Oceanicola granulosus HTCC2516
MKIVATLGPSSSSYEMIRKLHEAGADVFRLNMSHGDHAEIRARHEIIRQVEKDLDSPIGILADLQGPKLRVGTFANGEEELEPGQSFRLDLDEAEGDSARVRLPHKEIFDALEPGATLLVNDGKIRLKVKDCGGDFADCEVIVGGTISNRKGVNVPDVVLPLAALSEKDRKDLEFVCDLGVDWLALSFVQRRADVEEARALARDRARILSKIEKPAAVKAFDEILAASDGIMVARGDLGVELPVQNVPPIQKQLVRKSRAAAKPVIVATQMLESMIESPMPTRAEVSDVATAIYEGSDAIMLSAESAAGSYPVEAVSTMDNVAREVEADPNYRDIMIASRSISRTTVADGIVAAAREIAESTDILAICCFSESGTTALLAARERPETPILTMTTETSTARSLCLSWGVQTVMTGDVDRFKTAVVYAVRAARSELNATEDDNIIVIAGVPFNTPGSTNILRVAPCEERLIFRAEPG

SEQ ID NO: 11105 - protein, 381 aa, Prochlorococcus marinus str. NATL2A
MAYSETKVVLGGLAHIPIIIGFFYLIRRQYSFGAMLRTGKNALSEKVTKATPAKAATPAKAATPAKAATPAKAATPSKASAAKKPHADVPVNTYKPKAPFTGTVTENYSALKEGAIGKVQHITFDLSGGDPDFKYVEGQSCGILAAGEDAKGKPHRPRLYSIASTRYGDNFAGNTLSLCVRQLQYEKDGETINGVCSTYLCNLSPGDKVKISGPVGKEMLLPEEEDSNIIMLATGTGIAPMRAYLRRMFEPTEIEKHQWNFKGKAWLFMGAPKTANLLYDADFEHYKSKFPENLRYTKAISREQNNTKGGRMYIQDRVLEHAEEIFDMIENPKTHIYLCGLKGMEPGIDEAMTTAASAKGLDWSELRPKLRKAGRWHAETY

SEQ ID NO: 11106 - protein, 393 aa, Triticum aestivum
MGVKKPQPAPEKPKPEPQVLVPPVFDFPPLAARTRMLVPAYELMFGKLARRSLFDDYLHSGGVDAQIVLKQLGDSHADLTATMSTNGGEAHFRWQRDLKDPNTFVDFLVSTSKPTMRLSSSIYYPKYRIGAFGTFPLNMANRACPEDYGVMGLRYGSENLPIGASFVPFPSPGEVPYGAWLVGRKGNLSAGVQYKPIGGSKHPMPFTDLMNWNCAIGYGVGSSSPLSPSFNFALELVRSSQLVASFYQHHISAKVLNYRGGDETLNYIDLGLELATRVDKDKPTDDAGNSSFQVAASWQLHTDLLVKGKLGPSKSSAALAFENDHSKGTRSYGLGIRVEDFREARYQTLNRECTVLKQHEIDVDGKKRTLEFDFGPGNYDNLPTELKPIDKVL

SEQ ID NO: 11107 - protein, 639 aa, Thermoplasma volcanium GSS1
MGFRDYLAETRQIFDRLYPDNKITEIDYEGPTIVVYTKDPELFAKRDDLARQIAQEIRRRIAIRPDPSILTAEDQARAEIEKIIPKEAGLEDIYFEGDTGEVVIEVDEPSIITARNTEYVQEIKARTQWSPRIVRAPPMYSHTVKEIREYMRDIKQERKEFLHNLGVKLSGPPLVGETWVRLTALGGHSEVGRSATLVSTKNSKVLIDCGMMNVGPDADPWDAAPYLYVPEVQPLSSIDAVILTHAHLDHSGLLPLLFKYGYDGPVYMTQPTRDLAVLLQDDYIKVARMEGGKVPYESKYIREELKHTITLRYGETTDITRDMRLTFYNAGHILGSASVHLHIGDGLYNVVLSGDVKFEKTWLFNPANNKFPRAETFMTESTYGGRDDYSFTREEATETLVDVINRTHDRGGSVLIPVFAVGRSQEVMIVLEDAMRNGRIPQMNVYLDGMIMEATAIHAAYPEYLNKELREAIMVRKENPFLSQIFKKVETREQREDIAEDPESKVVLATSGMMNGGPVMEYFKAWAGNPKHTLVFVGYQADGTMGKRIQSGAKEVTISEGGKTVTYQINMDVETAEGFSGHSTKKQLLAYIATMQPKPKKILVNHGDNGKTAEFARLVRQRFNIESYALKNLETIRLL

SEQ ID NO: 11108 - protein, 845 aa, Aspergillus nidulans FGSC A4
MANPERSYLSRFFSSQFSKLPYPSQSFKDAVILVTGGNTGLGLEAARHFVRLQAATVILAVRDLKKGEQAKLSIEESTKVQGVVEVWQVDLEDVRSVQSLAAKASSLPRLDVVVANAGISTNKWALVGDMERTIQVNVLSTFLLILALLPKMQEQDIEGQIRARPRVVVVSSEGHETTAFAERKAARIFDALRDQRQANMDERYDTSKLIQLYLVRALAERLSRSDKPPVTLNAVSPGLCKTGLLRETPLVARLLTGPVMAILARNAEEGSRTLVHAAAANDGETNGKYLRDYLQRFYLAFRLISSSEQEGPTVHGTTNSSPSPCILSRYGKFYGAANESKAFLAYNNLTRCIRTLHDTKPRNKLRKNMGWQYIVAQPLKVDATICNISLAVQLCTAMRYEELDEACRSLEHLASDAEAEGEDAPLIPDPPGAVSPPTSLSGKAVLQVILLCASATLTLDIGLTVVRAPKIRLFESILCQAYYRTHGNPLPVPMQNIPESQCKTKEIQSGVARLIGWQTVFDGIPGGGPAVATAVLEATIADVVPDDKRSTIYFQLQATVLISDILANPLSSVLMAHNAWTPCFLGVGIQALATVLLIALPETLDFAKGSRPSDASIYGCKEEEPTLRGCLAKNFRSIVSDRNVAGLVFSLLILTVSAESLDFLLQYVSQRYGWSIAQSAMLLSLRAVVEFGLLLVVGSLLLFTQSSGLRNPRQRDLLIARLSLGLIVAGLLILSLSPTVAPAILVYTLGAGFQPAIMSLLASLWKASNPSNLGSLYSTVAIILAVGGVISGPLISLMYRIGLSLGHGWVGLPYFVASGLCAGIAGVLLSVKLPEQEQKPRRRET

SEQ ID NO: 11109 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 11110 - protein, 469 aa, marine gamma proteobacterium HTCC2207
MRKTKIICTIGPATDSLEMLENLANAGMNVARLNMSHGTHESHRKVIDAIRVLNRKLNHPIAVLLDTQGPEIRTGDLANDLHLNDGDTISIVARGAEDVESSSIHINYEDLITDVGIGDIITVDNGLINLEVLSKEERVMQCKVLDGGLLKSKRHVNLPGIRVNLPAITDKDRRDIEFGMSLDVDFIALSFVRQAEDIHELRELLGDKADTIKVIAKLEDQEAITNMVEIIAAADGVMVARGDLGVEVPLEVLPRIQRRILRTCAEMGTRAIVATHMLESMIENPNPTRAEVTDVANAVYEEADAIMLSGETTVGKYPVKCVEILDRIARSTESSRGLRFTDNLAIEGDKQQIAQAAVNLAEAISAKAIIVPTKRGRMANRVTNCHPQESIICAFTNSGATRRQLVMNRNVLSYQIDFGKDSDSTLAAAAAIMIKRDEFSPEDRVVVISDTLAGDGIEAIQIRQIADLL

SEQ ID NO: 11111 - protein, 273 aa, Cornicularia normoerica
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTELNGDNHSCIF

SEQ ID NO: 11112 - protein, 226 aa, marine gamma proteobacterium HTCC2207
MDQNQLKLAVAAAAVEYTLSKINPDSIVGIGTGSTANCFIDLLAEHKNSFQAAVASSDASAERLRGHGIEVIELNAAAEITIYIDGADEANPHLELIKGGGAALTREKIVTAVANEFVCIADESKWVDFLGQFPLPVEVIPMARSHVARELVKLGGDPVWRENVITDNGNQILDVHHLYPVASAQALEEKINQITGVVTNGFFALKAADVLFLATQQGIVTHYPKA

SEQ ID NO: 11113 - protein, 336 aa, marine gamma proteobacterium HTCC2207
MKKYHVCGLGNALVDTEIEVSEKNLKDLGIEKGLMTLVDEERQHFLQNNLSDHLVMSKRACGGSAANTVISLSQFGGKGFLSCKVADDENGQFYMQDLIDNGVDYNADAQISQGITGKCLVMITDDADRTMNTFLGISSELATTDIDASAIKNSEYLYIEGYLVTGESSLNAVLEACDIARQAGTKIALSLSDPGIVEYFRDALKSIVGDGVDLLFCNEQEALSWCQTDDLDRALEQLQNSAAQFAVTLGSEGAVVFDGSDYLRAPAQPITAVDTNGAGDMFAGAYLYGITQGYSCLSAAVFANRAASAVVGQYGPRLHSAEYDGLKEGLKSFLGA

SEQ ID NO: 11114 - protein, 262 aa, Kineococcus radiotolerans SRS30216
MGPAGLRRPRRARPAHRGARVLRPRAAVEGLPGHRAAGRRPRQRPGRARRPGVTASTLVLWRHGQTPFNAENRFQGQLDVPLDDVGRAQAAAAAAHLSALPLDAVVSSDLVRAVDTATALTSLTGLALTRDPALREVDAGEWQGLLGDEIARRWPEEHAAWRRGADVRTGGGETRSELGARVAGAVERHAAAVPGGGTLLVASHGAALKAGVLRLLGLPPTAGDAFAGLRNAHWAVLRRRSRAWALEEYNAGPAGARVGAEG

SEQ ID NO: 11115 - protein, 339 aa, Zea mays
GTLEVRRGPGAGRTNPSFDRPTAQQTMAGVSASIPCVVLNTGHAMPVLGFGTGSSSTPEDLPATILHAVRLGYRHIDTASMYGTEGAVGAAVSDAVAAGAVTSRADLFITSKLVMKDAHPDRVLPAIRESLARLGLDYLDLFLVHWPVAADENNKPVPFDMEGVWHAMEECHRIGLARSVGVSNFSAAKMSRLLAFAAVPPAVNQVEVNVGWRQEKVREACAKNGVVVTAFSPLGAIGTAWGSNAVMESGALEDIAARRGKTIAQVALRWLHEQGVCFVARSFNKERLKQNMELFDWELSVDDKEKIMGIPQRRACRAEFFLSPDGPYKTLEELWDGEI

SEQ ID NO: 11116 - protein, 471 aa, Brucella melitensis 16M
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETVLEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 11117 - protein, 148 aa, Glycine max
  misc_feature (141)..(141): Xaa can be any naturally occurring amino acid
  unsure (1)..(148): unsure at all Xaa locations
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISXTVLSCDK

SEQ ID NO: 11118 - protein, 312 aa, Ochromonas danica
NGFGRIGRLVARIMIEDPNSKLLAINTGADANYMAYQFKYDTVHGKWKGSLEVDGDDLIINGQRVKTTHFRNPNEIPWKGLGVEYLCEPTGVFLTADSAKPHVDSGVKKVIFSAPAKDKSPTIVMGVNENEYTTDMTFVSLNASCTTNCLAPMVKAIHDKFGIEDALMTTVHAMTSTQMVVDGSSKKDWRGGRGAAQNIIPSSTGAAKAVAQVILPSKGKITGMAFRVPTADVSVVDLTLRLATETTYEEICAEIQRRANTDMKGILGYTDEALVSSDFVTCPISSVFDAKAGIMLNPRFVKLVAWYDNEWG

SEQ ID NO: 11119 - protein, 315 aa, Ochromonas danica
NGFGRIGRLVLRAARNKPDVQVVAINDPFIPVDYMKYMFYYDSVHGRYPQAPVVVENGKLIVDGKVISVSHELDPVNIKWGDSGADYIVGITGKKFLTEEGAAKHFVGGAKKIVMSGPSKNKTPMFVVGVNHKEYKKELLVVSNASCTTNCLAPLAKAINDNFGIKEGLMTTIHATTASQPTVDGHSLKDWRGGRGAVGINIIPSSTGAAKAVGKVIPALHGKLTGMAFRVPTANVSVVDLTVTLEKGAKYADIKEAVKAASNGELKGILGYTEDSVVSFHFVSDTRSSTFDANAGIALTDNFVKLVSWYDNEWG

SEQ ID NO: 11120 - protein, 344 aa, Nostoc punctiforme PCC 73102
MKVGINGFGRIGRLVLRAGLDNPNIEFVGINDLVPPDNLAYLLKYDSTHGQLKHKVEAKEDGILIDGHFIPCVSMRNPAELPWGKLGADYVVEATGLFTDYEGAANHLKAGAKRVVISAPTKDPDRVTTLLMGVNHHLFDPGKDIIVSNASCTTNCLAPIAKVINDNFGLTEGLMTTVHAMTATQPTVDGPSKKDWRGGRGASQNIIPSSTGAAKAVALVLPELKGRLTGMALRVPTPDVSVVDLTFKTAKATSYKEICAAMKEAAAGSLAGILGYTDEEVVSTDFQGDTHSSIFDAGAGIELNSNFFKVIAWYDNEWGYSNRVIDLMLSISQKEKLASTVAVV

SEQ ID NO: 11121 - protein, 482 aa, Frankia sp. CcI3
MTTNTSTSSTTDDLTTGAPNGTGAPDGANGVGGPTGTVGGPGEHPAYEAGFTESANGRVYTVTGSDWEQILGVGEEENERIVVNMGPQHPSTHGVLRLVLEIEGETVTETRLVIGYLHTGIEKSCEYRTWTQAVTFLTRADYLSPLFNEAAYCLSVERLLGITEQVPERATVIRVMVMELQRIASHLVWLATGGMELGATTAMIFGFREREKVLDLLELITGLRMNHAYIRPGGLAQDLPDGAERAIRAFLADMPKRIREYHALLTGQPVWKARMVDVNVLDAAGCIALGTTGPVLRAAGLPWDLRKTMPYCGYETYEFDVPTALEGDSFARYLVRLEEMGESLKIVDQCLDRLRPGPVMVADKKIAWPSQLSVGSDGTGNSLAYIRKIMGTSMEALIHHFKLVTEGFRVPAGQVYTQIESPRGELGYHVVSDGGTRPFRVHVRDPSFVNLQAVPALTEGGQVADVIVGVASVDPVLGGVDR

SEQ ID NO: 11122 - protein, 364 aa, Cryptococcus neoformans var. neoformans B-3501A
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPSKELDKAGGNKKGRVEIIQLDLTDLASVEKCAEEFLNKEKKLDLLFANAGIMATPEGQYTKQGYTLQLGTNTLGHHRLITLLLPLLLSSPPSLPSRVILTSSAGHSMAPKGGVNIKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 11123 - protein, 143 aa, Ehrlichia ruminantium str. Welgevonden
MLERTLSILKPDVVKRNIAGQVNSYIENSGLKIIIQKMCLLTRYQAEKFYEIHKSQVFFVPLINFMISGPVVVQVLEGENAISLYREIMGATDPKKANSGTIRGDFAENIDANCVHGSDSLENAIREIRFFFSEYELLSLYEC

SEQ ID NO: 11124 - protein, 484 aa, Rhizobium sp. NGR234
MKLKDKELFRQAGVIGGEWIGAASGDVVEVFDPASQAVLGTVPDMGTAETRAAIEAAETAFGPWKKKTHAERAALLERWHALMIEHLEDLALILTLEQGKPLDEARGEIRYGAAFVKWFAEEARRIGGHTIPSPTPDRRIVVLKEAVGVCAIVTPWNFPNAMITRKVAPALAAGCTVVIKPSEFTPFSALALGVLAERAGIPAGVVNIVTGMPTAIGNEIMANETVRKISFTGSTRVGSLLMRGAADSVKRLSLELGGNAPFIVFDDADLDLAVEGAIASKFRNGGQTCVCANRILVQSGVYDAFAEKLAARVNAMKVGPGTEPGVAIGPMINAAAIDKIDRHVEDALAKGAKIAARGRSLPVGRQYTAPLVLTGATTEMLLASEETFGPVAPLFCFETEEEAITIANGTPFGLAAYFYTENLKRSWRVAEALEFGMVGLNTGAISTEVAPFGGVKQSGLGREGAQVGIEEYLELKSFHIGGLA

SEQ ID NO: 11125 - protein, 262 aa, Pyrobaculum aerophilum str. IM2
MSARRRVTDFVKGKGPYVWVTAYDYPTAKIVDEAGVDGILVGDSLGMVVLGLPNTLGVTLADMIRHTQAVARARPRALVVADMPFMSYETGPRDALRNASKLIKAGADAVKLEGGAEYARIVEKLVKAGIPVMGHIGLNPQRVLALGGFKMVGRTEEQRRKLLDDAKALRDAGAFSLVIEFVPASVAKEITEAVDIPTICIGAGPHCDGQILVLHDIIGLTERPPSFAKRYANVADVIRSAVKQYVNEVKTGQFPSKEHFKE

SEQ ID NO: 11126 - protein, 273 aa, Allantoparmelia alpicola
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRVEKSVTYDQIKETMKKASEGELKGIMAYSEDALVSTDLNGDNHSCIF

SEQ ID NO: 11127 - protein, 978 aa, Synechococcus sp. WH 7805
MTLLDQRTAASKTVQPISPFVRRHIGPEPQAVDQMLQALGFADLDAFIQAVVPGDILDPEPPCADLPEGVDEAPALAELRTIASCNQLSRSLIGLGYFETVTPALIQRQVLENPSWYTAYTPYQAEIAQGRLEALLNFQTLISELTGLPIANASLLDEATAAAEAMSMSFGVCKREGANRFLVDAAVLPQTLAVLRTRCEPIGVQLDVAEPEAFRWGDDVFGVLLQLPGRCGRLWDPRACIERAHTHGALVTVSVDPLAQVLLEPVGALGADIAVGSAQRFGVPMGGGGPHAAFFATRDAYRRQVPGRLVGQSRDAEGRPALRLALQTREQHIRRDKATSNICTAQVLLAVMASFYAIHHGPEGLETIANRIVMLRSRLELGLAALGFPVPGGVRFDSVDVHCPQAPLVHRLAAREGYNLRVLPDGVPADEAHGFGISLDELSDEAEIQSLLSICAEVVQTVPPVSSQPSSPAEVMAGVPLRQRPWLQQSVFHRYRSETELMRYIQRLVSKDLSLVHGMIPLGSCTMKLNAAAELAPVSWREFAAVHPFAPVAQQEGFQALIRDLERWLAALTGFAGVSLQPNAGSQGEYAGLLVIRAWHRSRGEAQRDVCLIPTSAHGTNPASAVMAGLRVVAVACDEEGNVDVGDLRSKAREHADVLAALMVTYPSTHGVFETRIREICSLVHEHGGQVYLDGANLNAQVGLCRPGAFGADVCHLNLHKTFCIPHGGGGPGVGPIGVAAHLQPFLPGHPLMPCGGNQPISSVSAAAWGSAGILPISWMYLRMMGAEGLRTATAVALLSANYLAHRLHAHYPVLFRGEGGLVAHECILDLRGLKRSAGLEVDDLAKRLMDYGFHAPTVSWPVAGTVMVEPTESESLEELDRFCDAMIAIREEVSRIESGESDRDNNPLKRSPHTLAAVTDDHWERPYSRQEAAFPLPGQQQNKFWPAVARIDNAFGDRNLICTCPSVAELAESLPVR

SEQ ID NO: 11128 - protein, 222 aa, Rhizopus niveus
SSCSSTALSCSNSANSDTCCSPEYGLVVLNMQWAPGYGPDNAFTLHGLWPDKCSGAYAPSGGCDSNRASSSIASVIKSKDSSLYNSMLTYWPSNQGNNNVFWSHEWSKHGTCVSTYDPDCYDNYEEGEDIVDYFQKAMDLRSQYNVYKAFSSNGITPGGTYTATEMQSAIESYFGAKAKIDCSSGTLSDVALYFYVRGRDTYVITDALSTGSCSGDVEYPTK

SEQ ID NO: 11129 - protein, 455 aa, Bacillus halodurans C-125
MKMTTVSVPTRESLIEEIKETIKTKNVELLHLQFVDIEGILKHVTVTAEQIDSVVDGKIMFDGSSITGFTPINQSDLYLQPDLTTFAVLPWTEEEGYSEGRFLCSVKKPDGSDFEGDPRNILKKTVERAKEKGYSISVGPELEFFLFETDEYGLPTKQTQDIGGYFEPSPKDNGEKVRLEIYRTLKAMGFTIEASHHEVAEGQHEINFKYADALGSADAATTYKWVVKTVAKQFGLHATFMPKPLGGANGSGMHTNISLFDDEKQENAFYDESDKLGLSKTAYQFIAGLIENVKDFVAVTNPLVNSYKRLVPGYEAPCYIAWSASNRSALIRIPATRGAGTRVEIRCPDPAANPYLAFAVVASAGLDGVEQELTAPASVDADIFHMSAEEIAERGIENLPTSLEEAINRFEEGEIGKKTFGEHAFGEYVALKRGEWDEFRTTVHDWEVAAYQGKF

SEQ ID NO: 11130 - protein, 553 aa, Bacillus halodurans C-125
MNRQWWKEAVAYQIYPRSFCDSNGDGIGDLQGVIEKLDYVKDLGIDVIWICPMYRSPNDDNGYDISDYQDIMDEFGTMEDFDQLLHEVHRRGMKLIIDLVINHTSDEHPWFIESRSSKVNPKRDWYIWRDPKEDGSEPNNWESIFNGSAWEYDQATGQYYMHIFSRKQPDLNWENRDVRKALYQMINWWLEKGIDGFRVDAISHIKKVKGLPDLPNPKGLDYVPSFEGHMNREGIHEYLQELKRETFDHFNIMTVGEANGVTVEQADDWVGEDHGAFNMIFQFEHLGLWDKGVNGTVDLAELKSIFTTWQKGLEGKGWNALFLENHDQPRSVSTWGNDKGYWKESAKALGTLFFFMQGTPFIYQGQEIGMTNVRFPSIEDYDDVGMKNFYRIETEKGRSHEEIMEIIWQKGRDNSRTPMQWNDQKHAGFSTATETWMGVNPNYKQINVEKQLKEEDSVLSYYKKMIELRKSSDLFVYGSYDLVLPEHKQIFAYKRTLEKESALILVNMFADEVSFQFPLKLIGEKERVLGNYKTQGAKDKLRPYEARVYRWQS

SEQ ID NO: 11131 - protein, 293 aa, Glycine max
  misc_feature (210)..(210): Xaa can be any naturally occurring amino acid
  unsure (1)..(293): unsure at all Xaa locations
ATKRARREEMSVEQKAAGKEEEGKLQKGIAEFYDESSGIWENIWGDHMHHGFYDPDSTVSVSDHRAAQIRMIQESLRFASLLSENPSKWPKSIVDVGCGIGGSSRYLAKKFGATSVGITLSPVQAQRANSLAAAQGLADKVSFEVADALKQPFPDGKFDLVWSMESGEHMPDKAKFVGELARVAAPGGTIIIVTWCPRDLAPDEQSLHPXSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 11132 - protein, 588 aa, Thermus sp. IM6501
MRKEAIHHRSTDNFAYAYDSETLHLRLQTKKNDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPHMPKLNTAHPEVKRYLLDVATYWIREFDIDGWRLDVANEIDHQFWREFRQAVKALKPDVYILGEIWHDAMPWLRGDQFDAVMNYPLADAALRFFAKEDMSASEFADRLMHVLHSYPKQVNEAAFNLLGSHDTPRLLTVCGGDVRKVKLLFLFQLTFTGSPCIYYGDEIGMTGGNDPECRKCMVWDPEKQNKELYEHVKQLIALRKQYRALRRGDVAFLTADDEVNHLVYAKTDGNETVMIIINRSNEAAEIPMPIDARGKWLVNLLTGERFAAEAETLCVSLPPYGFVLYAVESW

SEQ ID NO: 11133 - protein, 264 aa, Rubrobacter xylanophilus DSM 9941
MDGTRDTGFPDGASVEALGSPLARRAEVHGSLPSTQERARELARAGAGHGTAVLARVQTGGRGRLGRYWASPPGGLWMSLVLRPGLAPGAAHRITPAAAVAGAKALWELGVEARIKWPNDLLVGGRKVCGILAETVAAGGEGLCAVLGIGLNANLDPEQTGSAAATTLRRELGRDVDLLQLLGLLLGCLEVELGRVGGEFRAVLEDWRALECTLGRRVRVRRLGGVLEGTAVDLGPEGALLVRTSSGTVEVFEGEVERLQGEFL

SEQ ID NO: 11134 - protein, 452 aa, Pseudomonas fluorescens PfO-1
MSNNLDQLTDWLKDHKITEVECMIGDLTGITRGKISPTNKFIAEKGMRLPESVLLQTVTGDYVEDDIYYELLDPADIDMICRPDQNAVYLVPWAIEPTAQVIHDTYDKQGNPIELSPRNVLKKVLKLYADKGWQPIVAPEMEFYLTKRSDDPDYPLQPPVGRSGRPEIGRQSFSIEAANEFDPLFEDVYDWCELQELDLDTLIHEDGTAQMEINFRHGDALSLADQILVFKRTMREAALKHNVAATFMAKPMTGEPGSAMHLHQSIIDIETGKNVFSNDDGTMSQLFLHHIGGLQKLIPELLPLFAPNVNSFRRFLPDTSAPVNVEWGEENRTVGLRVPDAGPQNRRVENRLPGADANPYLAIAASLLCGYIGMVEGINPSAPVVGRGYERRNLRLPLTIEDALERMENSATIEKYLGKTFITGYVAVKRAEHENFKRVISSWEREYLLFAV

SEQ ID NO: 11135 - protein, 458 aa, Pseudomonas fluorescens PfO-1
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 11136 - protein, 136 aa, Clostridium thermocellum ATCC 27405
MERTLVILKPDSVKRKLVGEIISRFEKRNFTILHLKMMNIDRELACEHYSHVKDKPFFNDMIDYITSGPVVVMVLSGYRVIEAVRSMVGATSNFDSKPGTIRGDYGYHRFENLIHASDSCESAEIEIKRFFPELDS

SEQ ID NO: 11137 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 11138 - protein, 148 aa, Pinus resinosa
MAAKRITKELQDLQRDPPISCSTGPVGDDLFHWQATIMGPVDSPYAGGVFFIVIHFPPDYPFKPPKVTFKTKVYHPNVNSNGSICLDILKEQWSPALTVSKVLLSICSLLTDPNPDDPLVPEIAHIYKSQRARYEETARAWTQKYAMN

SEQ ID NO: 11139 - protein, 381 aa, Arabidopsis thaliana
MSHSAVSQAGAVSVSIENQRSLRRSVFKNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 11140 - protein, 127 aa, Oryza sativa
IPSRSSPQLLLLHRIVEASTAIDQVREVDSERHCKLAMASAAAAVAAKAWWTAAMSVGAVEGLKDQSGLCRWNYALRSLHGAAMDTLMLQVHGGAGASSPAAAMAAERPEEEGMRRVMYLSCCWGPS

SEQ ID NO: 11141 - protein, 410 aa, Salinibacter ruber DSM 13855
MLDLRPKTCSMAAPATAPDLDTYVSDRVRETPPSGIRRFFDIAATMDNVISLGIGEPDFNSPDAALEAGVDALENGRTSYTSNAGMEELRELIAEDYEERHGLSYDPESEIVATVGCSEAMQLAMQAFLEPGDEVLIPEPCFVSYGPSARFAGGEVVHVPTHVENDFQVTAADIEPHLSDRSKVLFLGYPNNPTGAVLRRDTLQEIAQLVVDNDLLVVSDEIYDQLIYGTAHDRGHVCVPTVEGLRERTVLLGGFSKNYAMTGWRIGFACAPKPLSQAMLKVHQYMIMSAPTMAQEGAIAALREARGDVEKMRQSYDERRRTIVSGLNDAGLPTFEPEGAFYCFPDVTSTGMTSEEFAQRLLEEEKVACVPGTAFGPSGEGYVRCSYATGLDDITEALTRIDRFVSRHQS

SEQ ID NO: 11142 - protein, 411 aa, Bordetella parapertussis
MNTISDSAAVAAGRRVAARMARVTTSKIYLAIAKVADMQAQGMQVASLTAGEPDFDTPAHVIEAAVQAMRGGDTHYTPVRGSLAMREAVRQKFQRENGLAFRDEEVMVGTGSKQVIANALAVTLETGDEVLLPVPYWAAYTGMVYAAGGVPTFVGTRAEDGYKLTPQALRAALGPRTRWVILNTPSNPSGLVYGSDELRALGEVLRERPDVLILTDEIYEHLNYTAEPPASLRKLCPDLAERIVVVNGVSKAYAMTGWRLGFAGGPADIIEAMANLQAQTTLAPCSISQAAAVAALNGPRESIDAMAAAYRRRRDLVMQIAGGQSGVRLQRPDGAFYAMLDLSEALAGGERFRGDPEPDQAFCEWLLETRHVAAVPGSVFGAPGSVRISFATDEQTIERGLTGLLDAAAHC

SEQ ID NO: 11143 - protein, 256 aa, Triticum aestivum
  misc_feature (44)..(44): Xaa can be any naturally occurring amino acid
  unsure (1)..(256): unsure at all Xaa locations
MDEAASPRGACKGGTTKTSRAFPGHGPIDMWESGITLGLGTGSXAAHAKIRRKILLRTGALRAVAGVPTSLKTEAHAARVGIPMLALADAAEIHLSIDGADEVDPDLNLVKGRGGSLLREKMIEGAGARFVVIVDESKLVPRLGCTGSVPVEVVPFGSAYTLGLIRKVFDKLPGFHARLRTVKSKAGDGQEELFLTDNGNHIVEMFFEDGIHGNLRDISDSLLRITGVVEHGMFLGMATKVIVAKKDGTVAVLSKK

SEQ ID NO: 11144 - protein, 381 aa, Kluyveromyces lactis NRRL Y-1140
MSSSRILPLYSKTDLEKHNDKNDCWVSLYQRKIYNVTEFLDEHPGGAEYILDYAGTDITDVMKDVLTHEHSESAYEIMDESYLVGYLATEEEEKKLLTNKDHVVEVNLKGNNEFDSTVFVKELPTEDKLSIATDYQNDYKKHKFLDLNKPLLWQVLFGKFTKDFYLDQVHRPRHYGKGSAPLFGNFLEPLSKTPWWMVPVVWLPVVTYHIYTALMNMNQAFAIFLFAVGVFVWTLIEYGLHRFLFHLDDRLPEKQWAFTLHFLLHGVHHYLPMDRFRLVMPPTLFVVLCTPFYKLVFALLPYYWACAGFAGGMLGYVCYDLTHYFLHHSQLPPYMRKLKKYHLEHHYKNYELGFGVTSWFWDKVFGTYLGENAPLSNMKYD

SEQ ID NO: 11145 - protein, 965 aa, Thermus thermophilus HB8
MDPLWYKDAVIYQLHVRSFFDANNDGYGDFEGLRRKLPYLEELGVNTLWLMPFFQSPLRDDGYDISDYYQILPVHGTLEDFKRFLDEAHGRGMKVIIELVLNHTSIDHPWFQEARKPNSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVFLPLLWSPQRREGPGLFARTHGQPGHFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGTVEEDLARLAYDVERAVHLALEALEAELWAFAEEVADYLHAAFLQAYRSALPEEALEEAGWTRHMAEVAAEHLHREERPARKRIHERWQAKAGKA

SEQ ID NO: 11146 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 11147 - protein, 510 aa, Gracilaria tenuistipitata var. liui
MKSIILTILDGWGYSENKKGNAIQIADTPTIDKLWNSYPNTLLNASGRDVGLPEGQMGNSEVGHTTIGAGRIINQDLVRISKSIEDRSFFNNEAINSICQKINFYNTKLHLIGLCSNGGVHSHIKHLFALLDIAMRYKIQICIHAITDGRDTSPYGSKIFIEEINNQIQQFNHINICTISGRYYSMDRDCRWARTEKSYNTLLKNTLGFTKDPILMINEYYKKNISDEFIPPTRLHKGSIENNDGIIFFNFRPDRMRQLVHAFTKSTFKGFNTTSFHNLEILTLTQYDPSLDIEVAFPAKKNKNFIGEIIAKYGLKQLRLAETEKYAHVTYFFNGGIEEPFAGEDRQLIPSPKVETYDLDPEMSATKLTESAINAINKNTYKFIVINYANPDMVGHTGNLDATIHAIQKIDKCIKKIWLACQAMNSTLIITSDHGNADYMLDENNEPCTSHSTNPVPFILAEPTNIHTYHLRKNGNLADIAPTILQLLNLNIPNEMNGISLLETKAKNKI

SEQ ID NO: 11148 - protein, 184 aa, Kluyveromyces lactis
MHTPRLPVLTLVKTPLNKSRMSVLNGLSWVTLKEELTSTKLMKSSPKKPNLLWTAVSRLSLCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 11149 - protein, 466 aa, Escherichia coli
MGQSSQPHELGGGLKSRHVTMLSIAGVIGASLFVGSSVAIAEAGPAVLLAYLFAGLLVVMIMRMLAEMAVARPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIGKILRAEGSEIRLRMWLYPWLTWLVIGFITFVLVVMLFRPAQQLEVISTGLLAIGIICTVPIMARWKKLVLWQKTPVHNTR

SEQ ID NO: 11150 - protein, 234 aa, Ustilago maydis 521
MASTEQDGGPPSLHISPPGTAFASGASTGVAPPPVLRPTHGRARSSSLVSVTRVEETHEEMLDQSAGFNANADWVNYKGAWVIHVVLIIVAKILLDVIPAMQQDTSWTLVNLGYMTLSYIMFHYVTGTPFESNAGAYDQLTLWEQIDEGAQYTPAKKWLTSVPIGLFLVSTHYTRYNPLLFGLNFSALLFVLFPKLPILHRLRFRFFAPPPTPSPYPSQPPTPTGTRTPSHAAF

SEQ ID NO: 11151 - protein, 390 aa, Myxococcus xanthus DK 1622
MRALCWNGINDLGVETVGDPRIVNPHDVILQVRMSTTCGSDLHFIDGYIPTMRKGDVIGHEFMGTVVEKGPAVKKVQVGDRVVVPSFIGCGSCWYCQHDLWSLCDNTNPKGELQEPLFGYQTAGIYGYTHTFGGYAGAHAQFVRVPHADNDCFRVPEGVTDEQALFLSDAVPTGYMGADFCDIQPGQTVAVWGCGGVGLMAQKAAFLLGAERVIGIDRFPERLKLAREKVGAETISYEEVDSVLDVLKELTGGRGPDACIDAVGMEAHGTGVGAAYDRAKQAMRLQTDRGQALRQAILACRKGGILSVVGVYGFMDAFPLGAIMNKGLTVRSAQQHGQKYLPRLLEHVVKGELDPSFLATHRFSLEDAPKGYELFKKKQDGCVRAVFLPN

SEQ ID NO: 11152 - protein, 242 aa, Zea mays
  misc_feature (206)..(206): Xaa can be any naturally occurring amino acid
  unsure (1)..(242): unsure at all Xaa locations
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNTDCGVSIGTIFGIYMIKDKDNATLEDVLQPGTHMIAAGYCMYGSSCTLVLSTGNGVNGFTLDPSLGEFILTHPNIKIXNKGKIYSVNERNARNWDAPTAKYVERCKFPQDGSSP

SEQ ID NO: 11153 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 11154 - protein, 397 aa, Burkholderia mallei ATCC 23344
MNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 11155 - protein, 363 aa, Neisseria meningitidis Z2491
MSHISPIPEILADIKVGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPEDIVQPGHIFPLRAQKGGVLVRAGHTEAGVDLAQMNGLIPAAVICEIINDDGTMARMPELMKFAEEHKLKIGTITDLIEYRSRTESLLEDMGNAPVQTPWGEFQQHVYVDKLSGETHLALVKGTPSADTETLVRVHEPFSVMDFIQANPRHSWSLPKALERVQQAESGVVILLHRTEDGASLLDRTLPKGANQAYKWDSKSYGIGAQILAGLNVKKLRVLGQPSSFTGLTGFGLEVVGFEEAEK

SEQ ID NO: 11156 - protein, 183 aa, Photobacterium profundum SS9
MNTKQQQIAIVTGANGGIGKNYTRMMLDDGFRVVMAVRNEVAGSLVRDELLQSHPDAAIDILKVDMSSLSSIKAFSKQVKEKYSRIDVLAHNAGVYFFDNERRESTDGIELNLAVHVVGPYALTIQLLPLLKETQGSRVITMSSSEHHGAKIDLRDIQIKERFEEQGNMIAYSRSKWAGLGWH

SEQ ID NO: 11157 - protein, 331 aa, Shigella flexneri 2a str. 301
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 11158 - protein, 263 aa, Salmonella typhimurium LT2
MKPTTISLLQKCKQEKKRFATITAYDYSFAKLFADEGINVMLVGDSLGMTIQGHDSTLPVTVEDIAYHTRAVRRGAPNCLLLSDLPFMAYATPEQACENAAIVMRAGANMVKIEGGAWLVDTVKMLTERAVPVCGHLGLTPQSVNIFGGYKIQGRGDAGQVLLDDALALEAAGAQLLVLECVPVELAKRVTEALSIPVIGIGAGNVTDGQILVMHDAFGITGGHIPKFAKNFLAEAGDMRAAVQQYMAEVESGVYPGEEHSFH

SEQ ID NO: 11159 - protein, 206 aa, uncultured marine alpha proteobacterium HOT2C01
MLSVFKNYFSHSTIYGFFIMAVVGMYYIVSNEMLSEYLFWFFIPIILAPFYEWYVHKYQLHRELTKKEGWYRRYQIILHHGHHRDPDNIKLQFAPWRYLIYTYGQVYLLYSLILWSFPAAMVPFTGHLVYHLWYEWIHLAHHSKEYKPVSIIGKKLRDAHMSHHFHNENYNWGITNMIGDYFFGTLKDNKTIKKSTTAKSIAGYTD

SEQ ID NO: 11160 - protein, 537 aa, Arabidopsis thaliana
MGKDERTSLGRALVKHHDHMIQETEEGGKSYKDQHKKVLESVTEVSDIDAIIEQAEEAERLFAIHHDSATPVPINMDTGSSSSGITAKEWKEQRMREEALHASSLQVPRRPHWTPKMNVEKLDANEKQAFLTWRRKLASLEENEKLVLTPFEKNLDIWRQLWRVLERSDLIVMVVDARDPLFYRCPDLEAYAQEIDEHKKTMLLVNKADLLPSYVREKWAEYFSRNNILFVFWSAKAATATLEGKPLKEQWRAPDTTQKTDNPAVKVYGRDDLLDRLKLEALEIVKMRKSRGVSATSTESHCEQVVVGFVGYPNVGKSSTINALVGQKRTGVTSTPGKTKHFQTLIISEDLMLCDCPGLVFPSFSSSRYEMVASGVLPIDRMTEHLEAIKVVAELVPRHAIEDVYNISLPKPKSYEPQSRPPLASELLRTYCLSRGYVASSGLPDETRAARQILKDYIEGKLPHFAMPPEITRDDENETADDTLGAETREGSQTEKKGEEAPSLGLDQVLDDLSSFDLANGLVSSKTKQHKKSHRKQ

SEQ ID NO: 11161 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 11162 - protein, 490 aa, Cryptococcus neoformans var. neoformans B-3501A
MFSHGLSIANPPPPAERPVTHAPRCLCFFFCLFICNFFKRCFFPAIPPFRSDCCFSFHFYAGSVRISSSPITLAQPVTRSPQTPRPFSFATQPAVSPIDGQIHTRYANQSPVNDAMAKPTHARGHIYSLAEVAKHNTRVSTLCTYNGKVYDLTSFLDDHPGGDDIILSYAGQDIGKVMSDEDIHQHSRAAYEMLEEFEVGELGGGEKIVSEDWVCDENFQPSDTDLLSDYNLNKFIDLTKPLLIQVWHAPWTKEYYLSQVHEPRHLKESARLFGSDLLEPFTRTQWWVVPMIWWPIAGLIGWLSMLQFTDSSITAKSILTYPLPSSIPVPSFAALGYFSLCFAFGVFIWTILEYSMHRFLFHLDYYLPDTRWAITLHFMLHGVHHYLPMDKLRLVMPPLLFFVLQTPFTKLAHIVFPKAIANGIISGAFAMYVVYDLGHYALHHTRLPAYLREMKRYHLAHHYKNFELGFGVTSKMWDYVFGTVLPTTTK

SEQ ID NO: 11163 - protein, 375 aa, Aspergillus oryzae
MTVALQEDPDLALTKDMHGKSAEEKNAFFAMLKKNNAAHREITNEYVRRWRTEKGIDGTTDEARKERTTEYMGVVNNYYDLVTDFYEEAWAQSFHFCRFTVGESFLQALARHEHYLAYKLGIKRGMEVLDVGCGVGGPAREIARFTGCQVVGVNNNGYQIARATRHTQKAGLEEQVSFCKGDFMHLDFPDNKFDAVYVIEATVHAPSLQKVYEQIFRVLKPGGRFGVYEWVMTDRFDESNPKHRAIRLGIERGNGIVNMCTQNEAAEAIQAAGFVLEHEEDLAARPDPIPWYYPIAGELRHARSLWDLLTVLRMTKLGRGAMGYLLWTLENLRLAPSGTAETATELASGADSLVEGGRLGLFTPMYFMIGRKPEI

SEQ ID NO: 11164 - protein, 347 aa, Triticum aestivum
MAASNGLEGVLLGMGNPLLDISAVVDEAFLAKYDVKPNNAILAEDKHLPMYDELSSKENVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVKVFLMNLSAPFICEFFRDAQEKVLPYADYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 11165 - protein, 159 aa, Brassica napus
LFSPSSLTLSHSDPGKSSWRCNDNLIVIRFPISSNEDMDLFCGECSSGESTAEFSSEEVESWPDDSIASCIEDERHFVPGLDYLSRFHSQSLDASAREESVTWILQVQAFYSFQPLTAYLAVNYMDRFLYARRLPETSGWPMQLLAVACLSLAAKMEEV

SEQ ID NO: 11166 - protein, 226 aa, Bordetella pertussis Tohama I
MLTQQELKQQAADAALELVEQVAGPDVIIGVGTGSTADLFIDGLACFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 11167 - protein, 373 aa, Pediococcus pentosaceus ATCC 25745
MKIKAAVVDQQNSDFKIKDDIELAEMGPDDIQVHMVASGICHSDEALRVGDAIIDYPIVLGHEGSGIVEKVGPEVTQFKPGDHVILSFYACGNCDNCLRGIPTQCRNYAANNLSGVRPDGSSHFTENGKHVADMFDQSSFTSTTVVRERNAVKIDDDIDLRKVGPLGCGYVTGSGTVLNTLQPRPGDTIAVFGTGAVGLAAMMAGKISGCTKVIGIDIVDSRLALAKELGATDIINSKNVDVVEEVKKLTGGLGVNWAVDTTGITKVMEDSIKVLTQGGTTATIAVTPNHIDLDTWNDLCVDDKKIVGVNMGDSIPQIDIPRLIEFYKAGMFDFDKTEKFFNFDEINEANAASRSGEVIKPVLIIDPDYVPGK

SEQ ID NO: 11168 - protein, 483 aa, Pneumocystis carinii
  misc_feature (133)..(133): Xaa can be any naturally occurring amino acid
  misc_feature (195)..(195): Xaa can be any naturally occurring amino acid
  unsure (1)..(483): unsure at all Xaa locations
MCCKAIKLGNARVFPVTTFRDAKKVRWINLLKSGKAKRNKSGKIIKQGEFQSKDVQDARIQPYRRWFSNTRVISQDVLNMFRESFAEKLNDPCKVLLKQNKLPMSLLMEPTKTRKANIIDIEPFDDTFGKKSXRKRAKLYASSIENLSNFAFESYENYIKKNSEYENVDKNIQKSFEAIFSKGTSKRIWNELYKXIDSSDVIIQLLDARNPLGTRCKHVEEYLKKEKPHKHMILLLNKCDLIPTWCTREWIKQLSKEYPTLAFHASINNPFGKGSLIQLLRQFSKLHSNRRQISVGFIGYPNTGKSSVINTLRSKKVCNTAPIPGETKVWQYVRMTSKIFMIDCPGIVPPNSNDSETEIIIKGALRIEKVSNPEQYIHAILNLCETKHLERTYQISGWENDSTKFIELLARKTGKLLKGGEVDESSIAKMVINDFIRGKIPWFIAPAQENDPSNIKLSNNTLVEKNHLTTLDDEIYNDANPNA

SEQ ID NO: 11169 - protein, 402 aa, Frankia sp. CcI3
MAAMSRISHRIGGIAPSATLAVDATAKAMRAAGRDVIGFGAGEPDFPTPDHIVAAAEKACREPRMHRYSPAAGLPELKQAIAEKTARDSGVIVSPSQVLVTNGGKQAVYAAFATLLDPGDEVLLPAPYWTTYPESIRLAGGVPVDVVTGPEAGYRVTVEQLEAARTPRTKVLLFNSPSNPTGAVHTPEEVRAIGRWAEQAGIWVISDEIYEHLVYGETRFASVLAEVPELAERCIIVNGVAKTYAMTGWRVGWLVGPADAVAAATNLQSHATSNVSNVAQAAALAAVAGPLDAVATMRTAFDRRRQTMHRLLSQTPGIRCPLPDGAFYCYPSVRDVLGRTLRGRIPTTSADLCQLILEEAGVAIVPGEAFGTPGFARLSYALSDDDLVKGVSRLSALLAEAA

SEQ ID NO: 11170 - protein, 417 aa, Aspergillus oryzae
MFDTVCTLPLSADLFAQAIHPKEPIVSVGLASGHVETFRLPSDEVDSDDDQASTSSSRNGRGHIDTMWRTRRHKGSCRCLTFGIDGESLYSAGTDGLVKAAKAETGVVENKIAIPPEKDGSVDAPTVIHALSPQTLLLATDSSALHLYDLRLPFSRVSARPQQSHHPHDDYISSITPLPASDTSTSGFSKQWVSTGGTTLAVTDLRRGVMVRSEDQEEELISSVYVGGLATTGTSRGEKVIVGGSSGVLTLWEKGAWDDQDERIYVQRSGGEGESLETLAMVPDELGRGKMVAVGLGSGGVKFVRIGPNKVVSEVTHDETEGVVGLGFDVEGRMVSGGGQVVKVWHEAVGSGANGASAGEKHMLGDSDEDSDDDDNDDSDDSDGERRRADEAKRKRKKGKGKDRSGGQHVMAFYDLD

SEQ ID NO: 11171 - protein, 225 aa, Arabidopsis thaliana
  misc_feature (179)..(179): Xaa can be any naturally occurring amino acid
  unsure (1)..(225): unsure at all Xaa locations
MTTFNYYLAEHPTIVNFRWSPTQSYASTWSFLFTAVSSYIIAAVTLHLLLLITLSLSNRRRGFSLGPIPALHSLTISIISAVIFVGILLSAAAEIRDTRWLWRRTRTTALQWFLCFPVGTRASGRVFFWSYAFYLSRFLHLFRTFFSVIRRRKLSFFQLINQSSLLCISFLWLEYSQSXFRFWTEIGLRGACFPFVGNCQAILLGCMTVCHVGVLCIHLVKRGGC

SEQ ID NO: 11172 - protein, 409 aa, Azoarcus sp. EbN1
MQNSPLHHFDFRFVLLEGIHATAVETLGTSGYSRVDARPGALTGDDLIHAVADADFVGIRSRTRLTEEVLTHAPKLLGIGCFCIGTNQVDLEAAALLGIPVFNAPFSNTRSVAELVLAEIVMLMRGIPEKNALLHRGGWMKSASNSWEIRGKTLGIVGYGHIGTQVGVLAEHFGMKVVYHDIEAKLSLGNAHQLGSLEDLLAASDVVSLHVPETPATRNMMDAARLAAMKPGSFLINASRGTVVDIDALADALGSGHVLGAAIDVFPAEPKSNDEPFVSPLLRFDNVILTPHIGGSTAEAQANIGREVAAKLARYANNGSTVSAVNFPEVSLPAHEGQCRVMHIHHNVPGMLARINERISKAGLNIVAQYLQTTQHVGYVVIDVDAEARQVAFDELNAIDGTIRCRLIC

SEQ ID NO: 11173 - protein, 1362 aa, Ustilago maydis 521
MNPSYTERRASAHPTMSSSAHHASSTPSAASIDPTTSHAISSGIPITSPAALSYFAAHPRRQQVHFGNYLLLQTLGEGEFGKVKLGVHKEWGEEVAVKLIKRDKVANDAAPLHLDDSAQKDPAKMSKVEREIQVLKDVRHPNIVRLYEVIESDRYIGIVLEYASGGELFDHILAHKYLKEEHACRLFAQLISGVSYLHHKKIVHRDLKLENLLLDRNRNVIITDFGFANNFEHKRNDLMATSCGSPCYAAPELVVQDGLYAGSAVDVWSCGVILYAMLAGYLPFDDDPANPDGDNINLLYKYILATPLSFPEYITAQPRDLLSKMLVPDPTRRATLEQVMQHSWLRHYRELFKFSVDDLERAAMEQQTKKRQMYRQQMMYQQQLQEQQRRQQMERSQSVRHNVSHLPVGTAYTANTAVSAVSAANVAHRQTLPISATVPDRLYEPIGSASRGADHSVTPQRAPTASSHQPPVAPTASADAAIAPLPRASTHNNVAAAADAAAAVAAAPSPVDPVTALGNARGEPRTRLDDAVPTIAAAYETEPRQLAAQKVQRHTIQLEYGGDERPRKESAPGSRQASQTQRNASASSTSSKLAEIERTKTAADKPAANANAIVPPSVLQSTSVQVPATSVVVPESEKANISKAGAPDMMRSVSASAASRVSVPPPIMEQTQPSVSAHRSTQPTSSSRVRAPSSASRNNADSGSTGHATRIPTSASQRVVSTSSAASEPVGFPSSATERTIPSADADAAAGRISASRRASNGAEITEPSHRSPSATRHATADNAPVTSASASARHRKGMSTDKFFLSRLLGSNSANQPNGAGVAGDKVSANGSDAAGDKTKRDSMNRPAPERAPSSSSTGKNGRRKAMSLVVGHASGEASSAAADRNRALKAGMPHSATRATFGTQVSGKADDSVSSAQKQRKGSASLASQTTSTSRAAQSSTRPQPLQPSLQQQQQQQDKAFNDGSTIASSSTAGPSSNAAKKVMDWFRKKSLSRGTFNEQPPLGLFERSPTSSYMHGSASQTPSVIVTSAPNGTSRHAEAPSGGSSVPSSRSTSGTHSENSEATEMTQLTNLSDASHQEGDGLKSSASTVQQQATPKASLSAVSNVSDASAAGSLVSTRSQQQQRPQPRVATATSASTTPARFNEARLRYHLGAVDQSALTSRSPIEVLKEVQRVLYEMGIDVRTEKDEDFKLECVRRKRAKTLMSATHGFGMSIRSSVFPPTQADVERSSRMSHRDSLTPSASSPGGGSLRSFLKRSSLQPGATSPKMGSSTLPSSATVTSNLGGAVHDENQPPPLYGDASVDGGQEIRFSVEVTRIKNLTGLYSLDIRRMKGNLWAYKFVYQALLDRCQLGSSTAAVG

SEQ ID NO: 11174 - protein, 222 aa, Petunia inflata
MFKSQLISALFISLFAFSPVCANFDYIQLVLTWPASFCYRPKNICRRIPNNFTIHGLWPEKEHFRLEFCDGDKFVSFSLKDRIVNDLERHWVQMKFDEKFAKIKQPLWTHEYNKHGICSSNLYDQRAYFLLAMRLKDKFDLLTTLRTHGITPGTKHTFGEIQKAIKTVTNNKDPDLKCVEHIKGVKELKEVGICFTPAADSFHDCRHSNTCDETDSTKILFR

SEQ ID NO: 11175 - protein, 480 aa, Polytomella sp. Pringsheim 198.80
MLSFKSDTSIFSGRKGPCANLFPPVSRKLNNAKPILMKAASKLVTTKSEEIFNEALELLPGGVNSPVRAFRSVGGKPIVFSKVKGARCYDVDGNSFLDYVGSWGPAIVGHAHDEVNAAIIDQVSRGTSFGAPGPLENELAKVVISRVPAVEMVRFVSSGTEACLSVLRLMRAATGRDGLIKFAGCYHGHADSFLVKAGSGVATLGLPDSPGVPASTTASTFTATFNDLDSVEKIFAAHPTEIAGIIVEPVVGNGGFIPPSPTFLRGLRALCDKYKALLCFDEVMTGFRVHKNCAQKLFGVTPDLVTLGKVIGGGLPVGAYGGRKDLMLHVAPAGTMYQAGTLSGNPLAMAAGLKTLEILDRPGAYEHLDRISKKLVEGVVAAGRAAGHPLVGGSFGGMFGFFLLKQEELGKEVEKKAPQSFEEAQSRADTAKFARFHRLMLEEGVYLAPSQFEAGFTSLAHTDEDIEFTISAAANAFKRL

SEQ ID NO: 11176 - protein, 315 aa, Shigella flexneri 2a str. 301
MDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 11177 - protein, 222 aa, Petunia inflata
MFKWRIVSALVILNFALFQVYGDFDYLQLVLTWPASFCYQPKDICKRTVNNFTIHGLWPEKKGFRLEFCSGGTKYKIFEDNMVNDLERHWLQMKFDENYAKKHQPLWSYQYRKHGMCCYKLYNQNAYFLLAMRLKDKLDLLTTLRTHGITPGTKHTFSEIQKAIKTVTNNKDPDLKCVEHIKGVKELNEIGICFNPAADSFHDCRHSYTCDETDSTKTLFRL

SEQ ID NO: 11178 - protein, 225 aa, Bacillus cereus G9241
MVIQWFPGHMAKARRQVTEKLKLIDVVIELVDARLPLSSRNPMIDEIITHKPRLVVLNKADMADDHLTKQWIAYFKEKGHMAISINAQAGQGMKEIAAACKVLVKEKFDKMVAKGIRPRAIRALIVGIPNVGKSTLINKLAKKNIAKTGDRPGVTTAQQWIKVGKEMELLDTPGILWPKFEDQLVGLRLATTGAIKDSILNLQDVAVYALRFYGETLPRAIKRAL

SEQ ID NO: 11179 - protein, 378 aa, Burkholderia mallei ATCC 23344
MTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLLEFGKEHGLKIGTIADLIHYRSRTESIVERVAERTMQTAHGPFKTVLYRDHPTGSPHIALVRGTPTPNDETPVRVHEPLSVLDLLETGVSTHSWTLDAAMKEIAARELGVIVLLNCGDTKEHLVDVFLAFDEKEKAAELKRRPVDFKTFGIGAQILRDVGVGRMQVLSNPRKLGSMSGYGLEVTGFAPMPGSAAPASGAA

SEQ ID NO: 11180 - protein, 312 aa, Methanothermobacter thermautotrophicus
MLFDAVGLGALNMDQLHMVERIAGPDEEVFVRSILESCGGSAANTIIGLARLGLRTAFIGKVAGDREGSILRENLKGGGVADYVAVSDEGRSGRVMGFVDPQGNRALYVDPGVNDTLSMDEVREEALKTRLLHLTSFAGSGIRVQREVLGVIDDSVTVSLDPGHLYAERGASELEGILERTDILLVNRRELEILTGSPDPAMASAELGVDVVVMKMGSEGVRAFDGSEVMVEALETSCRDTTGAGDAFNAGFLYAWLSGHGLEVSCLFGNYMASRCIEGYGATSSLPGREALEVLEGYLRDTYQEKRGDSGK

SEQ ID NO: 11181 - protein, 393 aa, Arabidopsis thaliana
MKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFREREFVYDLFEAATGMRMMHNFFRIGGIAADLPYGWIDKCLDFCDYFLTEVVEYQKLITRNPIFLERVEGVGIIGGEEAINWGLSGPMLRASGIPWDLRKIDRYESYDEFEWEIQWQKQGDSLARYLVRLSEMTESIKIIQQALEGLPGGPYENLESRGFDRKRNPEWNDFEYRFISKKPSPTFELSKQELYVRVEAPKGELGIFLIGDQSGFPWRWKIRPPGFINLQILPELVKRMKLADIMTILGSIDIIMGEVDR

SEQ ID NO: 11182 - protein, 957 aa, Pseudomonas fluorescens PfO-1
MSQLPSLSQLRDPHAFLRRHLGPDAAEQQAMLDSLGLGSRVELIEQTVPPGIRLNRELDLPPALDEQAALARLRGYAEQNQVWTSLIGMGYHGTLTPTVILRNVLENPGWYTAYTPYQPEIAQGRLEALLNFQQLTIDLTGLELANASLLDEATAAAEAMALAKRVAKSKSNLFFVDENCHPQTISVVQTRAEGFGFELIVDAVDNLKQHQVFGALLQYPDTHGEIRDLRPLIDHLHAQQALACVAADLLSLLLLTPPGELGADVVFGSSQRFGVPMGYGGPHAAVFASREEYKRAIPGRIIGVSKDARGNVALRMALQTREQHIRREKANSNICTAQVLLANIASFYAVYHGPEGLKRIAQRVHRLTCILAAGLERHGIQRLNQHFFDTLTLDVGGAQTAIIESAQAAQINLRILGRGQLGLSLDEACDENTVARLFDVLLGADHGLSIDDLDAETLASGIPEMLQRSTSYLRHPVFNAHHSETEMLRYLKQLENKDLALNQSMIPLGSCTMKLNATSEMIPITWPQFANLHPFVPREQAVGYTLMIEELERWLCAITGFDAICMQPNSGAQGEYAGLLAIRKYHESRQQGGRDICLIPSSAHGTNPASAQMAGMRVVIVECDDAGNVDLEDLKAKASEAGAKLSCLMATYPSTHGVYEEGISEICEVIHKHGGQVYMDGANLNAQVGLARPADIGADVSHMNLHKTFCIPHGGGGPGMGPIGVRAHLAPFVANHPVVPIDGPQPQNGAVSAAPWGSASILPISWMYIAMMGPQLADASEVAILAANYLAQHLSGAFPVLYTGRNERVAHECILDLRPLKAATGISEEDVAKRLMDYGFHAPTMSFPVPGTLMVEPTESESKAELDRFIGAMLSIRAEITEVQNGNWPAEDNPLKRAPHTMADITGVWERPYSIEQGITPDAHTKAHKYWPAVNRVDNVYGDRNLFCACVPVDDYR

SEQ ID NO: 11183 - protein, 640 aa, Oryza sativa (japonica cultivar-group)
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHINENIL

SEQ ID NO: 11184 - protein, 427 aa, Burkholderia mallei ATCC 23344
MSNNQTLFERAQRTIPGGVNSPVRAFRSVGGTPRFVARAQGAYFWDADGKRYIDYIGSWGPMIVGHVHPDVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADVAKHTTVLEYNNVAALEEAFAAFGGEIAAVIVEPVAGNMNLVRGTPEFLNALRALTAKHGAVLIFDEVMCGFRVALGGAQQHYGITPDLTCLGKVIGGGMPAAAFGGRGDIMSHLAPLGGVYQAGTLSGNPVAVAAGLATLRLIQAPGFHDALADKTRRLADGLAAEARAAGVPFSADAIGGMFGLYFTEQVPASFADVTKSDIERFNRFFHLMLDAGVYFAPSAYEAGFVSSAHDDATLDATLDAARRAFAALRA

SEQ ID NO: 11185 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 11186 - protein, 423 aa, Arabidopsis thaliana
  misc_feature (265)..(265): Xaa can be any naturally occurring amino acid
  misc_feature (276)..(276): Xaa can be any naturally occurring amino acid
  misc_feature (413)..(413): Xaa can be any naturally occurring amino acid
  unsure (1)..(423): unsure at all Xaa locations
MVSYRATTETISLALEANSSEAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAXNNLLKGWTTVXVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYXPVCQNHVLRE

SEQ ID NO: 11187 - protein, 410 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 11188 - protein, 211 aa, Ehrlichia ruminantium str. Gardel
MGIIVSENPSFISSIEDIIEDAKAGKVFVLIDDEQRENEGDLVVLAEKVTTDAINLMVTHGSGIVCLSITEDLMYKLGLELIPRRNINNNSASFATSIDARYGITTGVSVHDRVRTILTAVSKNVTMDDLVTPGHIFPIVSKKGGVLERLGHTEASVDIARIAGLTPAAVVCELMNPDGTMSRLSDIIEFSQRYDIKVTTIAKLVEYINTH

SEQ ID NO: 11189 - protein, 429 aa, Pyrobaculum aerophilum str. IM2
MPDGLAVWRVLRGAGVKLVKFIVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 11190 - protein, 336 aa, Myxococcus xanthus DK 1622
MATRIAINGFGRIGRCILRAVLSRKEDLEIVAINDLDKPAALAHLFKYDSVHRTWPGEVKATEKGIVVDGKEITVTAEKDPTALPWKSLNVDVVLECTGRFTARDAAEKHLKAGAKKVIISAPAKGPDITIAYGINHNEYDPAKHHVISNASCTTNCLAPIAKVLVDNFGIEKGLMTTVHSYTNDQRILDLTHEDMRRARAAALSMIPTSTGAAKAIGEVIPQLKGKMHGLAVRVPTPNVSLVDLTVNTEKKVTAEAVIEAFRKAAEGPLKGVLEFSDAQTVSVDYNGNPHSAIFDSTNCFVMGDNLLKVMAWYDNEWGFSNRMVDTAKFLVSKGV

SEQ ID NO: 11191 - protein, 226 aa, Syncephalastrum racemosum
ADSCPADALSCSATSGDSCCSPTNGLLVLVQQWLKDYGPNTAFTLHGLWPDTCSGGIPGSGNTGCDSSRNVDDVGSVIKSGDSSLYSQMSQYWPSYTGDNSEFWTHEWNKHGTCVTTLDPDCFGASYTDNEDMFTYFQQAIDLRAKYNLYTILKDAGITPGGSYSVSALESAIEKSTGSTPKITCSSGAISEIWLYFHVKGTDSYVPTDAVDKSTCSGTVIYPAKS

SEQ ID NO: 11192 - protein, 271 aa, marine gamma proteobacterium HTCC2207
MSKIAFIGGGNMASSIIGGMLANGFQPEQICVGNRGTEKCQRLQQAYGIAATSDNHAAVAGADIVVMAVKPQVMGAVVKDLASSINPGAVVVSVAAGIQLCNFQDWLGASRAIVRVMPNTPSMVRCGAAGLFANALVSNEQKVSIESIFNAVGISCWVDNEAQIDAVTAVSGSGPAYFFLFMETMQRVGQELGLSEQVARELTIQTALGAAEMASNSEHNTEELRLQVSSPGGTTRAAIAQFEALDIEETIRQAMRAAHNRAGEMAQEFSN

SEQ ID NO: 11193 - protein, 655 aa, Colwellia psychrerythraea 34H
MSGYFEILAILTCAVFVVWLFRRLNLPAILAYLVAGMLVGQHGLNLVQDQVDYDHFAELGIVFLLFTLGLEFSLPRLMAMRHLVVSVGSLQVGISLLVFIIAGLFFGLSFSEAFVVGSILALSSTAIVIRQLSETGAMKRKSGQLSVAILLFQDVAVVPLLIIIPMLAMDSQSSMVWALMLAMVKGVVVVALLLLIGKWLLPKVFNIIAQVRTDELFVLTTLLVTLLAAAFTQWFGLSMALGAFLAGMMLSESEYKHQLEADIRPYRDILLGLFFITVGMKLDVSLLISSPFSLLGLMLCFMLVKIMVIKILAVKAGESSKDAWASGLMLAQMGEFGFVLIALANQSQILPLDVASMLLGAGVISMAITPFMINNARSWALFLSQEKSPESLDLSQLPENKVLENHVVICGFGRVGQTVSRFLKQDEIDFVAIDVDPLRTQKAREAGEKVLFGSSRQTEVLNAAHLSEAKLVVIAFGDDKQSLEVIQKVRSMNEKVPILVRTRNDDQLDALQAAGANEVVPESLEGSLMLVSQVLSLTGVPFSRIMRRVQRERKNHYNHLHGFFQGEHTDMSPQAIDRIEFAHAILINDNSFSCGKSIESLNLGKMRVNVVALRRGDIECESPGKDTVLQAQDTLIIRGKPRGVEKADHYVQEGK

SEQ ID NO: 11194 - protein, 92 aa, Colwellia psychrerythraea 34H
MAATAYALHILVKHKEIAEDIIEQLGKGAKFQTLAKKYSSCPSGKKGGDLGEFKRGQMVPQFDKIAFKGALLESHLVKTKFGWHVIKVLYRT

SEQ ID NO: 11195 - protein, 294 aa, Rubrivivax gelatinosus PM1
MSDAAAAPPERKKRTITEIRDSKKSGEKMVYTSVPDYTSAKWAELAGVDVAVVGDSLAMVAHGHSSTVPATMDMMVMHAQAVRRGAPRTFTLGCMPYQSYNTVDRALLNATRFMQDGGCDAVKPQGGRSQAHILKALVDSGIPTASHIGLTPHTIAMFGGFKIQGRTAEAAMKILEDAFAIQDAGCFMLEFEAVPAKIATLISKQLEIPTIGIGAGAGCDGQILLSYDLLGVFTDFKPKFTKRYANLTEVAVQGLKAYVDEVKTGRFPDDDHSYGVDDREYEQFMNLVEKRRHV

SEQ ID NO: 11196 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 11197 - protein, 441 aa, Rubrobacter xylanophilus DSM 9941
MSSTVGDFFGASPRRVRDPVWGYIPVDRPMRALLESEALERMKGLHQLGFAHLVFRNARHSRYDHALGTCHLTRLVLRRIVDSGAYLEERDLRSALAAALLLHAGSPPYGDALEGLGLPPRRELSRRWIEESDAARVLQKEWELDPHNVLRLVLPEEDRPVALTPTEHLLRDILSGSLDADSLDGLARDARAAEAGFLPFKIEPLLEHLRVVGQENRAVLSVDEEGAGALQALVFSRYLMHYNVYGHHALRAPTVMFRRAAQDALQGGAVAPEKLAALDDARAFSLVRESAREGSPAAAVLTRLLSERRLYRRAIELDERHPGYGSLLRLREDANWRRRVEEAWARYLTRYRKGEAGPFDILIDIPPRSRPSVGLRFIRRLPVVPGERSLTTWQSLSGLSGEDMRRCWLPLHRIRVFAAGEELARSVRRHAEELFTIAEEV

SEQ ID NO: 11198 - protein, 198 aa, Glycine max
GNSLIPWLKNLSTASSSASSPKLPHLYLHSGSISAPVTPPLSSPTSRTPRINVEWDEQSARPGWTRQQHYSFLPSSSPPSPGRQVVDPEWFAGIKLPHVSPTSPTFSLVSSNPFAFKEDGLPGSGSRMWTPAQSGTCSPAIPPGSDQNADIPMSEAVSDEFAFGSNTLGLVKPWEGERIHEEFGSDDLELTLGNSKTR

SEQ ID NO: 11199 - protein, 979 aa, Nostoc punctiforme PCC 73102
MVLNAPILKSNEQQVLNQKSQKLSSFAPRHIGPNSDDIQQMLKVLGFPSLDALIDKTVPQTIRLKQPLKLPEAESEYAALASLKKIAAKNQVFRSYIGMGYYDTITPLVIGRNILENPGWYTAYTPYQPEIAQGRLEALLNFQTLIIDLTGLEIANASLLDEATAAAEAMSLSYGVSKNQANAYFVSHDCHPQTIDVLQTRAKPLGINIIVGDHQTFDFDRAIFGAVLQYPASDGTIYDYRAFIEKAHAKGALVTVAADPLSLTLLTPPGEFGADIAVGSTQRFGIPLGFGGPHAAYFATKEEYKRLVPGRIVGVSKDAQGKPALRLALQTREQHIRREKATSNICTAQVLLAVMASMYAVYHGPDGLKQIAENIHQLTLMLAAGLKHLGYKISSEHFFDTLRVELGTRSLEVILEACQARNINLRIFDDTAVGISVDETTTADDLIELFEIFAAPDSLLFGFKEIGDLIAARRKSSLQNSTFARTSNYLTHPVFNRYHSETELLRYLHKLESKDLSLTTSMIPLGSCTMKLNATAEMIPVTWEEFGKIHPFAPASQTQGYQILFQQLEAWLAEITGFAGISLQPNAGSQGEYAGLLVIRQYHENRGEAHRNVCLIPTSAHGTNPASAVMCGMKVVAVACDSQGNIDVDDLKAKAEKHSHELAALMVTYPSTHGVFEEPIQEICAVVHSHGGQVYMDGANMNAQVGICRPGDIGADVCHLNLHKTFCIPHGGGGPGMGPIGVASHLVPFLPGHPVVTINDSTQHSHIGAVAAAPWGSASILVISWMYIAMMGADGLTQATKVAILNANYIAKKLESYYPVLYQGKNGLVAHECILDLRSLKKSAAIEIDDVAKRLMDYGFHAPTVSWPVGGTIMVEPTESESKQELDRFCDALIAIRQEIAEIEVGKVDAQDNVLKNAPHTAESLITGEWQHPYSREQAAYPAPWTREYKFWPAVGRIDAAFGDRNFVCSCLPMDAYSS

SEQ ID NO: 11200 - protein, 679 aa, Zea mays
MQDSNPFTSVDCQSSGSGTPSPAPSSSSSSNLNNSAFWSNVVALLDALPSAAAPSRFASISSGNGTTRAFVRGICRGDTLPADCAKYLQNATLTIQSRCNRSSRRAGIWYDKCFVSYADTNASTSEEQSFRSILYNTGEVGDKDAFETTYYALMRQLTARVVNGSGTATSPSSTSSSLRSVSPMFATGEAVYDAAAPNGTMYGLLQCMRDRTQAECEQCLKDSVGQLPSCCYGHQGGVVLGYNCNLRVEIYTYYDLAIDAPPPSGSGFIGQSQVKKRVHTRTILAVALPVGTVFAAAAILGVFMQRRKTNRKKTQRLGNDIKEENISFVAPGKLSIAVLRTATNNFSEENKLGEGGFGEVFKGTLEDGEEIAVKRLSHTSSQGFNELKNELVLAAKLKHRNLVQLLGVCLQEEKLLAYEYMPNRSLDTFLFSGNPGTRRQLDWSKRFGIICGIARGLVYLHEESRLKVVHRDLKPSNVLLDADMNPKISDFGLARAFSNDQSVDITRRPVGTLGYMSPEYAYWGNVSTKSDMFSFGVIVIETVTGRRNNSPYDQSAGSVSVLSHVWDKWRTGATTDVVDPTLGAEHYSESEVVTCIEVGLLCVQENPADRPDASAVVLMLSSPTSTPGDRRVPSRPAFVFSTASAWSSGGVQIGNNKHTSTSMVSVSDNEVTITELQPR

SEQ ID NO: 11201 - protein, 469 aa, Erwinia carotovora subsp. atroseptica SCRI1043
MIVPVIMAGGSGTRLWPLSRALYPKQLLALHSDVTMLQATISRLAGFESEAPLVICNEAHRFIVAEQLRELRCEGKIILEPCGRNTAPAIAVAALQAMRLAPDVDPILLVLAADHVIENEDAFTQAVNQAQPLTALGKLITFGIVPTEAHTGYGYIRRGISVNDAAFTVDCFVEKPNASTAEAYVSSGDYYWNSGMFMFKASVYLNALKEHRPDIFAACEQACANSREDLDFTRLDEAAFTDCPDDSVDYAVMEKTSDAVVIPLAAGWSDVGSWSSLWGILEKDESGNVNIGEVIALDSHNNYISSDSALVATIGINDVVIVNTGDALLVAAKDRSQDVKKVVDRLKESNLHHYREHPESFRPWGKISNIDSGDHYQVKKIIVHPGHGLSLQQHFHRAEHWVVLVGTAKVNIDEKEFFLSENQSTFIPPGAVHTLENPGVIDLVMIEVRSGHYLADDDIVRLQDRYGRI

SEQ ID NO: 11202 - protein, 393 aa, Streptococcus mutans UA159
MTKLSRRVLEMEESVTLATSARAKTLKAQGRDVLELSLGQPDFVTPKNIQEAAMKSIRDGRASFYTIASGLPELKDAISQYFEKFYGYSVERKQIVVGTGAKFILYALFAAVINPKDEVIIPTPFWVSYADQIKMNDGVPVFIRTSEENHFKATVEQLEAARTNKTKMIVLNSPSNPTGMIYSKKELEAIGNWAVKHDILILSDDIYGRLVYNGARFTPISTISQPICQQTIVINGVSKTYSMTGWRVGYAVGDPEIIGAMSKIVSQTTSNLTTAAQYAAIEALIGNQDTVEVMRQAFEERLNTIYPLLAKVPGFHVVKPEGAFYFFPNVKKAMEMKGYTDVTEFTTALLEETGVALVTGAGFGAPENVRLSYATDMVTLKEAINRIQAFMEK

SEQ ID NO: 11203 - protein, 456 aa, Pediococcus pentosaceus ATCC 25745
MSKEKKIPSGFIYFFGSFGGILFGYDIGVMTGALPFLQTDWNLQNNAGVIGWITSAVMFGAIFGGALAGNLSDKLGRRKMILISSLVFAIGSLLSALSPHDGQIYLIAVRIFLGLAVGAASALVPAYMSEMAPARLRGRLSGINQTMIVSGMLLSYIVDFLLKDLPEQMAWRLMLGLAAVPAVILYFGVLKLPESPRFLVKSNDIDGARRTLSYIRPENEVDAELKTIRETAAEEESANTSSTFLDLLSGKYRYLVIAGVGVAAFQQFQGANAIFYYIPLIVEKATGNAASSALMWPIIQGVILVLGSLVFLWIADKFKRRTLLTMGGTVMGLSFILPAVLNMFIKDMNPMMIVVFLCIYVAFYSFTWAPLTWVIVGEIFPLAIRGKASGVASSFNWIGSFLVGLLFPIMTANMPQEAVFAIFGIICLLGVLFIRTRVPETKGHTLEEIEEQGLGK

SEQ ID NO: 11204 - protein, 471 aa, Acinetobacter sp. ADP1
MSMANKVLKLIQESGAKWVDFRFTDTKGKEQHVTYPADSIDEDTFEDGKMFDGSSIAGWKGIEASDMILRPDAETGFIDPFFAEPTVVVTCDVIEPSTGQGYERDPRSIARRAEEYLKSTGIGDTAFFGPEPEFFVFDEVKWEIDMSGARHTLIAEEAAWSTGKDYESGNSGHRPRVKGGYFPVPPVDSSHDMRAEMCNKIEEIMGPGRVEVHHHEVASCQLEIGVSFNTMVRKADEVQQFKYAVHNVAHQYAKTATFMPKPMVGDNGSGMHVHMSISKDGKNLFAGDEYAGLSEMALYFIGGVIKHARALNAITNPSTNSYKRLVPHFEAPIMLAYSARNRSASIRIPYVSSPKGKRIEARFPDPMMNPYLGFAALLMAGIDGIQNKIHPGEAADKNLYDLPPEEEAKIPTVAHSLDMALEALQADHEFLLKGGVFTKEMLDAYIELKTEEVRRLNTTTHPVEFDMYYSL

SEQ ID NO: 11205 - protein, 760 aa, Arabidopsis thaliana
MGKKRIVLLLFISFSYAEITKESPLSIGQTLSSSNGVYELGFFSFNNSQNQYVGIWFKGIIPRVVVWVANREKPVTDSAANLVISSSGSLLLINGKHDVVWSTGEISASKGSHAELSDYGNLMVKDNVTGRTLWESFEHLGNTLLPLSTMMYNLVTGEKRGLSSWKSYTDPSPGDFWVQITPQVPSQGFVMRGSTPYYRTGPWAKTRYTGIPQMDESYTSPFSLHQDVNGSGYFSYFERDYKLSRIMLTSEGSMKVLRYNGLDWKSSYEGPANSCDIYGVCGPFGFCVISDPPKCKCFKGFVPKSIEEWKRGNWTSGCARRTELHCQGNSTGKDANVFHTVPNIKPPDFYEYANSVDAEGCYQSCLHNCSCLAFAYIPGIGCLMWSKDLMDTMQFSAGGEILSIRLAHSELDVHKRKMTIVASTVSLTLFVILGFATFGFWRNRVKHHDAWRNDLQSQDVPGLEFFEMNTIQTATSNFSLSNKLGHGGFGSVYKGKLQDGREIAVKRLSSSSEQGKQEFMNEIVLISKLQHRNLVRVLGCCVEGKEKLLIYEFMKNKSLDTFVFGSRKRLELDWPKRFDIIQGIVRGLLYLHRDSRLRVIHRDLKVSNILLDEKMNPKISDFGLARLFQGSQYQDKTRRVVGTLGYMSPEYAWTGVFSEKSDIYSFGVLLLEIISGEKISRFSYGEEGKALLAYIGLLCVQHQPADRPNTLELLSMLTTTSDLPLPKQPTFAVHTRNDEPPSNDLMITVNEMTESVILGR

SEQ ID NO: 11206 - protein, 718 aa, Cryptococcus gattii
MGKGKNHDRKANPGFGKVKSKSGTSSGEFTLKRVKGENFYRDAKSAARVKMLNGGKAVRDRDGKIVEAAAFQKGEKEAEPGRVKPDRRWFGNTRVISQSALDHFRTALKEQKADPYSVLLKRNKLPMGLLQDDTKDSGGRPHIVETEPFGDTFGPKAQRKRPRLDIGSIEELGESSAAAAAAAEAATAESQANGTADLADVYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVDGGWHGEQGATVILTAIAKKSGKLLKGGEPDQEAAAKMVLNDWIRGKIPFFVAPPVKSELESQPGAPAAAAEATAATTAETQAAAEQELAEERETMEMLEEQERSLGKVLGIKRVKGVEQPISKIVTMTKFIGDDARRYVEEEVVDQDKEMAEEEEEEDEEEEEEEEGEDEELAWEDVFPEEADAVDGGEEVEESDEEETDHEDVDEEEAVPSAKQLGKRKATDSDEEEQTATKSKRMTTSKQKATNFYTHANVKNRNRDRKVPKNPGKRSRGDDETTGKKAKKRR

SEQ ID NO: 11207 - protein, 308 aa, Prochlorococcus marinus str. NATL2A
MVRLNEIKMQDGKIFLITGANSGLGYETSKFLLERGATVIMCCRDLLKGEKAKKELLKFKFSGKIELVELDLSDLINVKKFAESIKNTFDHLDVLINNAGIMAPPKTLSKQGFEIQFAVNHLAHMFLTLELLPMLEEKNNSRVVTVTSGVQYFGKIQWEDLQGNLKYDRWASYAQSKLANVMFGLELDSKLKETNSKTSSLLAHPGFARTNLQPKSVEANQSWQEELAYKLMDPMFQSAKMGALPQITAATLTSASGGEQYGPRFNFRGFPKICRNAPKALNQTSRKKLWDISEKLIKDFDTLSKQSK

SEQ ID NO: 11208 - protein, 569 aa, Ehrlichia ruminantium str. Gardel
MHDSKYLLDIITLLSAAILIVVLFWKLNISPVLGYFVAGTLIGAHGLNLVESSVIIQNLGEFGVVFLLFLIGIELTFERLIAMRLHVFGFGTLQVIVTTLAIWYIANKFGIDSKGSIIIGGALALSSTAIVLQVLQEKGCQSTQVGRLSIAILLLQDLAVVPLIVLLPLLSGESHHSIPISLLYSFIKAAVALTLIFITGRLLLRPLFNTIAAIKSSEIFIATTLLIVLGSAFITENFNLSMALGAFVSGLLVAETEYRHDVEQVVLPFKKLLLGLFFMTVGMSIDIKFVVNKLPIIGLISFSLITLKSLIIFILCRFFKFHVAAAIQAGLLLSQGGEFAFILFGLAAEKNVLPSDLAQTLMMITTVTMAFTPPLAALGDWIAKLITKKKISLNSQELTLDTKDLDQHVIVVGFGRVGRMVAKVLVAEHVNYIASDIQPKTVKDGRDAGFPVYLGDLTKLATLESMAISRAKMIIIAINNEVTIKKIISLVAQRFPNIIIIVRLPDLNNAEVYKELGAHYLIHETYEVGLQLGAIALSNTGFSNHAISLLKDRFRTVNYAAVKNKEANE

SEQ ID NO: 11209 - protein, 277 aa, Salmonella bongori
QKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAG

SEQ ID NO: 11210 - protein, 207 aa, Candida albicans SC5314
MISMTNIFTPIEEALEAYKNGEFLIVMDDEDRENEGDLIMAAELITQEKMAFLVRYSSGYVCVPLSEERANQLELPPMLANRSDRHGTAYTITCDFAEGTTTGISAHDRALTTRSLANPNSKPQDFIKPGHILPLRAVPGLLKKRRGHTEAAVQLSTLAGLQPAGVICELVRDEDGLMMRLDDCIQFGKKHGIKIININQLVEYISK

SEQ ID NO: 11211 - protein, 305 aa, Candida albicans SC5314
MDTKEIRSTVSNLEKAVDDTTILKLLNILNDGVKPSEKLLRETKVGVAVNKFRSHDSAEINGLVKKMIRNWRDAVQAEKNNKKKLAIAAGTGTGTPSSSAISPSSSGSGSTTPKPSESTTPSAARKGPRNPKTDGVNTQLYENDTRNASVSALYTSLAVDRDDSPKHILRIAIEIEAEVYKSEYSKVSDSYRNRLRSFTMNLRNKKNPELRERILSKQILPAAFIKMTPNEMAPEALKKEIEKLHKQNLFDAQGATEKRAVTDRFTCGKCKHKKVSYYQMQTRSADEPLTTFCTCENCGNRWKFS

SEQ ID NO: 11212 - protein, 277 aa, Aphanothece halophytica
MTKADAVAKQAQDYYDSGSADGFYYRIWGGEDLHIGIYNTPDEPIYDASVRTVSRICDKIKNWPAGTKVLDLGAGYGGSARYMAKHHGFDVDCLNISLVQNERNRQMNQEQGLADKIRVFDGSFEELPFENKSYDVLWSQDSILHSGNRRKVMEEADRVLKSGGDFVFTDPMQTDNCPEGVLEPVLARIHLDSLGSVGFYRQVAEELGWEFVEFDEQTHQLVNHYSRVLQELEAHYDQLQPECSQEYLDRMKVGLNHWINAGKSGYMAWGILKFHKP

SEQ ID NO: 11213 - protein, 149 aa, Pisum sativum
MDASTKVKKGAGGRKGGGPRKKAVTRSVRAGLQFPVGRIGRFLKKGRYAQRVGTGAPVYLAAVLEYLAAEVLELAGNAARDNKKNRISPRHLLLAVRNDVELGKLLAGVTIAYGGVLPNINPVLLPKRTESAASAPKSPSKAKKTPKKA

SEQ ID NO: 11214 - protein, 391 aa, Clostridium thermocellum ATCC 27405
MYTIQTLNKISLKGLELFPRDSYEIATEISNPDAILVRSYDMLSMELPKNLKAIARAGAGVNNIPVEKCTERGIVVFNTPGANANAVKELVLASLFMSSRKIYKGISWVQSLKGKGNEVAELVEKYKSQFAGPEIKGKKLGVIGLGAIGGLVANDAVALGMEVIGYDPFISIDSAWELSSSVEKAVSLDYLLSTCDYITIHVPFNPKTKGMINKEKFEIMKKGVRLLNFARGGLVVNKDLLEAIENGTVACYVTDFPEDELLGNDNIITLPHLGASTPESEENCAVMAASQLRDFLEYGNIKNSVNFPNCELPYTGNVRVIVAHDNIPNMFGQITSLIARNGINIGDMISKHKDKIGYTILNVEREISDEIVENIRAIEGVRMVRVINKTK

SEQ ID NO: 11215 - protein, 124 aa, Witheringia solanacea
NWSGRLLYCIPNYTFAKIAIGEKSDILDKSWPQLENTKTDGLKRQTFWERQYKKHGTCCKNKYTKEAYFNLAINLKDRFDILKILSDQGIVPGNKYDIQIVHDAIKKVTRQPPKLMCIEASPVL

SEQ ID NO: 11216 - protein, 475 aa, Bordetella parapertussis
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLERFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 11217 - protein, 229 aa, Brassica napus
  misc_feature (94)..(94): Xaa can be any naturally occurring amino acid
  misc_feature (124)..(124): Xaa can be any naturally occurring amino acid
  misc_feature (160)..(160): Xaa can be any naturally occurring amino acid
  misc_feature (179)..(179): Xaa can be any naturally occurring amino acid
  misc_feature (199)..(199): Xaa can be any naturally occurring amino acid
  misc_feature (203)..(203): Xaa can be any naturally occurring amino acid
  misc_feature (209)..(209): Xaa can be any naturally occurring amino acid
  misc_feature (217)..(217): Xaa can be any naturally occurring amino acid
  misc_feature (220)..(220): Xaa can be any naturally occurring amino acid
  misc_feature (222)..(222): Xaa can be any naturally occurring amino acid
  unsure (1)..(229): unsure at all Xaa locations
MVGMAVVGPWTLRVASPSPRVKSATCNSNSCPTTVNLRSELSAFRPQFRLFSRCFSDTPPPSLGASSSAHSGTFLPHLVASMEQVEENYILVKXPDGIQRVLFGEISSRFEQMGFKLIRLKMFXCPKEFAQEHFLDLSAKAFFPSPIEDITSGPSWCVWXGTSARWRLPPPVPLQAEPXTIRGDLAVQTGRNIVHGSDXPENXKREIAXWLKEGELXGWXSXLAKWLRE

SEQ ID NO: 11218 - protein, 460 aa, Nostoc punctiforme PCC 73102
MKLPKGPQSPAVLQMLRWITSPMSFMETCAKRYGDMFTIRLDSKSPPLIFVSKPEVLEQILTNDIKGLEAPGDTNLVFESLLGKHSVITISGAEHQRQRQLLLPPFHGERMRSYSQIISDITEKVISQYQIGQPFNIRSVTQAITLRVIMQAVFGLDEGPRAEKLQHCLAEMLEKGSSVLSAALLYFPALQRDFGPINFWGKQMRRQQAADKLIYEEIRERQEQPDPSRTDILSLLMAARDEAGQPMTDEKLRDELMTLLVAGHETTATALAWAFYWIQKIPTVRQKLLKELDSLGDNPDPSTIFKLPYLNAVCSETLRIYPVAMLTFARVVRTPLSLGGYELEPGIGVIGSIYLTHHREDLYPEPKQFKPERFLERQFSPYEYLPFGGGARRCIGLAFAQLEMKLALAKILSTRELELVDNSEVRPKRRGLVTGQDRPIQMVVTSQRQVKFPILQTATV

SEQ ID NO: 11219 - protein, 145 aa, Triticum aestivum
  misc_feature (9)..(9): Xaa can be any naturally occurring amino acid
  unsure (1)..(145): unsure at all Xaa locations
GTRLLRSPXKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLVRAKANSLAQLGSYTGEGESDEAKKGMFQKGYTY

SEQ ID NO: 11220 - protein, 302 aa, Cryptococcus neoformans var. neoformans JEC21
MPSPAVDLLKQKTASLPNAPISVVAANTFVPPTQPVTAGNQLPTSVPLPVLPAVEAAKRLAAYAAVDRHIAHEHKVIGIGSGSTVPYVVDRILAQGFEANKDRVFLPTGFQSKELIVKAGLTLGDVDQYARIDVTIDGADEVDNELNSIKGGGACQLREKVLAEAADTWIIVADYRKNSEVLGTSWTKGIPIEVVPFAYAKVLTNLAHMGSPHVLPNGQPGLSLRMGKMKAGPVVSDNGNFIIDAPFAEELMRQPEELLHKIKMLTGVVEVGLFCGMAKAAYFGNEDGSVTIRSDDGTISQL

SEQ ID NO: 11221 - protein, 343 aa, Listeria monocytogenes str. 1/2a F6854
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 11222 - protein, 135 aa, Triticum aestivum
  misc_feature (51)..(51): Xaa can be any naturally occurring amino acid
  misc_feature (70)..(70): Xaa can be any naturally occurring amino acid
  misc_feature (103)..(103): Xaa can be any naturally occurring amino acid
  misc_feature (123)..(123): Xaa can be any naturally occurring amino acid
  unsure (1)..(135): unsure at all Xaa locations
MAPTVMASSATSVAPFQGLKSTAGLPVSRRSNGASLGSVSNGGRIRCMQVXWPSEGIKNSETLSYLPPLXSTGGLPLSKSDYLDSVPSWVLSSEFKKVGFIFXVEHNASPWGTTMARYWACWXLPISGCTDARST

SEQ ID NO: 11223 - protein, 177 aa, Triticum aestivum
  misc_feature (101)..(101): Xaa can be any naturally occurring amino acid
  misc_feature (126)..(126): Xaa can be any naturally occurring amino acid
  unsure (1)..(177): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFIKVGFIFREXHNASPGYYDGRYWTMWKLPMFGCTXDATQVINEVEEVKKEYPDAYVRIIRFDNMRQVPGVSFIAFNPPGCDDVDKA

SEQ ID NO: 11224 - protein, 350 aa, Listeria monocytogenes str. 1/2a F6854
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 11225 - protein, 477 aa, Yersinia pestis KIM
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 11226 - protein, 130 aa, Brassica napus
  misc_feature (69)..(69): Xaa can be any naturally occurring amino acid
  misc_feature (89)..(89): Xaa can be any naturally occurring amino acid
  misc_feature (125)..(125): Xaa can be any naturally occurring amino acid
  misc_feature (127)..(128): Xaa can be any naturally occurring amino acid
  unsure (1)..(130): unsure at all Xaa locations
MSAFTSKFADELIANAAYIGTPGKGILAADESTGTIGKRLASINVENVETNRRALRELLFTAPGALPCXLSGVILFEETLYQKSSDGKXLFVDILKEGGVLPGIKVDKGVPLELAGTNGETTTRXLXXEE

SEQ ID NO: 11227 - protein, 509 aa, Candida albicans SC5314
MITKRLYSTIESSKKVLGTLSNPNLVKTEAYINGKWVPSSSGETFTVTNPALYPNPESELATMQSMSEEDFNSAIESADIAFNKFKKTTGRYRSELLLKLYNLMISNKDDLAKLVVLENGKPYADALGEVNYAASFFQWFSEEAPRIYGDIIPSANGTNRILTFKQPIGVCGILTPWNFPLAMITRKLGAAIATGCTAVIKPASETPLSATALAFLAEEAGFPPGVINVLPSADASGSGKYLTEHPLIKKVSFTGSTPVGKILMNQSASTLKKLSFELGGNAPFIAFDDVDVDKAVNGAIASKFRSSGQTCVCANRIFVHEKIYDEFAKKFVDKLKNETVLGNPLASGVTHGPVIHDRSMKKVRQHIEDAVDKGATILLGGSKRPDLGENFHDLTVLGDVTTEMLITQEETFGPVAPLIKFKTDDEVIKMANDTTVGLAGYFYANDVAKVFKIAEALNVGMLGVNTGAISEAALPFGGVGESGFGREGSKFGVEDYLVIKSAVLGGIEN

SEQ ID NO: 11228 - protein, 265 aa, Leptospira interrogans serovar Lai str. 56601
MKNIHKIFSPEKKGKEKISVVTCYDFSFARILNETEIDSILVGDSLGMVFQGNTSTLPVTLEEMIYHTKAVRRGAPDKFLIADLPFLSYQTSIEEGIRSAGKIMKESDCDAVKIEGGSEFICELVSILKQIGVPVMGHLGLTPQSVHVFGGHRVQGKGEESSSKLLKESISLFESGVFSMVLEMIPAELGKKVSQEVGVPTIGIGAGSDCDGQVLVLNDLLGLDINFQPKFLKKFSNLHSIVKEAIADYDKEVKSGEFPGKDHSF

SEQ ID NO: 11229 - protein, 124 aa, Witheringia solanacea
NWSGRLLYCIPNYTFVKIAIGEKSDILDKSWPQLENTKTDGLKRQTFWERQYKKHGTCCKTKYTKEAYFDLAINLKDRFDILKILSDQGIVPGNKYDIQIVHDAIKKVTLQPPKLMCTEVSQIL

SEQ ID NO: 11230 - protein, 248 aa, Brassica napus
MASTSLLKASPVLDKSEWVKGQSVLFRQPSSAAVVLRNRATSLTVRAASSYADELVKTAKTIASPGRGILAMDESNATCGKRLDSIGLENTEANRQAYRTLLVSAPGLGQYISGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHNIDRTYASSDIKFV

SEQ ID NO: 11231 - protein, 327 aa, Schizosaccharomyces pombe
MSNPDVDLDSIIDRLLEVRGSRPGRQVQLSEDEIRFLCNKAREIFISQPILLELEAPLKICGDIHGQYYDLLRLFEYGGFPPEANYLFLGDYVDRGKQSLEVICLLLAYKIKYPENFFILRGNHECASINRIYGFYDECKRRYNIKLWKTFTDCFNCLPIAAIIDEKIFTMHGGLSPDLNSMDQIQRIMRPTDVPDTGLLCDLLWSDPDKDLTGWGDNDRGVSFTFGPDVVSRFLHKHDMDLVCRAHQVVEDGYEFFSKRQLVTLFSAPNYCGEFDNAGAMMSVDESLLCSFQILKPAEKKQRYGYQGSSQNWHMTPPRKNKTGNSK

SEQ ID NO: 11232 - protein, 778 aa, Fusobacterium nucleatum subsp. vincentii ATCC 49256
MEERLLEKFSVSLKDTTPFEVYRALGETVMSFIAKDWYKTKQEYSKTKQAFYLSSEFLMGRALGNNLINLGIDKEVKEFLEELGIDYNQVEDEEEDAALGNGGLGRLAACFMDSLATLNLPGQGYSIRYRNGIFNQYLRDGYQVEKPETWLKYGDVWSVMRPEDEVVVNFGHTSVRALPYDMPIIGYGTNNVNTLRLWEAHSIVDLDLGVFNQQDYLHATQDKTLAEDISRVLYPNDSTDEGKKLRLRQQYFFVSASLQDIIKKFKKIHGREFLKIPEFIAIQLNDTHPVIAIPELMRILVDIEGVLWEDAWEIVKKTFSYTNHTILAEALEKWWVGLYQEVVPRIFQITEGIHNQFKNELATLYPDDVDKQNRMQIIQGNMIHMAWLAIYGSHKVNGVAELHTEILKEHELRDWYELYPEKFLNKTNGITQRRWLLKSNPQLASYITELIGDAWIKDLSELKKLEQFLDNEKVLNKIWDIKIEKKKELIEYLRETQGIDINPKSIFDVQVKRMHEYKRQLLNIFQVYDLYQQLKQNPSMDFTPTTYIYGAKAAPGYKVAKGIIRLINDIAQIINGDSDVKDKLKVVFIENYRVTVAEKIFPAADISEQISTAGKEASGTGNMKFMLNGAITLGTLDGANVEIVKEAGEENEYIFGMRVKDIDELRKKGYDPRFPYNNITGLKQVVDALIDGSLSDLGSGIYREIHSLLMERGDQYFVLEDFEDYRRKQREINRDYKNKISWAKKMLKNIANAGKFSSDRTILEYANEIWDIKETKIK

SEQ ID NO: 11233 - protein, 307 aa, Acetabularia peniculus
MVVYKQLDEWIEHLMQCKPLPEENVKELVAKAREVFSNEKNVQPVKMPVTVCGDIHGQFHDMVELFKIGGTCPDTNYLFMGDYVDRGYNSVETVTLLVSLKVRYPERITILRGNHESRQITQVYGFYDECLRKYGNANVWQLFTDLFDFLPLTGLIENEVFCLHGGLSPALDTLDQIRELDRIQEVPHEGPMCDLLWSDPDERLGWGISPRGAGYTFGQDISEQFNVRNSLKLVARAHQLVMEGYNWSHEKNVVTIFSAPNYCYRCGNMAAIMEVAEGMDKGFQQFEPAPRRGAEGEVNRRTPDYFL

SEQ ID NO: 11234 - protein, 381 aa, Raphanus sativus
NRTLVSPGNVFELGFFKTTSSSRWYLGIWYKTLSDRTYVWVANRDNPLSNSTGTLKISGNNLVLLGDSNKSVWSTNLTRRNERSPVVAELLANGNFVMRDAGEFLWQSFDYPTDTLLPEMKLGYDLKTGLNRFLTSWRSSDDPSSGDFSYKLEAQRLPEFYLSSGIFRLHRSGPWNGIGFSGIPDDQKLSYMLYNFTENSEEVAYAFRMTNNSIYSRLTLSSEGYIQRLTWDTSLGIWNMVWSSPLDSQCDMYKMCGPYAYCDVNTSPICNCIQGFNPSDVEQWDLKSWSGGCIRRTPLSCSIDGFTRMNNVKLPETTMAIVDRSIGVKECEKRCLSDCNCTAFANADIRNGGTGCVIWTGRLDDMRNYVTDGQDLYVRLA

SEQ ID NO: 11235 - protein, 334 aa, Myxococcus xanthus DK 1622
MAANANEQTQEELILSFLSESGGDYTSGEALSSKLGLSRTAVWKHVEALRAKGYRIEAVSARGYRLVAVPDRLTSLEVGPLLDTRDLGRTIHHHESLPSTNEKAFRLAQDGARHGEVVVAEQQTAGKGRRGRTWVSPPGLNLYFSAILRPGLPPQRAPELTLVAAVALAESLRDAGVEAAIKWPNDVHIDGLKVAGILTELSAEPERVHFVIVGVGVNLNSQVEHFPEELRATATSLSLALGQPVHRARFAASLWTRLEEWLDLYLDTGFDAVRARWKALSSTLGQDVLVRTDRHELRGRAEDIDPSGALLVRTAEGSLERVLAGDVEQLRPRR

SEQ ID NO: 11236 - protein, 371 aa, Candida albicans SC5314
MSIPVSMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATKVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 11237 - protein, 771 aa, Ustilago maydis 521
MSKQELLLQVTTDVICPWCFVGSRRLKAFLNSEDYKTQIAPHVRLVLKLEPYILDPRLPATSYDTPDKYYDAIETTPYDKNVPPTKKFYYGSKFGGGLDAFDAKISAAASELGMPKFDWTSEGKVGATWNAHRLVLKAGQLDEQNNSRADRDDLETALQSLQMRFMDRFYQDFHSNSKDMSDNTYLAGVAEELGLFDAQEAALTWLESDDLEYELGNKLQQAEMNGVQSIPFYIVNDGADHMSETGSHGSFLKMMQMAVAPYLSELSAERDEPDKPTRLGFAVVSNDDFSTLTFCVTRTATCGRLSGVPIAARVSLCLLAYIAPQETFTNVRYKEFAIRRGNKYLIEPLLRVGLFLVTVISSWAHCHCDYAHRLAEMTRATSVPSVYDTHCDGPGLLPVTKPWSQYYCQLRKYTSDVYATLKFPDFKHADYDCTGKTVLISGSNSGIGKQAALYFARAGATVVMACRFTATHEQNPEEARKEIVATAGVDDSKVELWEIDCSSLANIEKFGIKWRESGRTLDILVNNAGLSAGKRRITDEGFELTHVINLLSHCLLTFYLLPSLNKSAAPRIINTCSCFHAGGKLDFANMDNEKLTSLGPDCVQAYCDTKLWFLMWSVELQDRLSRSDDYRHVIVHGIHPGFVGSNIWHNPDTRIPYPLRIIFQSAISKLSINSEQGSYAIIHAALEPSLGLPKKLTSARNKLAVGESAKFGGKFINRNFVDIRRPEVDDVLARSRLWQRVLEDVAAAKRGVAADLPDHYESVKLLGQSTK

SEQ ID NO: 11238 - protein, 558 aa, Methanosarcina barkeri str. fusaro
MDNLHEALERQNIAYFSMEIGLRSDIATYAGGLGGLAGDAIRSAADLNIPFVAVTLVSNKGYFRQTLDPAGNQIEHKDEWNPAHFMTLCKEEVKVKIQDRDVKLRAWIYTYKSHIGGCVPIIFLDTNVEGNESEDRKITDFLYGGDQRYRLKQEIVLGIGGVRMLNALGFKVRKYHMNEGHSSLLALELLKQNSVDPTKIKELCIFTTHTPVEAGHDKFNYGLVKDLIQDKSDVEILRKFGGTDYFDTSIFAMNLSNYINGVTKRHSQISSALYPGYKIHAITNGVHSYTWTSPYFKKLYDRYLPDWENEPELLIRVGEIPDTEIWEAHWSAKRDLIDEVNKKTGVGMDYDTLTIGFARRMTSYKRPTLIFSDLEMLRSINKRGKIQLIFAGKAHPNDEAGKQIIRDIFKIIETLRDDIKIVFLENYNMDLAAKMVSGVDVWLNTPNCPYEASGTSGMKAAHNGVVNFSVLDGWWIEGWIEDVTGWSIGPKPDEKISIEEIRTAELRDLYYKLYYIIVPMYYEQKDEWLKLINNSIGMIASYFNSHRMMRYYVTQAYL

SEQ ID NO: 11239 - protein, 119 aa, Arabidopsis thaliana
  misc_feature (14)..(14): Xaa can be any naturally occurring amino acid
  unsure (1)..(119): unsure at all Xaa locations
EVIAEYTDRTLQRXTVPAAVPAIVFLSGGRSEEEATLNLNAMNKLQTKKPWNLSFSFGRALQQSSLKAWSGKTENEEKARAAFLVRCKSNSEATLGTYKGDATLAEGASESLHVKDYKY

SEQ ID NO: 11240 - protein, 552 aa, Deinococcus radiodurans R1
MTQAHPEWYKSAVFYELSVRTFQDGNGDGKGDFPGLTSRLDYLKNLGVDCLWLLPWFPSPLRDDGYDVADYRGIHPDLGTLDDFKVFLREAHARGLRVIGDLVTNHTSSDHPWFQAARRGPTLPDGSPNEYHDYYVWSDEGKEYADTRIIFTDTEVSNWTLDEQAGKYYWHRFFASQPDLNYDNPKVVEELHGAARFWLDLGLDGFRVDAVPYLIEREGTSCENLPETHEILKGFRAMVDREYPGRLLLAEANQWPEEVVEYFGTEAEPEFHMCFNFPVMPRLYMSLKREDTSSIREIMGRLPKIPSFGQWCTFLRNHDELTLEMVTDDERAFMYAAYAPDARMKINVGIRRRLAPLLDNDRRRIELLNTVLLALPGSPILYYGDEIGMGDDLGLPDRNGVRTPMQWNAGTSGGFSTAQPSDCFFPPIQDPVYGFGRVNVQSQLQDPSSLLKWTARQLELRRAHPAFAHGDLTFIETGNPAILAFTRQYDGETLLIVSNFAGNAQAGLLDLAPFVGRAPVTLSGASPLPVVTGNGQYPVVMGKYDYYWLRLN

SEQ ID NO: 11241 - protein, 469 aa, Vibrio sp. Ex25
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEEAAEIPTVAYSLKDALAELDADREFLTAGGVFSDDFIDSYIELKSQDVERVNMTTHPVEFELYYSV

SEQ ID NO: 11242 - protein, 433 aa, Propionibacterium acnes KPA171202
MSENHEYLSQGGDWAQIVDEAAERGDETVVVNFGPSHPSTHGVMRLIIELDGESVSDLRVGIGFLHTGIEKNMEFRTWTQGVTFMTRCNYVANFFNELVYCLAVEKLLGITDDVPERARVLRVMITELNRISSHLIAVGTGGLELGASSVAEVGLREREIILEFNQAVTGLRMNNAWIRPGGVATDLPETGLDQLRDLIKRMEKYLPEIGQFCNENPIFKARTQGIGYADLSTCMALGVTGPALRATGLPWDLRKTQPYCDYDTYDFDVATWDTCDCYGRFRIRLEEMDQSVRILKQCLKRLEDTQGDRHMVEDPHIAWPAELALGPDGQGNSNEHIRHIMGESMEALIHHFKIVTEGFRVPAGQVYQAIEGAGGELGCHLVSDGGVRPYRSHLRDPGFVNVQSLPAMCEGGMLSDVVPSLASLDPVMGGVDR

SEQ ID NO: 11243 - protein, 469 aa, Bartonella henselae str. Houston-1
MTTASDILKQIADNDIRFVDLRFTDPRGKLHHITIDIAEISEDTFNDGVMFDGSSISGWKTIHESDMVLMPDPETAHIDPFFAQSTLVIFCDVLDPVSGEFYRRDPRSIAKRAEVYMKSLGIGDTINVGPEAEFFIFDDVRYKVAPYNTGFKLDSSELPSNDDTEYETGNLGHRPRMKGGYLPVPPIDPCQDMRSEMLTVLKDMGIRVEKHHHEVAAGQHELGIRFDTLVREADKMQIFKYVVHQIANSYGKTATFMPKPVFGDNGSGMHVHMSIWKDGKPIFAGNEYAGLSETCLFFIGGIIKHAKAINAFTNPSTNSYKRLVPGYEAPVLLAYSVRNRSASCRIPMTPSPNSKRVEVRFPDPTANPYLAFAALLMAGLDGIKNKIHPGHAMDKDLYDLPLKELKDIPTVSGSLREALEALDKDRSFLKAGDVFDDDQINSFIQVKMQEVLRYETTPHPIEFDMYYSV

SEQ ID NO: 11244 - protein, 99 aa, Glycine max
MPSLQTALPPELANNAIRLYRECLRRAKYIGHRKHNTELLVDMVRQQFKKHMHETDPEKIQKLKDGAARGLINHILYESEQMTGSKFSKSKQPNLLYPK

SEQ ID NO: 11245 - protein, 273 aa, Triticum aestivum
  misc_feature (164)..(164): Xaa can be any naturally occurring amino acid
  misc_feature (226)..(226): Xaa can be any naturally occurring amino acid
  unsure (1)..(273): unsure at all Xaa locations
MAASLLLLSPSPHCHCITTPTRGTGTPLPSPRCHPPAPRRRPRPRGAGLVARGAAVPPEQSLAPHYKTLGDAKSALYQALEGIDRGIFGITSAKRSEIHALVELLESRNPTPNPTDKLHDKVDGCWRLIYSTISILGKRRTKLGLRDFISLGDFFQIIDVKEIXSVTSVHPKEKAVSVIKFSARALKIFSGQLAIEASYTITTKTPRVGIKLESSTITPDQLMNMXRKNYDMLLAIFDPKRWLEITYVDESLRIRRYDEANIFVLEKTDPSQV

SEQ ID NO: 11246 - protein, 451 aa, Methanocaldococcus jannaschii DSM 2661
MKVIRDSIHKDIYLDEKELEIIDSEEFQRLRNIKQTGLTYLVYPSANHTRFEHSLGTMFIASKIAEKINADVELTRVSALLHDIGHPPFSHTLEICGYSHEVFGRKKIKHMNLDNFSKSEIIKTLNRKNLEGKIISGDVDADRMDYLLRDSYHTGTAYGMIDLPRILRSITTFESFGKVKIGILKKGIQAIESLLVARHQMYSAVYMHPTVRIADTMIKRAVIKEIQEKNLDIKDLANMDDIALVSFLRISENYLMERIDRRNLYKNLITYSYFDLNPIEKWIFVNLDEKQILSLESRFYEEFGWDIFIDIYPIPKMEEHNVYIISDEGVKRLDEVSPLAQSLKPSEMRLWNISIYAPKEKIKELRENNVKDRINKILKELDVKVESKLIDILKEYGTITGKRRFLEIAKERGISPKEFYNELHKLIFCGLIKERFNRRTYVYCLNNFVKL

SEQ ID NO: 11247 - protein, 97 aa, Lycopersicon esculentum
MARSFSNSKTLSAFVSDSVSAFLSRRGYAAASQGAVSGVAKGVPRSNVMMQKSGEESVKTSWVPDPVTGYYRPEGQANEIDAAELRKMLLKHRSGSN

SEQ ID NO: 11248 - protein, 393 aa, Rubrobacter xylanophilus DSM 9941
MRLAGRMRRLGTESAFAVLARARELEAQGRDIIHLEIGEPDFDTPPHIVEAGCRALREGHTHYTPAAGIPELREAIAEEVSRSRGVPVHPSQVVVTPGGKPVMFFAILVLVEPGDEVLLPNPAFPIYESMVNFVGGRPVFVPLRQENGFRFDPEEFGERLGPKTRLVILNSPANPTGGVLTPEDTRALAEILRERPDVYVLSDEIYSRLVYPEASFASIASEPGLGPDGRTIILDGFSKTYAMTGWRLGYGVMPRRLAGEFAKLQVNSSSCANAAAQRAGLAALEGPQEPVEEMVREFGARRDMIVAGLNELPGVECRTPHGAFYAFPRVTGTGRSAGELARLLLEEAGVACLSGDGFGRYGEGHLRFSYANSRENISRALERVAKTLAGAAR

SEQ ID NO: 11249 - protein, 70 aa, Glycine max
MKSVGRVGGGESEQRGHFQMPLHYPRYTQADYETMPEWRLDSLLKEYGLPIIGDLHQKRNFAIGAFLWPH

SEQ ID NO: 11250 - protein, 240 aa, Bdellovibrio bacteriovorus HD100
MSAARTIYHMRVEEIIDHTPTVRELVLKTETPNEFGFKAGQFVMLHVPQGEAKPALRAYSIASDDRTKNGFRLLFKFVENGLASTFVWQLKGGELLNFTGPFGKVFFQEPPTEQIVFLNTGTGLSQHLCYLLSKKDQYPNLRYRMLFGVRTEKDMYYQKEIEELQKALPDFKFEFVLSRPQDDWKGKKGYVQNFISEFDYKNIPTTFYLCGNGGMIKDVKHQLLEVDGFDKTRIWAEAFD

SEQ ID NO: 11251 - protein, 440 aa, Listeria monocytogenes
MSYLTEKLREEKVFKDPVHGYVHVSDKIVWDLIATKEFQRLRRIHQLGTTSLTFHGAEHSRFNHSLGVYEIVRQIIDVTFANEPQLNPEERMVALCAALLHDLGHGPFSHAFEKVFGTDHEAYTQEIIIGDTEVSEVLMRAGEEFPLKVAAIIKKNYPNQTLVKLISSQIDADRMDYLLRDAYYTGVSYGKFDLERILRVLRPSPDGNGVIVKYSGMHAVEDYIMSRYQMYQQVYFHPVSRSGEVLLWKILERAKKLYCAGYEFQVTPVQVLPFFLNEVSLKDYIVLDDIVLMYYFSIWQEEEDPILSDLCSRFLNRRLLRYINYDPKEDAELYAELKGLLEKADIDPSYYLVIDSSSDLPYDYYLPGVGSGKDPIKLLMGNGELRELSTESPVVEAIGRERRTDIKLYYPLDFIESGDVDQAITERMIALIHAHSLKEK

SEQ ID NO: 11252 - protein, 358 aa, Methanosarcina barkeri
MTTVIPFGPQHPVLPEPVSLKLEIDDNVVVGVLPSLGYVHRGLETFINTKDFNQTTYVCERICGICSALHGITYTRTVEKLFDTEIPERAQYIRVIVGELNRLHSHLLWLGLFADGFGFESLFYECWKYREEVLDVAERICGNRVIHSISKVGGVTRDLTKEHIDMLLKMCDSLETEIKNIEKVFVNNYTVKQRLVGLATLSKQVAYEVGTAGPTLRGSGNAIDVRETPDWDIYKDLGFKTAVEKDGDCYARTKVRITELLNSLTIIRNAISKMPEGEIEVRVKGFPTGEAIMRTEQPRGEVIYYVKGNGTKKLERLKVRTPTFANIPSLLLMLPGVKLADVPIVVLTIDPCVSCTER

SEQ ID NO: 11253 - protein, 319 aa, Acetabularia peniculus
MDESTVDDVIERLLEVRNNRPGKQVQLTESEIRLLCLTSKEILSEQPNLLELEAPIKICGDIHGQYTDLLRLFEYGGFPPEANYLFLGDYVDRGKQSLETICLLLAFKIKYPENFFILRGNHECASINRIYGFYDECKRRYNIRLWKTFTDCFNCLPVAAIVDEKILCMHGGLSPELKTLEQIRRIPRPTDVPDTGLLCDLLWADPDKDVQGWGENDRGVSYTFGPDTVTEFLQRHDLDLVCRAHQVVEDGYEFFAKRQLVTLFSAPNYCGEFDNAGALMSVDDTLMCSFQILKPSEKKGKFMQGGNSLAGAGRGTPRR

SEQ ID NO: 11254 - protein, 319 aa, Acetabularia peniculus
MEESAVDDVIERLLEVRNNRPGKQVNLAEGEIRQLCLTAKDVFMSQPNLLELEAPIKICGDIHGQYTDLLRLFEYGGFPPEANYLFLGDYVDRGKQSLETICLLLAFKVKYPKNFFLLRGNHECASINRIYGFYDVCKRRYNIRLWKTFTDCFNCLPACALVDEKIICMHGGLSPELKSLDAIRHIPRPTDVPDTGLLCDLLWSDPDKDVAGWGENDRGVSYTFGPDTVTGFLQKHDLDLICRAHQVVEDGYEFFAKRQLVTLFSAPNYCGEFDNAGALMSVDDTLMCSFQILKPSEKKGKLLYGSGALAGPGRGTPRR

SEQ ID NO: 11255 - protein, 181 aa, Helianthus annuus
TTTTYDRHFTTTQPHYRQDDRSRYDQQTHSQSTSRTLAIIALLPVGGILLGLAALTFIGTLIGLALATPLFVIFSPIIVPAVLTIGLAVTGFLASGTFGLTGLSSLSYLFNMVRQTAGSVPESLDYVKGTLQDAGEYAGQKTKDFGQKIQSTAHEMGDQGQVGVHAQVGGGKEGRKSGDRT

SEQ ID NO: 11256 - protein, 315 aa, Rhodopirellula baltica SH 1
MPTEKHFGPQGWTPDRIGSLQGKTYVITGANAGAGFEATRALLSKGAKVVMMNRNADKSAAAIETLKREFGRDADVTFVRLDLAVLDSVREAASELLDTVPQIDALICNAAIAQVAKQEITVDGFESQLGVNHFGHFLLCGLLFDWIEQSHGRIVVVGSNAYKMGLKKIQFEDLNFDKNYTAWNAYAQSKLAQMMFAYELQRRVEASSKHVQVRVCHPGASRTNLLNDTASLPMKMLWKVISPFIAQSAERGSWPEVMCATEDGLKPQALYGPTKRAETVGPVGECPLEPLALNQEAATQLWSVSEQKVALTWSP

SEQ ID NO: 11257 - protein, 178 aa, Helianthus annuus
MASISSSVATVSRTAPAQANMVAPFTGLKSNAAFPTTKKANDFSTLPSNGGRVQCMKVWPPLGLKKYETLSYLPPLTETQLAKEVDYLLRKKWVPCLEFELEHGFVYRENARSPGYYDGRYWTMWKLPMFGCTDSAQVMKELAECKKEYPQAWIRIIGFDNVRQVQCIMFIASRPDGY

SEQ ID NO: 11258 - protein, 846 aa, Methylobacillus flagellatus KT
MGSHTQANGWHFVNSHGKTPMTAAKESNKPKASTLVITTEKTPIAQALQNHLIFSAFKTSEASTPRDWYVATGYTIRDHVVERWVKTAEAYNAQDPKRVYYLSLEFLLGRMLQNAALNLGIEGEVAEGLKTLGHKLEDVVELENDAALGNGGLGRLAACFLDSMASMDIPGTGYGIRYEYGMFRQSISQGQQVENPDNWLRYGNIWEFQRPESQYPVRFYGRVVEFPTAKGMEYHWVDAESVLAIAYDMPVPGYDTETVNTLRLWSAKAAREFDLAHFNEGNYEKAVEERNAYENISKVLYPNDTSVLGKELRLKQQYFFVSASIQDILRRFLAKHDDWSVLPDKVAIQLNDTHPAIAVAELMYQLVDVHHLDWDKAWKISEKVFAYTNHTLMPEALETWSVEMFGRLLPRHLGIIYRINHEFLQMVNHKFPGDTDLLRRVSIIDEEHGRRVRMAHLAVIGSHTVNGVAALHSELLKSTLFADFNRIFPGRFINITNGITPRRWLNQCNPGLTKLLESVIGKDFHHDLYKLRALEPLADDADFRKAFHAVKLANKERLAKRIEQVTGVRLNPAALFDVQIKRIHEYKRQLLNVLHIVTLYNRIRSGHVKDITPRAVIFGGKAAPGYWMAKLIIRLINDVASIVNEDPAVGDKLKVVFYPNYEVSAAELLFPGSDLSEQISTAGTEASGTGNMKMALNGALTIGTLDGANVEIREEVGEDNIFIFGLTTQQVAELKANHYNPWDYYHGNPELKQALDMITNGFFSVDEPDRYRAIGEALLQNGDQYLLLADYASYIDTQDAVGQLYRDKDEWNRRAILNVARIGKFSSDRTIGEYVEKVWHVKPVQH

SEQ ID NO: 11259 - protein, 393 aa, Pediococcus pentosaceus ATCC 25745
MPELDSALQNQTRPALSAISRSAIRQFDQQVSDIPGILKLTLGEPDLNTPEHVKQVLINAITNNASHYAPSAGLLRLRQAVSKYLLNSTNIRYNPASEILITIGATEAIFATMQTILSVGDEVIIPTPTFPLYMAIAKAIDATVIEIDTSDTDFVLTADALKQALQAHPNAKMLVLNYPTNPTGATYSKSKLTELAQVIQNSKLFVLADEIYGELSYDNKHYSIAELLPSRTILINGISKSYAMTGYRIGFLAAPATLTSNILKLHGFMVTTAPTSIMEGAIEALLHGQDDVAKMCEQYRLRRDYLVKELNQLNFQVRSPAGTFYLFAKIPINLIQNSNQLALQIAHQAKLAVIPGKVFGAGGEGYLRFSYAASMSNLHEAVRRLTKFVQEEK

SEQ ID NO: 11260 - protein, 345 aa, Bacillus anthracis str. 'Ames Ancestor'
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQNNCDCK

SEQ ID NO: 11261 - protein, 221 aa, Prunus mume
MAILKSTLAFLVLAFAFFFCCVMSTGSYDYFQFVQQWPPTNCKFRKCSKPRPLQRFTIHGLWPSNYSNPTRPSNCTGLQFEARKVYPQLQSDLKISWPDVESGNDTKFWEDEWNKHGKCSEQTLNQRQYFERSHAMWTSFNITEILKNASIVPHPKKTWSYSDIVAPIKTATERTPLLRCKLDKKTQLLHEVVFCYEYKAKKQIDCNRTAGCGHQPAISFQ

SEQ ID NO: 11262 - protein, 435 aa, Pseudomonas fluorescens Pf-5
MTGIDEIECVTADLNGVPRGKVMTAEGFLEGRRLQMARGVLLQCIMGGYPPARFYGSDDGDLALNADPRQIHRLPWSETPRALAICDADELSGESSRLSTRGQLKQVIARYAALGLAPVVATELEFFVFAANDDPAQPFRPPVGLDGRREEGYSAFSVSSNNGLRPFFKEVYEGMAALGLPRDTFMHEMGVSQFEINLLHGDPLLLADQTFLFKHLLKEVALKHGLIVVCMAKPLAHTPGSSMHIHQSLVEMGNGRNVFSDDAGQPTAMFRHFIGGLQAGLADFTALFAPNVNSYQRLCHPYASPNNACWSHDNRAAGLRIPASSPVARRVENRLPGADANPYLAIAASLAAGLHGIENELEPTAAIQGEFEVPDNLSLPCTLHAALERLKRSQLARELFGNEFIEGYIASKTMELTSFFDEITPWERRVLAAQA

SEQ ID NO: 11263 - protein, 334 aa, Lactobacillus paracasei subsp. paracasei
MKNKSTQEKVVLELLTNLDTWVSGDYLAKKFQVSRETIWKAINNLKNKRDYPIVSRKKRGYMLHTAPYLEADLINIYGHKQLTDNLHVFKEVTSTQDLAKQFSSKHCITRPTVFVADKQTNGYGRRGRSFYSPPTTGLYLSIILPNQQQTVIQPGLLTTGIAVSITHVLEKFYPNKEFQFKWVNDIYLNYHKVGGIITESIFDLELGAASAFIVGVGINLTTVKFPKELAIKAQAIDNDNSVNRNQLIAEIIQAIINGFLDYTNPQLLAEYRKKSIVLGKVVSLNTGSEVIQGVAQKIEDNGGITIKRIDGTFQTFTSGEVIKTGFKYKGDHIG

SEQ ID NO: 11264 - protein, 219 aa, Photobacterium profundum SS9
MTQDEMKKAAGWAALEYVTKGSIVGVGTGSTVNHFIDALETRKEEIKGAVSSSVASTERLEKLGIPVFEANEVAGLDIYVDGADEINAEYDMIKGGGAALTREKIVAAISDKFICIVDDTKQVDVLGQFPLPVEVIPMARSFIGRELVKLGGDPEYREGVVTDNGNIIIDVHNMAITDAKDMEKKINALPGVVTVGLFAARGADVLLVGAPEGVRKFEK

SEQ ID NO: 11265 - protein, 224 aa, Prunus mume
MAMLKSSLAFLVLAFAFFVCFIMSTGDGSYDYFQFVQQWPPTTCRVRGKCSNPRPIQIFTIHGLWPSNYSNPTTPSNCIGSQFKESMVSPRLRSKLKRSWPNVEGSNDTRFWEGEWNKHGRCSQQTLNQYQYFERSHEMWHFHNITNILKNASIVPHPTQTWTYSDIVSTIKAVTQTTPLVRCKQHKKTQLLHEVVLCFEYKALKQIDCNRTAGCPNQQAISFQ

SEQ ID NO: 11266 - protein, 718 aa, Cryptococcus gattii
MGKGKNHDRKANPGFGKVKSKSGTSSGEFTLKRVKGENFYRDAKSAARVKMLNGGKAVRDRDGKIVEAAAFQKGEKEAEPGRVKPDRRWFGNTRVISQSALDHFRTALKEQKADPYSVLLKRNKLPMGLLQDDTKDSGGRPHIVETEPFGDTFGPKAQRKRPRLDIGSIEELGESSAAAAAAAEAATAESQANGTADLADVYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVDGGWHGEQGATVILTAIAKKSGKLLKGGEPDQEAAAKMVLNDWIRGKIPFFVAPPVKSELESQPGAPATAAEATAATTAETQAAAEQELAEERETMEMLEEQERSLGKVLGIKRVKGVEQPISKIVTMTKFIGDDARRYVEEEVVDQDKEMAEEEEEEDEEEEEEEEGEDEELAWEDVFPEEADAVDGGEEVEESDEEETDHEDVDEEEAVPSAKQLGKRKATDSDEEEQTATKSKRMTTSKQKATNFYTHANVKNRNRDRKVPKNPGKRSRGDDETTGKKAKKRR

SEQ ID NO: 11267 - protein, 226 aa, Prunus mume
MTTLKSSTALLVLAFAFFFCFIMSTTGSYVYFQFVQQWPPTTCRFSSKPSNQQRRLQIFTIHGLWPSNYSNPRMPSNCTGSQFNFTKVYPQLRSKLKKSWPDVESGNDTRFWESEWNKHGTCSEEKLNQMQYFERSHEMWNFHNITKILENASIVPSATQKWSYSDIVSAIKARTQTTPSLRCKRDKKTQLLHLHEVVLCYEYNALKQIDCNRTATCGNQQAIWFQ

SEQ ID NO: 11268 - protein, 855 aa, Clostridium thermocellum ATCC 27405
MYLFGKITVTAVIPDELSKLKDIAYNLWWSWNSEAIDLFREIDLALWEKLGKNPVRFLKEVSQKKLEAKLKDPDYMQRYKKVVNDFETYMNETDTWFSRNFPDKKDHMVAYFSAEYGLNEVLPIYSGGLGVLSGDHCKSASDLGIPFTAIGLFYKEGYFSQRINSEGWQETIFTPLNPSNLPIQPALNDKGEEVIISVELPGRVVYAKVWVVKVGRVNLYLMDTDIEQNSPYDRGLTARLYGGDQETRIQQEIFLGIGGARVLDALGIKATVYHMNEGHSAFLGLELIRKLVQNHNLPFNQAKEVVASSVIFTTHTPVPAGNDVFPLEMIDRYFGNYWPSLGINRHEFLDLGLRIGEHHNFNMTVLALTLAGQKNGVSELHGAVSRNIFKNVWPGIPEDEIPIGHITNGIHTLTWLSPSIKYLYDKYLDKDWKERLHEKEVWEKVDDIPDEELWKTHCVLKTKMIGYVREKLKEQRAANGESIERIKEVDTLLDSNALTIGFARRFATYKRANLIFRDLARIQKLLNNPEKPVQIIFAGKAHPADGPAHEIIKYINDIAKQEGFNGKVILVENYNMTLARNLVQGVDIWLNNPRRPLEASGTSGQKVAINGIINFSVLDGWWCEGYNGKNGWAIGDDTFYDNEYHQDNADSESIYNILEKQIIPTFFDRNEKGVPEKWVKIMKESIKSIAAQYSTHRMVQDYINKYYIPAMERYDKIKASNYQFAANISEWKKKVAHLWPQVQIIAEKTANQLKERNFISGESIPIYATVNLGGLEPSDVKVQAYYGSIGKNNSIENPVIVDMDVVERNSDGTYLYSANITLYEGGEYGYTFRVIPNHPDIINPFDLGLIRWIVQ

SEQ ID NO: 11269 - protein, 425 aa, Hordeum vulgare subsp. vulgare
MGNCWGTRIKDGSTHPGASGMFSRGSGKDGSRLSACSSRASSASMPPSAKTECEILQSANVKVFSYNDLRLATRNFRPDSVLGEGGFGSVYKGWIDEHTLSACKPGTGIPVAVKRLNLEGLQGHREWLAEVNYLGQFCHQNLVKLIGYCLEDEYRLLVYECMPRGSLENHLFRRGSHFQPLSWNLRMKVALGAAKGLAYLHSAEAKVIYRDFKTSNILLDTDYTAKLSDFGLAKDGPVGEKSHVSTRVMGTYGYAAPEYLSTGHLTAKSDIYSFGVVLLEMLSGRRAIDKNRPQGEHNLVEWARPYLTHKRKIFRVLDTRLEGQYSLNGAQTIAALAVECLSFEAKMRPSMEAVVSILEGIQDSSDPTRRPADPARRPAAERPQDPKSGSKTAPGASNSGKGRRKSSGDLLKEPGRDPKPSAYSS

SEQ ID NO: 11270 - protein, 332 aa, Oryza sativa
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRSLAQYRQKLDNMFQ

SEQ ID NO: 11271 - protein, 470 aa, Vibrio cholerae O1 biovar eltor str. N16961
MKKTKIVCTIGPKTESVEKLTELVNAGMNVMRLNFSHGDYVEHGTRITNFRKVMEVTGKQLAILLDTKGPEIRTIKLENGDDVDLVAGQEFTFTTDTKVVGNKERVAVTYSGFAKDLNVGNRILVDDGLIEMEVLATTDTEVKCKVLNNGALGENKGVNLPGVSVNLPALSEKDKNDLKFGCEQGVDFVAASFIRKGSDVKEIREVLASHGGQNIQIISKIENQEGLDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVKIMAQIAERTDPVLKAELGSRLDSPRLRITEAVCKGAVDTAEKLAAPLIIVATEAGKSARSVRKYFPTANIIAVTTNKKTAAQLVLSKGVTPVVVDAIDNTDAFYHLGKEIALQSGLGKKGDIVVMVSGALVASGTTNTASVHVL

SEQ ID NO: 11272 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 11273 - protein, 206 aa, Mesorhizobium loti MAFF303099
MSRTLVLVRHGQSEWNLKNLFTGWRDVDLTEQGHAEAKAAGQKLKARGLKFDIAFTSALSRAQKTCQHILDAVGQSDLKTIRDQALNERDYGDLSGLNKDDARKKWGEEQVHVWRRSYDVSPPGGESLKDTGARVWPYYLHDLQPHVLRGGTVLVAAHGNSLRALIMALDGKSGEEIVKLELGTGVPVIYQLNADSTVASKEVLEG

SEQ ID NO: 11274 - protein, 124 aa, Witheringia solanacea
NWTGPLLNCKRKYEFALIERGEKCDILDKRWPQLENRNEFGLEKQLFWKRQYDKHGACCNNKYTNEAYFNLAINLKDRYNILKILSDQGIIPGKKYVVQKVHDAIKTVTRQPPKLTCTRNSLGL

SEQ ID NO: 11275 - protein, 260 aa, Synechocystis sp. PCC 6803
MAITPTQLLDWKRQQRPIVALTAWDTAIASVLDAAGVEIILVGDSLGMVALGYETTLPVSLDTMIHHTAAVKRGVQRALVVCDLPFLTYQESPAQAMGSAGRVLQETGAQAVKLEGGHPRMVETVARLTEVGIPVMGHVGLTPQSVHQLGYRQQGQDPATAEKILHQAIALAEAGVFAIVLEHIPSELAASITEQLPIPTIGIGAGPQCDGQVLVTADLLGLTVKQPPFAPAYLNLRHTITETVHKFSGEVRQRQFPRRG

SEQ ID NO: 11276 - protein, 139 aa, Triticum aestivum
  misc_feature (136)..(136): Xaa can be any naturally occurring amino acid
  unsure (1)..(139): unsure at all Xaa locations
MMHGPAGGSGGGGGHGLGGTRVPTWRERENNRRRERRRRAIAAKIYTGLRAYGNYNLPKHCDNNEVLKALCNEAGWVVEPDGTTYRRGCKPPPQARPDPMRSASASPCSSYQPSPRASYNPSPASSSFPSSGSSSXITL

SEQ ID NO: 11277 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 11278 - protein, 485 aa, Novosphingobium aromaticivorans DSM 12444
MALQLNDPSLLRQAALIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFHIGGLKI

SEQ ID NO: 11279 - protein, 108 aa, Triticum aestivum
  misc_feature (92)..(92): Xaa can be any naturally occurring amino acid
  misc_feature (104)..(104): Xaa can be any naturally occurring amino acid
  unsure (1)..(108): unsure at all Xaa locations
MPKKSKKSKSKRVTLKAKHKVLRKVKEHHRKKRKEAKKEGRSGKSKVEKDPGIPNEWPFKEQELKNLEVRRAMAIKEQEDKKEARRERARKXKLGLPDDEDMAXDNDA

SEQ ID NO: 11280 - protein, 446 aa, Haloquadratum walsbyi
MTDEESRALYDRALSVMPGGVNSSVRATQPYPFFIERGDGATVIDADGTRYLDYVMGYGPLLYGHDLPEPVNAAIQSYTSEGPMYGAPTPIEVEHAEFVARHVPSVEMIRFVNSGTEATVSAVRLARGYTGRDKIVVMKGGYHGAQESTLVEGDPMHVEPSTPGIPSSFAKHTLPVPFNDLEAITTVFETHGEDIAAVLTEPILANNGIVRPVDGYLEHLRSLTTEHNSLLIFDEVITGFRVGGLGCAQSKFGVTPDVTTFGKIIGGGFPVGAIGGRADIIEHFTPSGDVFQSGTFSGHPVTMAAGYESLKYAAENDVYDHVNRLGERLRGGITDIATDQSPSAIVVGLDSMFKTVFEREGSTTDDGDVCSAGCEQRESCMRYDDCPKTGADVSSAETERWERIFWQEMRDHNIFLTANQFESQFVSYAHTDEDIDRTLEAYKSAL

SEQ ID NO: 11281 - protein, 435 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 11282 - protein, 266 aa, Pseudomonas syringae pv. tomato str. DC3000
MPNITVTSLLAMKHKGEKITMLTCYDATFAHTACQAGVEVLLIGDSLGMVLQGHDSTLPVTTAETAYHVACVKRGNQGALILADLPFMANATLEQTFINSTTLMQAGAHMIKVEGAAWLGESIRLLAERGIPVCAHMGLTPQSVNVLGGYKVQGRLEAQARQMRADAIALEQAGAAMILLECVPSELAEEITHAVKIPVIGIGAGSATDGQVLVLHDMLGLSITGRVPKFVKNFMIGQPDIQSAIQAYVSAVKDVSFPAIEHGFSA

SEQ ID NO: 11283 - protein, 392 aa, Prochlorococcus marinus str. NATL2A
MTDKSQISIRALSIKPSLTLEISAKAKALKAEGKNICSLSAGEPDFDTPEFIVDATLKALKDGKTRYGPAAGDPELREAIAQKQSDINKVPTKTDNVLVTNGGKQAIYNLFQVVLNPGDEVLIPTPYWLSYPEITLLAGAKPIKIKSSTKDKFKIDINSLEEHVTEKTRLLIINSPSNPTGCVLTEQEMKTISDFLRRHPRILLMSDEIYEFLISPNQVHHSFAKIAPDLKNRIFTVNGFAKAWAMTGWRIGYLTGNAEVIKKAIALQSQSTSNVCSFAQKGAIAALQGSKDCVHEMANIYNKRRLLITERLKKIKHISFVPPNGAFYVFPEINLEEIDSISFCKLALEKVGLAIVPGIAFGDDKCIRISYAASNKMIEDGVNRLERLLNDF

SEQ ID NO: 11284 - protein, 274 aa, Listeria monocytogenes str. 1/2a F6854
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 11285 - protein, 477 aa, Myxococcus xanthus DK 1622
MRRAKIVCTLGPASQSQEMLEALLENGMDVARLNFSHGSHEQHAENIAKLRAASLKVRKAVGILGDLQGPKIRTGRFVKGSTELKEGGTFHITTDETVPGTDEIVSTTYPFLAADVNPGDRILLDDGLLELKVLETDKQKLIRTQVIHGGTLKNNKGINLPGVAVRAEALTPKDREDLVFGIKAGVDYIALSFVRQPSDLDTARQAMAEVGRTVPIIAKLEKPEAIARLDAILDKTDGVMVARGDLGVEIPPEEVPAVQKDIIRRSNLRGLPVIVATQMLNSMIDNPRPTRAEASDVANAVFDGADAVMLSGETASGKFPIESVQMMERIILAAESSARTTQSLMRVLETPVGLPNHFPDVIARVACEAAKASNASLIAAFTLSGVTARLLSHYRPPVPIVAFSPNQEVRRRLSLLWGVVPRVLEPTQDTEAMVKRVEEELLARGLGRKGDRIVIVFGAPVGQPGKINSLRLHTIQG

SEQ ID NO: 11286 - protein, 386 aa, Synechococcus sp. WH 7805
MRVSSAASNTYNERVFTLVVVGLQASKQRRSEQTFKVSYDQLQSTVQRINSCGGRILSVTAGSSRTTAHTSVSTASATSTVTETPSKPAHKAVPVNLYKPKSPFIGTVTENYSLLKEGAIGRVQHITFDLSGGDPHLAYVEGQSIGIIPEGEDAKGKPHKLRLYSIASTRHGDNLADNTVSLCVRQLEYKNDAGEEIKGVCSTYLCDIEPGTKVKITGPVGKEMLLPDDEEANVIMLATGTGIAPMRTYLRRMFEPSEREKNGWTFRGKAWLFMGAPKTPNLLYDEDFEHYEREYPDNFRYTKAISREQQNSKGGRMYIQDRVLEYADEIFAMIENPKTHVYMCGLRGMEPGIDEAMSAAAAAKGLDWSELRPQLKKAERWHVETY

SEQ ID NO: 11287 - protein, 217 aa, Triticum aestivum
MLKKLISKTKSKKKKEAASSSLPTLDRLHETLEMLEKKERLLQKKSSAEIEKAKDYTKAKNKNAAIQCLKKKKLYETQIEQLSNFQLRVHDQIIMLENAKATTDTVDALRSGSSAVKAIQQSLSIDDIENAIEEANEHTENMKQIQDALATPFGASAEFDEDELEAELEDLEEEELDLELPEPPRGTHVAPSTSAATSRPAASDFAELTKLQAEMAL

SEQ ID NO: 11288 - protein, 1114 aa, Azoarcus sp. EbN1
MDLLPAMAAPDKETDDGLWYKDAVVYELHVKAFFDANDDGVGDFNGLTRKLDYIRDLGVNTIWLLPFYPSPLKDDGYDVADYHGVLPAYGTRADFRQFVREAHRRGLRVITELVVNHTSDQHAWFQAARRAPAGSSKRNYYVWSDDPTRYSGTRIIFTDTETSNWAWDPVAKSYYWHRFFSHQPDLNFENPNVLKAVLRTMRFWLDMGVDGFRLDAIPYLREREGTNNENLPETHDVIREIRKCIDAHYRGRVLLAEANQWPEDVREYFGDGDECHMAYHFPLMPRLFMAVAQEDRFPVVDIMRQTPDIPENCQWAIFLRNHDELTLEMVTDRERDYMWQFFANDPRMRINVGIRRRLAPLLENSRDRVELMSFLLLTMPGSPILYYGDELGMGDNVFLGDRDGVRTPMQWTPDRNAGFSRADPQQLYLPPIMDPIYGFQAINVEAQARNPHSLLNFTRRLIAMRNSSRAFGRGMLRFLEPGNRKVLAYLREYRDQSVLCVANLARTPQAVELDLARFEGRVPVEIVGRVPFPPVGKLPYLLTLAGHGFFAFELSADAPPPNWHEERLPQTELPILVLTEGWRTFFRGHQGGSAVRRAIATRSRDQLQNEVLLPYLQARRWFAAKGETVTRIEVVEEQEWAAGGGNWLLALLEVSLASGSSHLYFLPLGIAWETAGDNPVDRFGAAALARVREKARIGILYDAFIDPVYCRALGQSMGGGGPQPLGGGSLRFTASEHYARFAEALGDEVRQPLQEQTNTGVFFGSRLYLKGYRRLQFGTNPEIEVGYFLGSAPEFSRVAAVAGSVEYIAPDGRVAALAMLQEFVDNQGNAWDYTLNHLDRLFSPDTWPAAAADEPEAEGMDRVYLLLAQTLGRRIGEMHAAFAHGTDPAFVPEPLGDAEVEAWRAQVIGDVERTLSLLEAALPRLDERARDEARQVLAAHHLLVARLAGLDLASPGLVKTRLHGDLHLGQVLIVQNDFVIVDFEGEPARSIDERRCRHSPLRDVAGMLRSFDYAVRTVGYHHLQARPEHAEALARALPEWKEGVVRSFMQAYGEVVAPLPSVPPDAAVAADFVTLFVIEKLLYELRYELDNRPEWVRIPLSALAEIAASPQGSH

SEQ ID NO: 11289 - protein, 85 aa, Triticum aestivum
  misc_feature (23)..(23): Xaa can be any naturally occurring amino acid
  misc_feature (31)..(31): Xaa can be any naturally occurring amino acid
  misc_feature (37)..(37): Xaa can be any naturally occurring amino acid
  misc_feature (61)..(61): Xaa can be any naturally occurring amino acid
  unsure (1)..(85): unsure at all Xaa locations
GFFLWFSPFSVEFLYALIASPSXNFKLFSGXSGLEFXRERGAGFFYQPWVEEAVFKYFNCXPPGGNNGPGFGGFLGKKFCCSLWG

SEQ ID NO: 11290 - protein, 405 aa, Bacillus licheniformis ATCC 14580
MKGGCASMFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 11291 - protein, 334 aa, Synechococcus sp. WH 7805
MAIRIGINGFGRIGRLAFRQAMTCPDVEVVGINDLIEVDYLAYLLRYDSTHRQFQGDIRVEDGALVVNDQPIRITAERDPSQLRWGEIGADYVLESTGFFLTAPLAQAHLDAGARRVVMSAPSKDDTPMFVMGVNHTSYAGQAIVSNASCTTNCLAPLAKVVHDNFGIVSGLMTTVHATTATQKPVDSPSLKDWRGGRGAGQSIIPSSTGAAKAVGRVIPELNGKLTGMAFRVPTPDVSVVDLTVNLDRPTSYENLKQTIKQASQNGLSGILGYTEDPIVSNDLLGESCTSVFDAGAGMALNDRFMKLVAWYDNEWAYSCKCIDLMRHMATHQS

SEQ ID NO: 11292 - protein, 255 aa, Humulus lupulus
MASAGPATALRTISSSSPKLHNTRSPFSSSLSPPKSSLSFTKVLSPALISTPKLQITSNPSSKTYITCRSQASPSESEKPIKVHELRVYEINERDRSSPAYLRLSQKEVNSLGDLVPFSNKLYTGCLQKRIGITAGICTLIQNKAEKKGDRYEAIYSFYFGDYGHLSVQGSYMTYEDTYLVVTGGSGIFEGAYGQVKLQQLIFPFKLFYTFYLKGIKEDLPEELLGVHVEPSPSVEPSPAAKACEAHAVIQSFTD

SEQ ID NO: 11293 - protein, 390 aa, Clostridium thermocellum ATCC 27405
MNIAEMVLPTVRQVPPSGIRKFFDLVNEMKDAISLSIGEPDFVTPWNIREAGIYSLEKGHTHYSPNAGFMELREEICKYQERKYNLKYDPKTQVIVTVGGSEGIDIALRALVGPGDEVIIPEPCFVAYKPCTIFTGATPVIVNLSAENEFRLTPELLEKAITDRTKVLILPYPNNPTGAVMEKKDLEAIVEVLKDKDIIVISDEIYSELTYGVKHVSIASFPEMKDKTVVINGFSKAYAMTGWRLGYCLGHPDLISQMYKIHQYAIMCSPTTAQYAAIEALRNSDDDVEAMVREYNRRRRIMVEGFRSAGLECFEPLGAFYVFPCIESTGMTSYEFSERLLMEEKVAVVPGTAFGECGEGYVRSCYASSMDNIIEAMKRIKRFVERNRKK

SEQ ID NO: 11294 - protein, 300 aa, Triticum aestivum
  misc_feature (106)..(106): Xaa can be any naturally occurring amino acid
  misc_feature (114)..(114): Xaa can be any naturally occurring amino acid
  misc_feature (152)..(152): Xaa can be any naturally occurring amino acid
  unsure (1)..(300): unsure at all Xaa locations
QFCCRNTTSDLLSASRRRHGAQTNKVFVYFCSQGCRPAERMDGIGCSVSPSPCSSYQPSPRASYNASPTSSSFPSGASSPFLPHSNNMVNGVDATPILPWLQTFSXSTASNKRXHLPPLLIHGGSISAPVTPPLSSPTARTPRMKTDWDESXIQPPWHGSNSPCVVTSTPPSPGRQMVPDPAWLAGIQISSTSPSSPTFSLMSSNPFSVFKEAIPGGGSSRMCTPGQSGTCSPVIPGMARHPDVHMMDVVSDEFAFGSSTNGGAQQATAGLVRAWEGERIHEDSGSDELELTLGSSRTRS

SEQ ID NO: 11295 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 11296 - protein, 333 aa, Synechocystis sp. PCC 6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 11297 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 11298 - protein, 390 aa, Pseudomonas syringae pv. tomato str. DC3000
MTQPYSARSRAIEPFHVMALLARANELQAAGHDVIHLEIGEPDFITAEPIIKAGQAALADGKTRYTAARGLPQLREAIAGFYAQRYQLDIDPQRILVTPGGSGALLLASSLLVDPGKHWLLADPGYPCNRHFLRLIEGEAQLVPVGPQERYQLTPELVASHWNPNSVGALVASPANPTGTLLTRDELAALSSALKARNGHLVVDEIYHGLTYGVDASSVLEVDNEAFVLNSFSKYFGMTGWRLGWLVAPPEAVADLEKLAQNLYISAPSMAQYAALACFEPQTLAILEQRRAEFGRRRDFLLPALRELGFGIAVEPEGAFYLYADISAFGGDAFAFCKHFLETEHVAFTPGLDFGRFQAGHHVRFAYTQSLPRLEQAVERIARGLRSWSA

SEQ ID NO: 11299 - protein, 530 aa, Corynebacterium glutamicum ATCC 13032
MSQNGRPVVLIADKLAQSTVDALGDAVEVRWVDGPNRPELLDAVKEADALLVRSATTVDAEVIAAAPNLKIVGRAGVGLDNVDIPAATEAGVMVANAPTSNIHSACEHAISLLLSTARQIPAADATLREGEWKRSSFNGVEIFGKTVGIVGFGHIGQLFAQRLAAFETTIVAYDPYANPARAAQLNVELVELDELMSRSDFVTIHLPKTKETAGMFDAQLLAKSKKGQIIINAARGGLVDEQALADAIESGHIRGAGFDVYSTEPCTDSPLFKLPQVVVTPHLGASTEEAQDRAGTDVADSVLKALAGEFVADAVNVSGGRVGEEVAVWMDLARKLGLLAGKLVDAAPVSIEVEARGELSSEQVDALGLSAVRGLFSGIIEESVTFVNAPRIAEERGLDISVKTNSESVTHRSVLQVKVITGSGASATVVGALTGLERVEKITRINGRGLDLRAEGLNLFLQYTDAPGALGTVGTKLGAAGINIEAAALTQAEKGDGAVLILRVESAVSEELEAEINAELGATSFQVDLD

SEQ ID NO: 11300 - protein, 276 aa, Triticum aestivum
  misc_feature (99)..(99): Xaa can be any naturally occurring amino acid
  misc_feature (102)..(102): Xaa can be any naturally occurring amino acid
  misc_feature (115)..(115): Xaa can be any naturally occurring amino acid
  unsure (1)..(276): unsure at all Xaa locations
MGVPDGVAAPPRTLRFQPRAFVAAALCSWGGEARIPRWGFAKGPPRLNHKPRTRVFVPSVNTAPKKGEEVLFQNSPLRGKECQVFMDLEKGIESGADLXSDXPLEHPLFHPKENXGILGWVRRGQMVPEFEEAAFSAPLNKVVRCKTKFGWHLVQVLSERDQCLLQDIQPEELHEKMQDPSFMEEAQLIDVREPDEVERASLPGFKVLPLRQFGTWGPVMTDEFNPQKDTYVLCHHGMRSMQVAKWLQSQGFQKIYNVAGGIHAYSVKADSSIPTY

SEQ ID NO: 11301 - protein, 454 aa, Haloferax volcanii
MTEDNALTDGGLSDEAQAVIDEIEEKNVDFLRLQFTDILGTVKNVSIPASQAEKAFTEGIYFDGSSIDGFVRIQESDMRLEPDPSTFAVLPWRKKENSAAGRLICDVFNTSTGEPFSGDPRGVLKRAIEPEELGYDVNVAPEPEFFLFEEDEDGRATTVTNDAGGYFDLAPKDLASDVRRDIIYGLESMGFDIEASHHEVAEGQHEINFTYDDALSTADNVRTFRSVVRAIAAEHDLHATFMPKPIPRINGSGMHTHISLFKDGENAFHDGDDEFDLSDTAKSFVAGILDHAPAITASLTRRSTPTRRLVPGYEAPVYIAWSDRNRSALIRKPAARTPAASRIEARFPDPSCNPYLAFAALIHAGLDGVEKGLDCPDPVRENIYEFDEAKREEYGIETLPKTSAARRRPRRDEVIQEALGDHVFEKFVEAKRSEFKDYLVDVSQWELDRYLETF

SEQ ID NO: 11302 - protein, 317 aa, Xylella fastidiosa Ann-1
MDERVLLTCLGCNYVSGNVLASMTGMTEATIAACIQALRAVGIPIKSRAEQGYALAAPLSLLTAERIRAELSHSIAAELRVLDVAWTLESTNTSLLARPALADGVEVLLAERQRGGRGQRGRSWISPLAANIYLSLSRVFSSGAAQVMGLSVAVGVAIAEALIAAGFSHVRLKWPNDLVDNGRKLGGVLVERQGVARAVIGLGLNVRMPTNFAEQIDQPWVDLETLAGSTVERNALVALLLSALLPALHLFQLEGLAPFLPRYAKLDCLVGYAVWIEEANLKYVGIARGLAADGALLVEINGVLRPFHTGQVSVRPI

SEQ ID NO: 11303 - protein, 227 aa, Streptococcus pneumoniae TIGR4
MENLKKMAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 11304 - protein, 145 aa, Arabidopsis thaliana
  misc_feature (130)..(130): Xaa can be any naturally occurring amino acid
  unsure (1)..(145): unsure at all Xaa locations
VSRKDNKDITSIASNGGRVNCMKVWPPIGKKKFETLSYLPDLSYVELDKESEYLIRNKWIPCVEFELEPGFVYREHGNTPGSYDGRYWTMWKIPLFGCPDSAQVLKEVEECKKEYPGAFIRIIGFDNTRXVQCIRFIADKPPSFT

SEQ ID NO: 11305 - protein, 262 aa, Ehrlichia ruminantium str. Gardel
MKITILGSGSSSGVPIIGCDCSACKSHLQYNKRTRASALFENNGTKLLVDTTPDLRIQALQHNLSSVDGILYTHFHSDHCDGISDLQPFVPTNELNTVHIYSDVMTLCSLVASNSYFFIRGIVSKWKKCHYLTPNIMYYYQEYNIGNFRILMIKQDHGVADCNGFIFNNQVAYCTDVKSFPKKSFDLLYKIKVLILGCLKYEESFAHSSVNTCLEWVAELKPETTIFTHMSHDLEYYSLIDYIKSRIDANVIVGYDGLQFVI

SEQ ID NO: 11306 - protein, 472 aa, Vibrio vulnificus CMCP6
MTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 11307 - protein, 389 aa, Streptococcus pneumoniae R6
MDLTKRFNKQLDKIQVSLIRQFDQVISEIPGVLRLTLGEPDFTTPDHVKEAAKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 11308 - protein, 256 aa, Streptococcus mutans UA159
MKIGFIGVGKMASAIITGLKKTDFELIISDSSLKAGQDKAEALGVAVAQSHQELVDEVDLLVLGVKPQVLASVLNPLILTKPILSMAAGTSLEYLDKLSQADLPIIRIMPNLNAKILQSSTAICRNDKVSDQLFAIAKQITDSFGTTFEIAEKDFDTFTALAGSSPAYIALFIEAMSKAGLKHGFPKDLAFKIVSQTVLATTSNLIQGQEKPNDLIDKVSSPGGTTIAGLLDLEKTGFTASTISAIDATIDKSKNM

SEQ ID NO: 11309 - protein, 272 aa, Photobacterium profundum SS9
MEQRSITFIGAGNMARSIIAGLVASGYPANKITATAPSEARREPLARDYGIHTDADNLRAAQQADVIVLAVKPQLMESVCSALQDIDFSNKLVISIAAGISASRLNEMLNTELNLVRVMPNTPSLIGKGMSGLFASQSVSENDKVYAEQLMQAVGEACWVQQESGINGVIAAAGSAPAYFFLFMEAMQKEAIKQGFDADTARLLVQQSALGAAELVKANPETELSTLREQVTSKGGTTAEAIRTFNEHQLSDIVAKAMRAAVSRAEEMEKLF

SEQ ID NO: 11310 - protein, 618 aa, Gibberella zeae PH-1
MGTGKKEASRRERQGKGGDGLNNVKTKGENFYRDAKRVRQLNILKEGKAQRNADGEITKAASFQSRDIPNARIEPNRKWFTNTRVISQDSLNAFREAMDEQARDPYQVLLKTNKLPLSLISDGKNVNTENGIKQHKAKMTVETSPFAEVFGPKAQRKRVKLGVSSLDDIIGDTEKSMDTYRDRLEQQKLLSGASGDAEDLDDAGKPLTMAIEPVFDKGQSKRIWNELYKVIDSSDVIIHVLDARDPIGTRCLSVEKYLKEEASHKHLIYLLNKVDLVPTSVAAAWVRTLSKEHPTLAFHASINNSFGKGSLIQLLRQFSSLHSDRKQISVGLIGGPNTGKSSIINTLMKKKVCTVAPIPGETKVWQYISLMKRIYLIDCPGIVPPSTTDTPTDLVLRGVVRVEKVEHPEQYIQSLLNRVKKHHMEKTYELKGWDNSTEFLELLARKAGRLLRGGEPDLDGVAKMVLNDFMRGKIPWFTPPPKSEGEADTKVGNREGRLGEMPRKRKQEEAVDDEDASAEAQLQREAEAALEKAGGESAGEESDFEGFGSDTEEARSRKPSFGATIDGESEVESAEDDVISVGGSEEVEEEEEQKAPASAAKSKGKKNKGGPPSKKRRA

SEQ ID NO: 11311 - protein, 302 aa, Gonyaulax polyedra
MEALDLDRIIVQLLEVRGCRPGKLVQLTEGEICALCIRSRDIFMDQPILLELECPLKVCGDVHGQYSDLLRLFECGGLPPEANYLFLGDYVDRGKQSLETICLLLAYKVKYPENFFLLRGNHECASINRIYGFYDECKRRYSIRLWKTFTDCFNCLPVSAVIDDKILCMHGGLSPELSNLEQIKRVVRPTDVPDTGLLCDLLWSDPEKEISGWGENDRGVSFTFGPDVVQRFLRQHGLDLVCRAHQVVEDGYEFFARRALVTIFSAPNYCGEFDNAGAIMTVDESFCCAFQILRPLTRMGVP

SEQ ID NO: 11312 - protein, 448 aa, Archaeoglobus fulgidus DSM 4304
MKTLILAGGKGTRLWPLSRELMPKQFIKLFSESLFQKTVKRALYLSSPDEIYVITNKEYRFRVLDDLEEIGISIPEENIILEPEAKNTLPAICLGVKAAGEGKFAVLPSDHLIKADEEYLNAFRSAEKLSENYIVTFGITPTRPHTGYGYIKPGKELEGGFEVEQFKEKPSRELAEEYVSKGYLWNSGMFVFDSKVFVEELKELAPEFAKVLEEGEEAYKQIPEASFDYAILEKSGRVAVVPIKTFWSDLGNFDSIYEVMEKDERGNAIKSESCIPVDSENNLVITQRLTALIGLRDLIVIDTDDALLVARRGEAEKVREVYRLLAEKGDKAVEVHRTAHRPWGSYTVLEENKSYKIKRITVKPKKRLSLQRHYHRSEHWVVVKGTARIVVDGNEILLRSGESTFVPAGAIHRIENPGKIPLEIIEIQIGEYLEEDDIERFEDDFGRR

SEQ ID NO: 11313 - protein, 273 aa, Arabidopsis thaliana
  misc_feature (147)..(147): Xaa can be any naturally occurring amino acid
  misc_feature (246)..(246): Xaa can be any naturally occurring amino acid
  unsure (1)..(273): unsure at all Xaa locations
RSFNNSVADQHAVQETVARVKPSINETTTKEEKSFFNLDNENGVEDTPRLIDTKDNVFRMSNPKSKYPVLQLDLKLISDLVIIIVAATCGGIAFACAGQPVITGYLLAGSIIGPGGLSFVSEMVQVETVAQFGVIFLLFALGLEFSXSELRVVRAVAIPGGLLQIFLFMCLSGITASLCGGKLTEGIFVGAFLSMSSTAVVLKFLMDRYSISALHGHITVGTLILQDCAVGLLYALLSVLGGTSGXFQGVLSMAKSLAILIAVLGASDALSRT

SEQ ID NO: 11314 - protein, 371 aa, Xanthobacter autotrophicus Py2
MTTRRTGRAEKTLRETTAMPTADHRAAPGITLACALEEWAGEDARRRDVAATLNALAAGTIQIARAIAEGPLAGDLARTLSSGEAGEGQKALDIISNDMVIDALRKAPVAAVASEENDAPVLLDPEAPLLVAIDPLDGSSNIDTDISVGTIFAVFPHQDGTDAASVTAFLQNGRDMLAGGYVIYGPHTALMLTVGAGTWHFALDRDGSFRLVNAAVRVKEDAAEFAINMSNYHHWDDPIRAYVDDCLAGRKGPREREFNMRWVASMVADAHRIFQRGGIYLYPGDGRKGYTHGRLRLLYEAFPVAFLMEQAQGSAIDGRSSILDLSATGVHQRVPFIFGSRDEVARAARYHLEPSGHGERSPLFARRGLFI

SEQ ID NO: 11315 - protein, 370 aa, Methanosarcina acetivorans C2A
MKEISFSENVSRIDTSGIRKIFEAAGSNAINLGLGQPDFDTPVHIKTAAIEAINEGFTGYTVGPGIPELREALSQKFLEENGFSVSPQEIIVTSGASEALTIALAALLNVGDEVLISNPGFVSYNALTEILNGKVVSVPLAEDLTMKPDAVLERITPKTKALILNSPSNPTGAVSSRADIKALAEIADDHNITIISDEVYEYFIYEGEHVSPASYSDNVVTINATSKSYSMTGWRLGYLAARKEYIAQMNKVHQYIQACANSIAQKAAYAAVTGPKDSVNAMREEFRKRRDLLVKGLNELGMECAFPKGAFYAFPKVENSAEVASKMISNGVVVVPGTAFGSEGDGYIRISYAASMKDIEKSLAIMEKVL

SEQ ID NO: 11316 - protein, 429 aa, Oryza sativa
MERKQAEYSNLDERYAIQGEKYQGQQYSHIYFTRLHHMRNLLHALVPSWKPHLPVTTVLGLEEGKDCIIVGTLYKHMKLKPSILDEYSKERSAIPLVKPHNFMHPDDHLILEDESGRVTLAGAIPPAAYVTGVVIALHGKETSAGNFLVEDILEAGIPPQITLPSINEDKYVVFVSGLSIGSEKFNPLQFQLLIDHITGHLGDENEQSIASNIVRVVVAGNSVHISPRFFNGQAVASKDQSRIAEPIKELDIMLTQLVASLPVDMMPGSNDPANFSLPQQPLHRCLFAGAATYNTFSSCSNPHQFELDSVRFIGTSGQNIDDLYKYSDAKDKLEFVERTLRWRHLAPTAPNSLGCYPYTDKDPFLVESCPHVYFVGNQDKYETQLLQGLEKQKVRLICIPRFCDSGVAVMLNLRNLECSTLSFSTSFDA

SEQ ID NO: 11317 - protein, 283 aa, Listeria monocytogenes
MKTVKLNNGVEVPILGFGTYQITDAAEAEHAVKDAIKAGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDIFNNPVLTKIGAKYGKSAAQVILRWLVEQDIIVLAKSVKPERMAQNLAIFDFELTEADKEEIAGLDQGESQFFSHADPEMVKWMASRKLNV

SEQ ID NO: 11318 - protein, 268 aa, Brassica napus
  misc_feature (193)..(193): Xaa can be any naturally occurring amino acid
  unsure (1)..(268): unsure at all Xaa locations
MASDGGVSCLRRSEMMSVGIGGIDSPPLDVDEVHVLAVDDSLVDRIVIERLLRITSCKVTAVDSGWRALEFLGIDNEKASAELDRLKVDLIITDYCMPGMTGYELLKKIKESSSFRQVPVVIMSSENVITRIDRCLEEGAEDFLLKPVKLADVKRLRNYLTRDVQVSNGNRRKLPEDSPPLTLWHDFVGLFSXPPSTLSPDSWDSSCPPLSPVEIFSSPLLSPLDDEDDDVLTSSPESTPSPVRRQKMRSPDIRLVTFSGGPCNIYPR

SEQ ID NO: 11319 - protein, 485 aa, Oceanobacillus iheyensis HTE831
MSNKNFPLIFERSKEGRTSYSLPELDVESFDLEAELGSEYVRQTPPELPEVSELDIIRHYTGLSNRNYGVDSGFYPLGSCTMKYNPKINEDIARLDGFSHIHPYQDVSTVQGAMAMMFDLQESLKEITGMHEVSLQSAAGAQGEWTALMMIRAFHESRGDYGRTKVIVPDSAHGTNPASAAVAGFEAVTVKSNQEGLVDLDDLRQVVGEDTAALMLTNPNTLGLFEKDILTMAEIVHEAGGKLYYDGANLNAIMGYVRPGDMGFDAVHLNLHKTFTGPHGGGGPGSGPVGVSEELAAFLPKPLIVKKNDGYDFDENRPQSIGRVKPFYGNFGINLRAYTYIRTMGAEGLKKVSEYAVLNANYMMRQLEDVFELPYPQHCKHEFVLSGSKQKKLGVRTLDMAKRLLDFGYHPPTIYFPLNVEEGLMVEPTETESKETLDGFIDTMRTIAKEVEENPEIVQEAPHQTIVKRMDETRAARKPVLRYHP

SEQ ID NO: 11320 - protein, 254 aa, Arabidopsis thaliana
MASSTMSLQSISMTTLNNLSYSKQFHRSSLLGFSKSFQNFGISSNGPGSSSLTSFTPKKKLTPTRALSQNLGNTENPRPSKVQELSVYEINDLDRHSPKILKNAFSFRFGLGDLVPFTNKLYTGDLKKRVGITAGLCVVIEHVPEKNGDRFEATYSFYFGDYGHLSVQGPYLTYEDSFLAITGGAGIFEGAYGQVKLQQLVYPTKLFYTFYLKGLANDLPLELIGTPVPPSKDVEPAPEAKALKPSGVVSNFTN

SEQ ID NO: 11321 - protein, 476 aa, Synechocystis sp.
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGPNGNSSYYFADSVEGRWNTGREEEGGNLGYKPGYKEGYFPVAPTDTAQDIRTEMLLTMAGLCVPIEKHHHEVASGGQNELGIKFDKFDKLVNSADNLIIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKANRLEFRCPDATSNPYLAFAAIVCAGIDGIKNQIDPGEPLDVDIYDLSPEELAKIPSTPGSLEAALEALEKDHQFLTGTGVFSPDFVESWIEYKLDNEVNPMRLRPHPYEFSLYYDC

SEQ ID NO: 11322 - protein, 449 aa, Oceanobacillus iheyensis HTE831
MEFRYLPMTNQDKQEMLDAIGIKSTEELFSDIPEHVRFKGEMNLKAPISEYELTKELTELASRNIHTKEYTSFLGAGVYDHYIPSVVDHVISRSEFYTAYTPYQPEISQGELQAIFEFQTMISELTGLPVANSSMYDGGTALAEAVNLSAAHTKRKKVLVSKAVHPEYRAVIDSYTRGQSIDIVEIDTVNGVTDLAQLDQAIDETIAGVVVQYPNFFGQLEPMKKIEQLLENHQKTMLIVSSNPLALGYLTPPGEFGADIVTGDTQVFGIPAQFGGPHCGYFATSKKLMRKVPGRLVGETVDEEGTRGYVLTLQAREQHIRRDKATSNICSNQALNALASSVAMSSIGKHGLRKLASVNMQKARYARKKLLEAGVELAFDGSFFNEFVIKVPGSVSKINKQLLDKGIIAGYDLAKDDKSLEGYMLIAVTEVRTKQEIDQFVKELGDIHV

SEQ ID NO: 11323 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 11324 - protein, 417 aa, Myxococcus xanthus DK 1622
MSPPQFPPSPTRAISSDGPFRALLLENIHPSAGEMLAAEGFQVERVSSALKPDELAERLKGVHLLGIRSKTTVPLAALEHAENLLAIGAFCIGTNQVDLTSANTHGIPVFNAPFSNTRSVAEMVIAEVIVLTRQLFERSQEVHAGQWRKVATGSHEVRGKTLGIIGYGHIGSQLGVIAEALGMRVLYFDVMTKLPLGNAQPAVTLEELLGASDFVTLHVPALPTTHMMMGAEQIAQMKKGACLINASRGTVVDIDALARALQSQHLGGAAVDVYPEEPESNSDGFVTALQGLPNVVLTPHIGGSTEEAQASIGKEVATSLLKYFKAGASTGAVNFPNIEAPLIPGTHRILNVHRNIPGVLRDINRIVSDLNANIHAQVLSTDANIGYLLMDLDQDVSTPVCEAIAGLETDIKTRILS

SEQ ID NO: 11325 - protein, 294 aa, Mycobacterium sp. JLS
MSGSTPRYGIVVGVDGSPESQVALRWAATEAQTSGRPVTLINVVTPIAISWPTIMLQEQISTYEKQNAEEVLGHARQTLLDGLGPGPQPAVHSEVLMAGIVEALVEASKDAHMVVVGARGRGAVRRVLLGSVSAGLIHHAHCPVAVIHSRDGRLPTADAPVVVGIDGSPASEAATALAFEEASRRGAELVAVHVWSDMAPIPGAATDRHQCEQRAEETLAERLAGWQERYPDVRTRRVVESDRPARWLVEHSADAQLVVLGSHGRGGFAGMLLGSVSAAVAQSVDVPVIVVRPR

SEQ ID NO: 11326 - protein, 636 aa, Ashbya gossypii ATCC 10895
MFSRYWKDPSRESKVLLESGNHVLLYNDQRGISQGEVFRYIIKVDKAQLDAKTKIEELVLRIKNVESPLLRPIYLTGPYSVYAEVRPYNYDENTAFQGDDLQFISDLKPDEAFSATLKLNGDSQVLESTVYSWTADVLSQMTWMVDHPILVRLSIGNTRSIGKAAMKTPARAVEPVSGFTVEIQDTMTVWNEPPLFPERPVHLVIVTHGIFSNIGCDMLYLRDRLKKCAHAVEENCNQNVVVRGYHGNIGKSHKGIEYLAMRVADYVLKTIAQMPNEYFLDRISFIGHSLGGLVQTFAIQYMLERDPGIFSPQAGGLRPMNFIALASPFLGVIGDFPLYATVALNFGALGRTGKDLNLKNDFAISELVRNPKQAYNRRPVLESIVSGSMKSVLQAFSNRTLYANALHDGIVPLRTSALLYLDWYSLQEVNLIGAQEGAETFDLGEEDHALKRYDTVEIPPDLSEKKDTIRWLLPRALIKRRHKWYKRSQTVKPGIEQLWDEDSDYHPLTKASALSSAANILVAPPPTQDYYKDPQSRTDYIFHDKRYSPEELPPAYYRNRELLKKILYPNDKVHRTQEKIARGYQESMSWRKVLVNIQPESHNNIIVRRRFVNSFGWIVIEHLVNEHFGRRASRSD

SEQ ID NO: 11327 - protein, 281 aa, Oceanicola granulosus HTCC2516
MAGIDDLPPLREVIATHGLSAKKALGQNFLLDLNLTAKIARAAGDLTAADVLEIGPGPGGLTRGLLASGARHVVAIEKDPRCLPALAEIAAAYPGRLTVLEGDALATDATVHLTPPYRIAANLPYNVGTELLVRWLTPPSWPPAWESLTLMFQKEVAQRIVARPGSKAYGRLALLAQWRADAQIVMSLPPGAFTPPPKVSSAVVRLDALPQPRYPADAATLSRITATAFNQRRKMLRASLKGLAPDIERHLEAVGIAPTDRAEQIDLERFCALARRLAPER

SEQ ID NO: 11328 - protein, 693 aa, Oryza sativa
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPDMATATCRSCLGGIVGMMPKYFSGKQGGRVLGLRCNYRYEIYPFFDGVSLLQLPAASLGAPPAPSPAAVNVTPPATTTGTRRRVDITRKCTVILIKISFNMTFDMIWNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 11329 - protein, 149 aa, Nicotiana tabacum
MLAVFEQSIGRPPPELSLPQAGIQKKEAKTREEIAESFKTWKQDSTFYHLFNGNFMAFSHGNENPLQPRSIVVMDDVFCIFSGALDNTFDLRKHYGLSRQATEAMIMVEAYKVLRDRAPYPPDQVIKELEGKFAFILFDSKASTLFLAR

SEQ ID NO: 11330 - protein, 316 aa, Zea mays
MMTSWLLGRRGPSGFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLDTMKRTSHESNLEGRIVNVSSEGHRLAYREGIRFDKINDESVYSSIGAYGQSKLANILHANELARRFEEDNVNITANSLHPGSIITNLLRYHSILDVLHRTLGKLVLKNAEQGAATTCYLALHPHVKGVSGKYFCDCNLYEPSANAKDMELAKRLWDFGVELIT

SEQ ID NO: 11331 - protein, 434 aa, Bacillus clausii KSM-K16
MNRKTSESLYQEAQHVIVGGVNSPSRAYKGVGGGTPVFMERGEGAYFYDVDGNRYIDYLAAYGPIITGHAHPVITKAIQDQAAKGVLFGTPTRLENEFAQELTNAIPSLEKVRFVNSGTEAVMTTIRVARAYTGKEKIIKFAGCYHGHSDLVLVAAGSGPSTLGTPDSAGVTAATASEVITVPFNDIEAFKEALAHWGSETAAVLVEPIVGNFGIVEPEPGFLEAVNDLAHSAGALVIYDEVITAFRFMYGGAQDYLNVKPDMTALGKIIGGGLPIGAYGGRMDIMEQVAPLGPAYQAGTMAGNPASMSAGIACLEVLRTEGVYEKLDELGARLEEGLYLAAAKANVPISINRLKGALTVYFTDEPVIDYEGAKRSNGDQFSVFFKAMLNEGIHLAPSKYEAWFLTIAHTKNDIDETIEAAYRSFKTVAAGFYS

SEQ ID NO: 11332 - protein, 461 aa, Zea mays
MASFSSLSASSSTSTPSFNLPAKTSAGTGSLSFHRARESQKSRARMVTVRAEAVDTTISPRVNALRPSKTMAITDQATALRQAGVPVIGLAAGEPDFDTPAVIAEAGINAIRDGATRYTPNAGTLELRKAICKKLEEENGLSYSADQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKHPRLLVLSDEIYEHIIYQPAKHTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQTAMGKIKEAMALLRPPVAV

SEQ ID NO: 11333 - protein, 426 aa, Burkholderia mallei ATCC 23344
MPKSRARSAEAAQHLLFGVPLHWMRDWSTPFSLYVDHARGTHFTDIDGHRYADFCLGDTGAMFGHAPEPVARALAEQAARGYTTMLPSEDAAWVAAELARRFRLPYWQFALSASDANRFVLRWARAATGRKHIVVFNGCYHGTVDDVFVDLADGRPVQRDSLLGQAHDLSAYTRVVEFNDLAALEAALKDGEVACVLAEPALTNIGMVLPDAGFWREARALTRRHGTLLAIDETHTISSGPGGYALAHGLEPDLLVVGKPIGGGVPCAVYGFSASCAERAQHAKASAPPGHSGIGTTLTANMLAMRAIRATLADVMTDTAYAHMFDLAARLAAGLEQTIARRGLPWCVTRIGARTEFQFAPAPPRNGTIAGLQLDGELEHIVHLYLLNRGVLITPFHNMMLVCPQTSAEDVDRLVAAFDACLGELL

SEQ ID NO: 11334 - protein, 266 aa, Bacteroides coprosuis
MTKKKLPVRFTGQHFTIDKVLIKDAIKESNINQHDTVLDIGAGKGFLTVHLLKNVDKVIAIENDVALSQHLRKKFIHAQNVQVVSCDYRNFVVPKVPFKVVSNIPFGITSDIFSSLMFENVEYFLCGSIILQSEPAKKLFSSKVYNPLTVLYHTYYDLKFLYEINPESFLPPPTVKSALLRIERKQISLDIGLKVKYLNFVSYMLQKPDLTVKTAMKSIFRKKQVRSISEKFGVDLNSKIVCLTPNQWKNCFLEMLEVVPEKFHPS

SEQ ID NO: 11335 - protein, 589 aa, Nostoc sp. PCC 7120
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGSQEISCVTYDYLADEVPVGAKILLDDGRVEMVVEDINRDKGDLNCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNAGDILVAPRTGADFVEAIRKAGGIITEDESLTSHAAVIGLRLGVPVIVGVKKATQVIRDGAILTLDLQRGLVYSGAVGTP

SEQ ID NO: 11336 - protein, 958 aa, Bdellovibrio bacteriovorus HD100
MKIADLSPTNEFIPRHIGPTDSDIHEMLKTLGFNSLDQMADKVIPAQIRTTHAYADVGNGISEHGLLNHLKQMVSKNKVYKNYIGMGYHDTITPTVIQRNIFENPVWYTAYTPYQPEISQGRLEALLNFQTMIADLNGMEIANASLLDEGTAAAEAMFMAHSLCKNKANAFVVSPDMHPHVIEVIGTRAEPLGFEMIVMDPAKYDFAKPVFGVFFQYPNTNGTVEDYAAIAKKYKDHGALVTASTDLLAMTLLTPPGEWGADMVVGNSQRFGVPLGFGGPHAGFLATKDAFKRLMPGRLVGVSVDSQGKSALRLALQTREQHIRREKATSNICTAQVLLANMASMYAVYHGPAGLKKIALRVQRLTAILSAGLKKLNLEVGAGHVFDTVTVKTDKAAEIIAQAEKMQMNFRNYGGGKLGVSLNEATTLEDVEQIWAAFNLGKAAGFTALSVDESLADVTLPANLTRSTAYMTHQVFNSHHSETEMLRYIHHLQNKDLTLTHSMIPLGSCTMKLNATTELVPVSWPEISKLHPFAPTAQAVGLIEMIHDLEKKLCDITGFAAVSLQPNAGSQGEYAGLLVIRKYHQSRGQGHRNICLIPSSAHGTNPASAALVNMQVVVVACDDQGNVDVADLKAKAEQHKDNLAALMITYPSTHGVFEEGIVEICKIIHDNGGQVYMDGANMNALVGMCRPGVFGPDVSHMNLHKTFSIPHGGGGPGVGPIGVGAHLAEFLPKHSLVPEAGPANGISATTSAPWGSASILPISWAYITMMGAQGLRKATLVSILSANYIAKKLEAHYPVLYKGKNGLVAHECIVDVREIKKTSGIDVTDVAKRLMDFGFHAPTMSFPVAGTLMIEPTESESKKELDRFIESMVTIRKEIAAVETGKMDKENNALKNAPHTAQMLMKPEWNHPYSREEAVYPVEWLRGNKFWPVVGRVDNAYGDRNLICSCPSIEDYQA

SEQ ID NO: 11337 - protein, 457 aa, uncultured bacterium 442
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCEIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCQRL

SEQ ID NO: 11338 - protein, 237 aa, Zea mays
MSGSASRKLFQAARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVN

SEQ ID NO: 11339 - protein, 155 aa, Triticum aestivum
  misc_feature (82)..(82): Xaa can be any naturally occurring amino acid
  misc_feature (101)..(101): Xaa can be any naturally occurring amino acid
  misc_feature (117)..(117): Xaa can be any naturally occurring amino acid
  misc_feature (119)..(119): Xaa can be any naturally occurring amino acid
  misc_feature (124)..(124): Xaa can be any naturally occurring amino acid
  misc_feature (132)..(132): Xaa can be any naturally occurring amino acid
  misc_feature (136)..(136): Xaa can be any naturally occurring amino acid
  unsure (1)..(155): unsure at all Xaa locations
MAPTVMASSATSVAPFQGLKSTAGLPVSRRSNGASLGSVSNGGRIRCMQVWPIEGIKKFETLSYLPPLKHGGLLKAGPTTWXRSKWGALPPIQARLGHLPXEHNASPWGTNNGRYWXMXNCLVXGAPTQQVXNEVXGVKEDTYSASRFTSPHASP

SEQ ID NO: 11340 - protein, 141 aa, Chromobacterium violaceum ATCC 12472
MAIERTLSIVKPDAVAKNVIGKIYDRFESAGLKIVAAKMKQLSRAEAEGFYAVHKERPFFKDLVDFMVSGPVMIQALEGENAVLKNRELMGATDPKKAEAGTIRADFAESIDANAVHGSDSVENAAIEVAYFFAASEISSR

SEQ ID NO: 11341 - protein, 795 aa, Corynebacterium glutamicum ATCC 13032
MTENQPLPADLVGSHVRAAAGTPADLATDRKFWTGLSRAVQERIADDWERTREAYGAARQQHYFSAEFLMGRALLNNLTNLGLVDEAAAATRELGHEITDILEIENDAALGNGGLGRLAACFLDSAVTQDYPVTGYGLLYRFGLFRQSFNEGFQVEKPDPWREEEYPFTIRRASNQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQGHLAHHKDLSNFAEFHSVQLNDTHPVLAIPELMRLLMDEHDMGWEESWAIVSKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 11342 - protein, 274 aa, Mycoplasma penetrans HF-2
MENEKKINWFIGHMKRTVDILESKKKNIDFVIEVVDARLPYGSSNLELLSVFENKPIIKIALKSDLVKKDHYQNGFFYASIKNPADRKKIINYIDSCLKEKKDRLIKKGLRNPTFIGIVVGLPNIGKSSLINYLSNKKSLNVENRPGVTRKTENIKISDSLFLIDTPGVFLKNVTDYQMGLSLALINCVKREVVDKKDLVLFLISKFIENNNLNSFNETLNTNINSNNPSEVLSELLKVLKIDEDNNQKISVFYDFVFKKTIDNPKISLFLEKI

SEQ ID NO: 11343 - protein, 463 aa, Acinetobacter sp. ADP1
MLQQAVKEMFDHHELTSQPMYRPEVQKVIDQHHLKYVLAQFVDIHGAAKTKSVPISGLKAIEKDGVGFAGFAISGMGMQPHGPDFMVKGDLSTLTPVPWQPGYGRVVCEGYVNGKPHPYDSRYVLRQQVERLSAQGWTLNTGLEPEFSLFRRSEDGKLKMVDDSDNLDKPCYDYKGLSRSREFLERLTEALIPVGFDIYQIDHEDANGQFEINYTYADAMKSADMFTFFRMAAGEIANDLGMICSFMPKPDPKRAGNGMHFHLSIGSDECSNLFHDASDPSGMGLSKMAYHFIAGLLEHGPALCAFCAPTVNSYKRLVVGRSLSGATWAPAFIAYGGNNRSAMVRIPYGRIELRLPDAGCNPYLVSAAIIAAGLDGIERELMPPTACNENLYSLGLEEIAARGIQTLPQSLKEAIDALKADPLFAQKMGSEIVNEFIEQKSMEWVEYCRHVSDWEIQRYTEFF

SEQ ID NO: 11344 - protein, 519 aa, Burkholderia xenovorans LB400
MLTQAAMSALSIDPNSAGAATAHGRCARIVPVILAGGSGTRLWPVSRENYPKQLIDVVGSDSLLQATARRMDGFPAGWKVDASPVIVCGEEHRFVIAEQLHENGVDARLIVEPARRDTAPALTLAASLACADGGDAILVVMPADHSIADVPALQAALERAAQYAEQGSIATLGVPPTRPDTGFGYIRIGAELAGGGHAIDGFVEKPAEELAAKYVAAGMYWWNSGIFIVRASVWLDTLKRLQPEMHSACERAFSGGRQDGAYFRPLVEAFLSAPANSIDYAVMERLTETAEPDATDGAAASAPAQPAGVVIGLDAGWSDLGSWDAVWAAMEKDANGNAGRGRVTFEGAVSSYAHSEGRLVACVGTTNVVVVETADAVLVVDRSHVQDVKGLVSRIKAQHAPEADAHRKVRRPWGFYDSIDHGERFQVKRIVVTPGAQLSLQLHHHRAEHWVVVRGTALVTRGDEQFLLSENESTYIPLGTRHRLENPGKVPLEIIEIQSGTYLGEDDIVRFNDNYGRCS

SEQ ID NO: 11345 - protein, 312 aa, Saccharomyces cerevisiae
MNIMKRQLCTSSKRFFSTAKNVVKYNTIQDIRNKYFTGTPLSMCTAYDFITATWVNKANCDLLLVGDSLAMTSLGYDSTITLSLNEFKYHVASVCRAEGSSMVVVDMPFGTFESGISDGLKNAIDIMKLDSKVTSVKVEVGSYTKDKYAMKFIEELCSRGIPVMAHIGLTPQKVHSLGGYKVQGSKSLLQMQELYETAMQLQKIGCWSILIECVPHKMAQFITSKLSVPTIGIGAGNGTSGQVLVISDLLGMQGDSVPKFVKQAVNMTDIATQGLKEYIASVEDRTFPERGTHTFKVKEDLWNEFLSSINEK

SEQ ID NO: 11346 - protein, 639 aa, Magnaporthe grisea 70-15
MSTAPELDLAEAARAHAPSTAKEGMTTRGSTESLRAVEGEIYPTEEEFATLRRVHGKVSWLIYTIGLVEMCERFAYYGTTAVFVNFIAYPLPEGSTTGAGGTDRQAGALGLGQQASTSLTLFNAFWSYFMPLLGGYLADTYWGRFMTIQYAIVLATIGHILIIVAAIPSVITNPSGALGAFIVGILFFGTGVGWFKANISPLIAEQYEMQHPRAVIETLPSGERVIVDPVVTISRIYMRYYFLVNVGALVGQISMVYAEKYVGFWLSYLLPTLLFFLCPIIMVISRKSYAKRPPTGSVLGNMAKLVAFGIKKGSITELNKDVFWDRIKPSRVTGADRPKFMDTIDDAWVDEVRRGLSACYVFAFLPIFWLAYNQMSNNMINQAATMRLDGIPNDVVTNLNPFSLLILIPICDKLIYPALAKAGIRFTPIKKIALGFVSAALSMAIAAIIQHFIYVKSPCGYSASECIDPPNPPDMSVWIQTPAYVLIALSEVFASITGLEYAFTKAPRNMRGMVTGVFWLVNSISAALGFAFVGLATDPLLVWLYTTVAIVSAVGGIAFWFCFRKLDKREDELNALPESNYKGRHLDGPMDVEKRVMDDEATQAAPAATSVPAPGTASGTAADVDAVTPVEAGSTEKRQ

SEQ ID NO: 11347 - protein, 230 aa, Zea mays
SVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLPGGINELDERTQVAYGSKNEIIRFEETLYGSSRLAASATATARALI

SEQ ID NO: 11348 - protein, 144 aa, Arabidopsis thaliana
  misc_feature (57)..(57): Xaa can be any naturally occurring amino acid
  misc_feature (94)..(94): Xaa can be any naturally occurring amino acid
  misc_feature (116)..(116): Xaa can be any naturally occurring amino acid
  unsure (1)..(144): unsure at all Xaa locations
MVFCTAHATVRDPFIGLKYSSAFPATRKALKDITSITSNGSRVNCMQVWPPIGKKKXETLCYLSDLTDSKLAKEVDYLIRARWIRCDELELKHXVVFREHGHSPGYYDGRYWTMCXLTLFGCSESPVLLKEVVECRKEYPTAFI

SEQ ID NO: 11349 - protein, 463 aa, Candida albicans SC5314
MSSPQQIVNSFQQALNLSGSPNAVSTSPTQSFLSQYVPSKPAKALKPFKTGDIKILLLENVNQTAINIFKNQGYQVEFYKSSLPEDELLEKIKDVHAIGIRSKTKLTEKILKAAKNLVVIGCFCIGTNQVDLEFAAKSGIAVFNSPFSNSRSVAELVIAEIITLARQLGDRSIELHTGTWNKVSAKCWEIRGKTLGIVGYGHIGSQLSVLAEAMGMNVIYYDVMTIMSLGNSKQVESLDELLKKADFVTLHVPATPETKNLLSAPQFAAMKDGAYVINASRGTVVDIPALVQAMKAGKIAGAALDVYPHEPAKNGEGLFSDSLNEWASELCSLRNVILTPHIGGSTEEAQSAIGIEVGNSLTKYINEGASQGAVNFPEVSLRPLDLDQQNVVRVLYIHQNVPGVLKTVNNILSNHNIEKQFSDSQGDIAYLMADISDVDISDIQSLYEQLEQTPYKIATRLLY

SEQ ID NO: 11350 - protein, 447 aa, Alkaliphilus metalliredigenes QYMF
MFPYIPATEESKKKMLEDVGLNSVEDLFKDISHKVRLKGELNIPKHKSELEVSSYIKKLGKMNETTEDYTCFLGCGAYDHYIPSVVDAVISRSEYYTAYTPYQAEIAQGTLQTIFEFQSMMAGLTGMDVCNASVYDGSTAVYEAAYVAVASNRRKEVLISKSVHPEYRKVLKASLGAANIKYIEIEIKEGTTDLDDLKEKLTKDVSAVIVQSPNFFGLIEEVEEVVKESHENKSLVVMSTDPISLGLLKTPGEMGVDIAIGEAQALGIPLSFGGPYLGFITTTKALLRKVPGRLVGMTKDVDGKRGFVLTLQTREQHIRREKSISNICTNQALNATAATVYLSLMGKEGMKEVAKQNYDKAHYAHEQLISTGMFEDSWEKPFFKEFTLKYKGNLKALKEKLEENKILGGFHPKEDYQALENHLIIAVTEKRSKEEVDQLCTIVKEVE

SEQ ID NO: 11351 - protein, 481 aa, Alkaliphilus metalliredigenes QYMF
MYEKVIYEISSKGKKGYMLPPQDVPQYEVPEKYLRKTDNHLPEVSEREVMSHFVNISSKNYHIDKGFYPLGSCTMKYNPKINEAMARLDGLANIHPYQDEKMVQGALRLMYELQGSLGEITGMDAFTLQPAAGAHGEKTGLMLMHQYHRGRNDLKRDKIIVPDSSHGTNPASAAMTGFKIIEVPSNERGGVDIEALKNVVGDDTAGLMLTNPSTLGLFEENITEIAGIIHGAGGLLYYDGANMNAIMGYARPGDMGFDIIHLNLHKTFTTPHGGGGPGAGPVGVKEFLKEFLPVPMIDKKDETYTLRYDMENSIGKVKSFYGNFGMLIRAYTYILTMGSDGLKHVSEMAVLNANYLKENLKEYYQLPYDILCKHEFVLSGKSMKKKYGVSTMDIAKRLIDYGYHPPSVYFPLIVEEAIMIEPTETESKETLDEFIKVMITIAKEAAENPDLLHEAPHHSPVRRLDDSGAARNPILKWQDIE

SEQ ID NO: 11352 - protein, 334 aa, Synechococcus sp. WH 8102
MTRFPSTCSLDVVGIGNAIVDVLVQTDDAFLAQHGLQKGGMALIDEQQAETLYTASGPGLETSGGSVANTMVGIAQLGGRAGFIGRVRDDQLGGIFSHDIRAVGARFDTPAATTGATTARCLIYVTPDAERTMCTFLGASTQLEPEDLDLSMVRDTKVLYLEGYLWDSPAAKRAFIAAADVCREAGGQVALSLSDGFCVDRHRESFLELVNGHVDVLFANEVEIKSLYETDDFDTALKKVGGCCSVIAVTRGGEGSVVLSGDQRWDIGIFGLGELVDTTGAGDLYAGGFLHGYTQGESLGRCGQLGALCAGQIVTQLGARPQVSLRELAAAHLN

SEQ ID NO: 11353 - protein, 97 aa, Citrus sinensis
MARSLFKAKLLLAPVADGISLSISRRGYAAAAPLGTISRTGIMEKNDLRPAVREDSGASSAWAPDPITGYYRPENRAVEIDPAELREMLLNHKVRAH

SEQ ID NO: 11354 - protein, 345 aa, Zea mays
  misc_feature (292)..(292): Xaa can be any naturally occurring amino acid
  unsure (1)..(345): unsure at all Xaa locations
MDSGPVPTRPTGGSAAVASSSSSLIFLGTGCSGALPDARCLIQPSEPPCTVCSTALSLPPDRNPNYRCNTSLLVDYCHDDGTHRYILIDVGKTFREQVLRWFVHHEVPSIDSVILTHEHADAVLGLDDLWVALPSCQRNGSAKVPVFLTQFTMDSVAARFSNLVEQKLQGGDDFARPAHLDWTIIEGDVDKPFVASELQFWPLPLSNLKLSGQVMHGEDYVCLGFLFGRKARVAYLSDVSRILPRTEHAISKSGTATGQGQLDLLILETNRLHGAGDGRSCHLTLSQSLEPXDAVKRIRPKRALLIGMNHEFEHHRENQLLARWSCRERIPVQLAHDGLRVFIDL

SEQ ID NO: 11355 - protein, 109 aa, Glycine max
  misc_feature (63)..(63): Xaa can be any naturally occurring amino acid
  misc_feature (96)..(96): Xaa can be any naturally occurring amino acid
  unsure (1)..(109): unsure at all Xaa locations
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 11356 - protein, 336 aa, Deinococcus radiodurans R1
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 11357 - protein, 188 aa, Aspergillus nidulans FGSC A4
MRPLTEEETQTLFKKLAEYCGSGLKELIKPLDSSPNADRYVFRLSGNRVYYSLLSIANAATAFPRDQLLSLGICMGKFTKTGKFRLHITALPIIAEHARNKIWIKPNGVMPFLYGSNVAKAHVAKLPDEMAEHSGVIVCTQDDVPLGFGITARSTAEARRLDPTGIVCFRQADCGEYLRDEDTLFASG

SEQ ID NO: 11358 - protein, 400 aa, uncultured bacterium 582
MALLSDTLARVKPSPTVAMSSKAIEMRAAGRDIISLSAGEPDFDTPENIKSAAIAAILAGKTKYTAPDGIIELKQAICDKFLRDNALRYRPEQVSVGTGGKQVLYNALMATLNPGDEVIIPAPYWVSYPDMVYLAGGEPVILETSVERGFKLSAEALEAAITPRTKWFIFNSPSNPTGAGYHWDELRALTEVLQRHPHVWILSDDIYEHLVYDNFKFCTPAEVAPDLMDRTLTVNGVSKGFAMTGWRIGYAAGPRALIAAMRTIQGQSTSNPCTVSQWAALEALNGPQDYIASNNILFRTRRDLVVAQLNAIDGITCPTPEGAFYVYASIDGLIGKTTAAGVLLANDEAFAMQLLEEANVAIVFGAAFGLSPCFRVSYAASEDTLKAACTRIAEFCAALT

SEQ ID NO: 11359 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 11360 - protein, 335 aa, Geobacillus stearothermophilus
MAVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 11361 - protein, 349 aa, Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 11362 - protein, 315 aa, Zea mays
MEDLASSRGGGGCGGLDAQIEQLMECRPLPETEVKTLCEKAKEILMEESNVQPVKSPVTICGDIHGQFHDLLELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDNVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 11363 - protein, 129 aa, Prunus avium
TMPSNCAGSEFKERKLSPKLRSKLKRSWPDVESGNDPRFWEGEWSKHGKCSEQTLNQMQYFQRSHEMWQSFNITEILRNASIVPHPTQTWTYSDIVSPIKAVTQTTPLLRCKFPPKSQTKSQPKSQAPS

SEQ ID NO: 11364 - protein, 473 aa, Prochlorococcus marinus str. NATL2A
MSKTSQDVLRQIKDEGIELIDLKFTDLHGKWQHLTVASDLIEESSFTEGLAFDGSSIRGWKAINESDMAMVPDPSTSWIDPFYHHKTLSLICSIQEPRSGEPYARCPRALAQKALDYLGSTSVADAAFFGPEPEFFIFDDVRYNSGEGSSFYSVDTIEAPWNSGRVEEGGNLGYKIQLKEGYFPVSPNDTAQDMRSEMLLLMGELGIPIEKHHHEVAGAGQHELGMKFAPLINAADNVMIYKYIVRNVAKKYGKTATFMPKPVFNDNGTGMHVHQSLWKGGQPLFYGEGTYANLSQTAKWYIGGILKHAPSFLAFTNPTTNSYKRLVPGFEAPVNLVYSQGNRSAAVRIPLTGPSPKAKRLEFRSGDALANPYIAFSAMMMAGIDGIKNQIDPGDGVDVDLFELPSEELSKIDTVPSSLNDALEALKNDSQYLTEGGVFTEDFINNWIELKYEEVQQLRQRPHPHEFTVYYDA

SEQ ID NO: 11365 - protein, 483 aa, Acinetobacter sp. ADP1
MDLQQQPLFRQKALVAGQWCDADNAEKTPIFNPATQELIGYVPNMGRAETERAIEAAYASWEMWKTKTAKERSALLKKWYDLILLNLDVLAEILTTEQGKPFNEAKGEIIYAASFIEWFAEEAKRIYGDIIPSPYPDARIVVNKQPIGVVAAITPWNFPAAMITRKVAPALAAGCPCIVKPAPETPFTALALADLAIQAGIPAEIMSVVTGDAAQIGDAIFASDHVRKFTFTGSTPIGKLLLEKSAKTLKKVSLELGGNAPFIVFDDADIEAAVEGALIAKFRNAGQTCVCVNRFLVQSGVYEKFIQVFKAKIESLKIGNGLEAGSEIGPLINAQAVAKVQSHIEDALSKNGRLITGGQVHATGELFFEPTLIADANTEMMVATQETFGPLAAIFKFDTEQQAIQMANDTEFGLAAYCYTRDLGRAWRMSEQLEYGMVGINKGLISNEVAPFGGIKHSGLGREGSKYGIEDYLEIKYTLFGGL

SEQ ID NO: 11366 - protein, 193 aa, Triticum aestivum
  misc_feature (76)..(76): Xaa can be any naturally occurring amino acid
  misc_feature (88)..(88): Xaa can be any naturally occurring amino acid
  misc_feature (96)..(96): Xaa can be any naturally occurring amino acid
  misc_feature (114)..(114): Xaa can be any naturally occurring amino acid
  misc_feature (122)..(122): Xaa can be any naturally occurring amino acid
  misc_feature (133)..(133): Xaa can be any naturally occurring amino acid
  misc_feature (138)..(138): Xaa can be any naturally occurring amino acid
  misc_feature (141)..(141): Xaa can be any naturally occurring amino acid
  misc_feature (155)..(155): Xaa can be any naturally occurring amino acid
  misc_feature (160)..(160): Xaa can be any naturally occurring amino acid
  misc_feature (164)..(164): Xaa can be any naturally occurring amino acid
  misc_feature (167)..(167): Xaa can be any naturally occurring amino acid
  misc_feature (173)..(173): Xaa can be any naturally occurring amino acid
  misc_feature (176)..(176): Xaa can be any naturally occurring amino acid
  misc_feature (178)..(178): Xaa can be any naturally occurring amino acid
  unsure (1)..(193): unsure at all Xaa locations
MAPTVMASSATSVAPFQGLKSTAGLPVSRRSNGASLGSVSNGGRIRCMQVWPIEGIKKFETLSYLPPLSTEALLKXVDYLIRSKWVPXCLEFNKVXGFIFREAQTQSLGYYDGXYWTMWKLXMFGATDAKKVXLTRGXEVXKEYPDPLSAIIGFXKMRKXKWVXFNXLKPPGXKDXGXAKSPKGNKGIDFLNN

SEQ ID NO: 11367 - protein, 178 aa, Brassica napus
  misc_feature (155)..(155): Xaa can be any naturally occurring amino acid
  misc_feature (158)..(158): Xaa can be any naturally occurring amino acid
  misc_feature (163)..(163): Xaa can be any naturally occurring amino acid
  misc_feature (165)..(165): Xaa can be any naturally occurring amino acid
  misc_feature (172)..(172): Xaa can be any naturally occurring amino acid
  unsure (1)..(178): unsure at all Xaa locations
MMNVSRPAVHPVDSVPVAPPANDRPPARMKDVQGMPGTTGGLILRLSQFVPALISVSVMITTSDYRSATAFCCLVLAVTLQSLWSLSLFIIDAYALLVKRSLRNHLIVQCFTVGDGITSTLTFAAASASAGITVLINDLNKCNVNHCTRFETAVXMAXISWFXVXPSFIFNXWSLASF

SEQ ID NO: 11368 - protein, 227 aa, Zea mays
MASIPPPSSSVAALTRQPAQFLKGCSVSKETKASVCSFLATNSNSTRVKSVGLRVASSFKNDGGYPADGFSGNGNTLLPKSTSVRGEDHPAADPVLPMDSMMTPEILSANLALVMDKFSDDDTRTELDLDSPTEGFASIADAIDDVRQGKLVTVVDDESRENERDLIMAASLVTPEAMAFIVRHGTGIVCVSMKEDDLERLSLPLMVTTKENEEKLCTAFTVTVLIW

SEQ ID NO: 11369 - protein, 519 aa, Rhodobacter sphaeroides
FFLTSAALQDILRRFKSGHGDLRALSRHVAIQMNDTHPAIAGPELIRLLVDEHGLSFDEALPVAQECLGYTNHTLLPEALERWATFTFGNVLPRHMQIVERIDGWHRRTFPARPHYVGIVKHHEVRMGELAFIMSHKVNGVSALHTDLVKANLFPELDRLHPEKIVNQTNGVTPRRWLKMANAPLARLIGETIGEGWEDDLDRLKGLEPHVKDQGFLGAFDAAKRQNKVTLSNWLGAECGVKVSPDALFDVQVKRIHEYKRQLLNILETVARWQAIRANPDAGWVPRVKIFGGKSAPGYAVAKEIIHLINDVAAVINADPLVGDLLKVIYPANYNVSMAERLVPAADLSEQISTAGKEASGTGNMKFMMNGAPTIGTLDGANVEILQEVGRENFFLFGLTAEEVMKRREDPDHARKAIEASQIMQNVLQAIAEGQFSPGQADRYHGLVHRVWHHDYFLVASDFDAYLAAQAEVDAAYKDRARWLTMAALNTARSGFFSSDRTIRGYMKEIWGVESALQD

SEQ ID NO: 11370 - protein, 286 aa, uncultured archaeon
MSMEEYLCRIAEADVAVVSHFKLPARSFDSSTLKLVALTRTGYDDVDLDAATLKGVAVANAPGYSNEAVAEHVFAMLLSFIRRISEADFWIREEKFDCTAFEGRELRGKTMGIIGTGQIGLRVAEIARCFGMDVIAYDVRRNPAVAEKLRYVGLDRLCAESDFITVHLPLTSDTRGLIDEESFRLMKPGAVIINTARGPVVDQAALLRALDEGRIAGACLDVFDQEPLPPDSPLLAMSNTLLTPHIAYNTREAKEQSIAIAAENVALYLSGKPRNIVNPAVLGVKP

SEQ ID NO: 11371 - protein, 299 aa, Mycobacterium sp. JLS
MHAMVYHGPGRRSWEQVPDPEVQRATDAIVRVDAVTICGTDLHILKGDVPEVQPGRILGHEAVGTVIEIGSAVEKLAVGDRVLVSCISACGSCRYCRDGQYGQCLGGGGWILGHLIDGTQAEYVRVPFADNSTHKVPAGVSDEQMVMLADILPTSYEVGVLSAAVRPGDTVAIVGAGPIGLAAVLTAKLFSPSHIVVIDIAESRLEAAKNMGADVVVNSTSQDARSVLDELTDGLGADVAMEAVGMPETFEQAVRLVRAGGHVANIGVHGKPATLHLEDIWIKNLTITTGLVDTHSTPP

SEQ ID NO: 11372 - protein, 491 aa, Agrobacterium tumefaciens str. C58
MNIHNNSGTATHPATDPVTAIVTGFNLKTPGSKRAAAYNRDFLSDKSSIGLPFTMQTKEALYPIVATHAEGAYLQDVDNNRYVDILMGLGTNLFGHNPSFIRTAIEAQLTKGFALGPQSDLAGETAELFCCITGKDRVTFSNTGTEAVQTAMRIARAATGRDKIVLFTGSYHGHSDPALHKATKLEYIRRGALLRSHPAWLVALKPLLKRMVLTKAVPGFSGVAPSSARDIVLLEYGNPRSIDYIRRHGDSLAGVLVEPVQSRNPELQPREFLHELRSVTEKTGSALIFDEMITGFRVAPGGAQSHFGIDADIATYGKIAGGGLPLSLIAGKGRFMDFVDGGAWAYGDSSFPKVAPTFFAGTYCRHPLALAAAKAVATRLLEDGPTLQEGLNARTQAFVERLNGALKGAGLPVAFMSFGSFFAISAARSRISPQAVTMLSFLLLTSGVHLRAGDRGGFLSTAHSDDDIAFVHDAVLQSLTALADHRLLDRH

SEQ ID NO: 11373 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 11374 - protein, 346 aa, Cytophaga hutchinsonii ATCC 33406
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 11375 - protein, 323 aa, Staphylococcus epidermidis RP62A
MSKYSQDVIRMLYEHQSNYISGQYIADQLNISRAGVKKVIDLLKEDGCDIKSINHKGHQLNSLPDQWYSGIVKPILDELGLFNHLEVYHTVDSTQLKAKRALVGNKDTFLILSDEQTEGRGRFNRNWESSKGKGLWMSLVLRPDVPFSMIPKFNLFIALGIRDAIQQFSNERVTIKWPNDIYIGNKKICGFLTEMVANYDEIEAIICGIGINMNHVESDFDEDIKDKATSIRMHSDSIINRYTFLTALLTQIIHRFDQFLHQTFESIREEYIHATNIWHRQLKFTENNHQFLGEAIDIDSDGFLIVKDEKGQLHRLMSADIDL

SEQ ID NO: 11376 - protein, 225 aa, Campylobacter upsaliensis RM3195
MIYAANLKCNHTRASFELYLKALNEVLKTQNENVFVFPPSVAFSQKESFFTQGAQNFYPCINGAFTGELGKEHLDEFGIKCVLIGHSERRIFENEALIKAKFDFAKEQGWQIFLCIGEDLKTKQKGLAKDFLKKQLENLDLNYEKLIIAYEPIYSIGTGVSAKNEDIEAILAFLRTLTKVSLLYGGSVNETNIKELTQIKHCGGVLVGSYALKVENFITLIKESK

SEQ ID NO: 11377 - protein, 287 aa, Listeria monocytogenes str. 4b F2365
MTIQWFPGHMAKARREVTEKLKLVDVIFELVDARIPLSSSNPMLEEIIHQKRRVIILNKADTADEKTTKEWIDYFAEKGLPAVAVNAQEGKGLFKIEQAAEKLMAEKFDRLRSKGMKPRAIRAMILGIPNVGKSTLINRLAKKNIARTGNKPGVTKAQQWIKVGKTLELLDTPGILWPKFEDQEIGYKLALTGAIKDDLLQMEEIAGYGLRFLEKHYPDRLQNWLKVETVSEDPIETLAFIAEKRGLLDRYNDPDYSRAAETVVREIRQQKLGRMSFDFPNWEDEVE

SEQ ID NO: 11378 - protein, 131 aa, Glycine max
  misc_feature (77)..(77): Xaa can be any naturally occurring amino acid
  misc_feature (103)..(103): Xaa can be any naturally occurring amino acid
  unsure (1)..(131): unsure at all Xaa locations
MPPTSPDYSSIMSHFRGKYHNELIANAAYIDTSGKGILAADDGTGTIGKRLASISVENVESNRRAFRELIFTTHQVXLKYLRGAILFRETLYQSTPAGKHYVXVLKEAGVLPGIKVVKGTAELAVTYGETT

SEQ ID NO: 11379 - protein, 179 aa, Pyrus communis
FTQQYQPAVCSSNPTPCRDPPDKLFTVHGLWPSNVNGSDPKKCKTTILNPQTITNLTTQLETIWPNVLNRRANVRFWRKQWRKHGACGYPTIADDMHYFSTVIEMYITKKQNVSEILSKAKIKPEKKFRTRDDIVNAISQSIDYKKPKLKCKNNNQITELVEVGLCSDNNLTQFINCPH

SEQ ID NO: 11380 - protein, 462 aa, Oryza sativa
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLPDIAYFEFIPLKPVAGDGGYAEAEPVGLTEVAAGELYEVVMTTFAGNTRSSSSCMTLVAYYYLQSKKWMNICRFCISVHETSRNLVTCTFAATGHIMFAQK

SEQ ID NO: 11381 - protein, 471 aa, Escherichia coli
MIIPIIMAGGSGTRLWPLSRSLYPKQFLSLINENSLLQETLKRLDGLNCLPPVIVSNNEHRFIVAEQLRQFGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDLIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHVSHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 11382 - protein, 242 aa, Xylella fastidiosa Ann-1
FLIVRAFGHPTSTALTISTSLAQIGEFSFILAGLGIQLAILPETGRDLILAGALLSIIANPFLFTWLDRWQAQQTAEETTLVEPELPPGPSPDLYNHAIVIGYGRVGSMLAQLLQSRHVPLLVIDDNSEHVLKAHAAGIPAIRGSAAADLVLAEAHPDRAKIAVLAIPQPLEAGEILAKLRALNPELTLVARAQNDAEVKHLLEHGADATVVAEREMAHSLAEMVLSSTNHPNSTRPQPAIA

SEQ ID NO: 11383 - protein, 293 aa, Medicago truncatula
MEGNSGGGGGGGGGSSGGGGGGGADVELLCKTLQVEHKLFYFDLKENPRGRYLKISEKTSATRSTIIVPFSGISWFLDLFNYYVNSEDQELFSKELQLDTKVFYFDIGENRRGRFLKVSEASVSRNRSTIIVPAGSSRDEGWAAFRNILAEINEASRLFLLPNQQNSESSERLLSDDVGAGFISGHNTQPATSSELNVDRSVDLPAQDEIGNLGVSKVIRADQKRFFFDLGNNNRGHFLRISEVAGSDRSSIILPLSGLKQFHEIVGHFVEITKDRIEGMSVANVRTIDPPQR

SEQ ID NO: 11384 - protein, 494 aa, Spinacia oleracea
MAASAMGVLQEREVFKKYWIEHSVDLTVEAMMLDSQASDLDKVERPEVLSMLPPYEGKSVLELGAGIGRFTGELAEKASQVIALDFIESVIKKNESINGHYKNVKFMCADVTSPSLNISPNSVDIIFSNWLLMYLSDEEVERLVERMLKWLKPGGYIFFRESCFHQSGDHKRKSNPTHYREPRFYTKIFKECHMQDDSGNSYELSLIGCKCIGAYVKSKKNQNQISWLWQKVDSEDDKGFQRFLDSSQYKFNSILRYERVFGPGYVSTGGLETTKEFVSKLDLKPGQKVLDVGCGIGGGDFYMAENYDVEVVGIDLSINMISFALERSIGLKCAVEFEVADCTKKDYPENSFDVIYSRDTILHIQDKPALFRSFHKWLKPGGKVLISDYCKSAGTPSAEFAAYIRQRGYDLHDVKAYGKMLKDAGFVEVIAENRTDQFIQVLQKELDALEQEKDDFIDDFSEEDYNDIVDGWKAKLVRTTEGEQQWGLFIAKKM

SEQ ID NO: 11385 - protein, 92 aa, Zea mays
  misc_feature (38)..(38): Xaa can be any naturally occurring amino acid
  unsure (1)..(92): unsure at all Xaa locations
MPPKKAAPSKAELANKQNVVEDKTFRLKNKNKSKNVQXYVQSLHHAVHPKPDSTKTAVKNNNDDEKAREKDLNDLFKGVDRHSKVPVDVDPK

SEQ ID NO: 11386 - protein, 138 aa, Zea mays
  misc_feature (33)..(33): Xaa can be any naturally occurring amino acid
  misc_feature (86)..(86): Xaa can be any naturally occurring amino acid
  misc_feature (104)..(104): Xaa can be any naturally occurring amino acid
  misc_feature (118)..(118): Xaa can be any naturally occurring amino acid
  misc_feature (130)..(130): Xaa can be any naturally occurring amino acid
  unsure (1)..(138): unsure at all Xaa locations
MASRWVLVGEVIGRLEKRGLYLLVLKLPKMEKXLVEQHCENLSFNTFAVVVQCMVSGLVVTKVCEGKKVVSAGRGIIGAAGPSGFXSATIRGVVAVDLCRNVIXGMYSVESSSKEISXWLGDGTAEWRSXQHFCLYEA

SEQ ID NO: 11387 - protein, 402 aa, Zymomonas mobilis subsp. mobilis ZM4
MIGRITMAITPLMPVYPRCAVRPVRGEGCYLFGEQGERYLDFASGIAVNILGHGHPHLVKAIQEQAATLMHVSNMYGSPQGEAFAKRLLSHCFADTVFFTNSGAEAIECAIKTARRFHYANGNPERFKLITFSNAFHGRTMGTISATNQPKMVDGFKPLLPGFQVVEFNDLAAAEAAVDDQTAGFLVEPIQGEGGIRPATDEFMKGLRRICDEKGLMLVLDEVQCGYGRSGTFFAHEQYGIKPDIMAVAKGIGGGFPLGACLATEHAAKGMVFGTHGSTYGGNPLAMAAGQSILDIILEDGFFDHVQKMGNILAEKLETIVKKYPELCLEARGRGLIRGLKLSVPSRDVVAHLRDNHGLLTVAAADNVIRILPPLVIEEKHIDEFMEKLEAGLKSYVPAQAA

SEQ ID NO: 11388 - protein, 468 aa, Azospirillum brasilense
MSDISKVFDLIKEHDVKYVDLRFTDPRGKLHHTAQHVSTIDEDVFEDGIMFDGSSIAGWKAINESDMILQLDPTTAVMDPFSAQPTLNILCDVYEPSTGQPYARCPRGIAKAAEKYMASAGIADTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGLDGIQNKIHPGEAMDKNLYDLPAEELAKVPTVCGSREALDSLKADSAFLQKGDVFTKDMIESYIDLRTEELLAFETMPHPIEYKMYYSV

SEQ ID NO: 11389 - protein, 467 aa, Azotobacter vinelandii
MSKSLQLIKEHDVKWIDLRFTDTKGKQQHVTMPARDVDDDFFEYGKMFDGSSIAGWKGIEASDMILMPDDSTAVLDPFTEEPTLIIVCDIIEPSTMQGYDRDPRAIARRAEEYLKSTGIGDTAFFGPEPEFFIFDEVKYKSDISGSMFKIFSEQAAWNTDADFEGGNKGHRPGVKGGYFPVPPVDHDHEIRTAMCNALEEMGLKVEVHHHEVATAGQNEIGVSFNTLVAKADEVQTLKYCVHNVADAYGKTVTFMPKPLYGDNGSGMHVHMSIAKDGKNTFAGEGYAGLSDTALYFIGGIIKHGKALNGFTNPSTNSYKRLVPGFEAPVMLAYSARNRSASIRIPYVNSPKARRIEARFPDPSANPYLAFAALLMAGLDGIQNKIHPGDAADKNLYDLPPEEAKEIPQVCGSLKEALEELDKGRAFLTKGGVFSDDFIDAYLELKSEEEIKVRTFVHPLEYDLYYSV

SEQ ID NO: 11390 - protein, 238 aa, Brassica napus
MLAIFDKKVAKAPEALTSQEGGSVCALKDGFLPNHFASIYPGAVTTNLGSSGLIACSLHKQNPLLPRLFAVNDDMFCIFQGHIENIPFLKQQYGLTKTATEVTVVIEAYRALRDRGPYPADQVVRDFQGRFAFMLFDCTTKNVFLAADADGSVPLFWGTDGEGHLVLSDELETVKKGCFFTSSGGLRSFEFPLNELKPVPRVDSSGQVCGVLFKVDSEAKKEGAMPRVGSVQNWSQQI

SEQ ID NO: 11391 - protein, 379 aa, Oryza sativa
METAAAVVCRGGGLRAPARRGGSDSSTTRAGGVAASPAPATTARRRPLLVASLGEPLITAQPLSSSLGDGAAVHETLARSDSVIPSLKPSHCVDHSVQVDADEETGSTKTLPPPDDVPTKTVHVKFVLQKRCAFGQRFLVVGDVAALGLWNPAKAAALDWSEDHVWTVKKELPAERSIEFKFLLQDRSGHVEWQHGRNRILHVADTSNTLIVCEDWDEAKNQQVSEEIGDADGIFSGSDGVFQEDELQLGEEQETNKGVTVGVDDAKSALVTYIYREMMGANDAIQPQLALDKHHKIPDELSGEANMAAQDGNHTATAAAASGFAGSNGEDAILHKEGDPVENNRLGLASIFFNDMAWTRKALQQLLRSLGFQIGTRKT

SEQ ID NO: 11392 - protein, 582 aa, Oryza sativa
MTLMTDGINLFREEDCSCRLAEPKRGEEIPREEMRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRYAKMTALVLTLFPCMWLHYLQIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHVLKIWLLFLISIGLSSILFAGAAVMGYKMFGESTESQFTLNLPENLVVSKVAVWTTQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 11393 - protein, 82 aa, Rhizobium etli
IPVMGHIGLMPQQVQTAGGYRSVGHSEHETSKIRRDAHAIGGSGAFAVVIEGTVEPLAREVTSAMHIPTIGIGASAACDGQV

SEQ ID NO: 11394 - protein, 521 aa, Zea mays
MICYMLWLAACCLLLLYSVRFRSGWSHGNGPRSYPVIGCLVDFYKNRWRLLDWYTELLAASPTQTIVVDRLGARRTVVTANPVNVEHILKSNFGNYPKGKPFTDILGDLLGTGIFNVDGELWYAQRKLVSHEFSARALRELEFAVLEDEARERLVPALGLAAARGDVVDMQDLLRRFSFDVICRVSLGVDPGCLDPALPAPRLAAAFDAAAGIIARRGAAPVAAVWKAKRALDVGSERQLREEIAVIHEAVMDLIHIRKKECGLRVNSGDGRRSDLLSRMIECGYPDEAIRDMVISFIMAGRDTTSSALTWFFWLLTRHRDVEREVLREITGGGASHAAAGGQGKMRALHAALCETMRLYPPVAWDSKHAAAGDVLPDGTRVERGDRVTYFQYGMGRMESIWGADAGEFSLRRWLSIIPEENAAPAPPAAVAGLSPFKYPVFQAGPRTCLGKEMAFVQMKFVASTVLRRFEIVPVDEGRVPVFLPLMTAHMAGGLNVTVRRRGEPIAAAATPLDPSADPVL

SEQ ID NO: 11395 - protein, 558 aa, Bacillus sp.
MFLEAVYHRPRKNWSYAYNGTTVHLRIRTKKDDMTAVYALAGDKYMWDHTMEYVPMTKLATDELFDYWECEVTPPYRRVKYGFLLQQGHEKRWMTEYDFLTEPPRNPDRLFEYPFINPVDVFQPPAWVKDAIFYQIFPERFANGDTRNDPEGTLPWGSADPTPSCFFGGDLQGVIDHLDHLSKLGVNAVYFTPLFKATTNHKYDTEDYFQIDPQFGDKDTLKKLVDLCHERGIRVLLDAVFNHSGRTFPPFVDVLKNGEKSKYKDWFHIRSLPLEVVDGIPTYDTFAFEPLMPKLNTEHPDVKEYLLKAAEYWIRETGIDGWRLDVANEVSHQFWREFRRVVKQANPDAYILGEVWHESSIWLEGDQFDAVMNYPFTNAVLDFFIHQIADAEKFSFMLGKQLAGYPRQASEVMFNLLDSHDTARLLTQADGDKRKMKLAVLFQFTYFGTPCIYYGDEVGLDGGHDPGCRKCMEWDETKHDKDLFAFYQTVIRLRQAHAALRTGTFKFLTAEKNSRQIAYLREDDQDTILVVMNNDKAGHTLRCLSGMHSGPICGTTMS

SEQ ID NO: 11396 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 11397 - protein, 471 aa, Escherichia coli
MIIPIIMAGGSGTRLWPLSRSLYPKQFLSLINENSLLQETLKRLDGLNCLPPVIVSNNEHRFIVAEQLRQFGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDFIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHISHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 11398 - protein, 256 aa, Brucella melitensis 16M
MTKFWIGTSWKMNKTLAEARLFAEALKAADAGRSPDIQRFVIPPFTAVREVKEILSGTSVKVGAQNMHWADQGTWTGEISPLMLKDCNLDIVELGHSERREHFGETNETVGLKVEAAVRHGLIPLICIGETLEDCESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 11399 - protein, 297 aa, Xylella fastidiosa Ann-1
MMQPPINVHTPHSSAQLALLPPKHLNQLESHGMESRLFNTPAKKAFGQHFLVDRYYIDRIIHVINPQPNDHIVEIGPGQGAITLPLLKCCGSLTAIELDRDLIAPLTAAATPIGKLDIIHSDVLKVDLSILAKQGNKKLRLVGNLPYNISSPILFHVLQQAAIIADMHFMLQKEVVDRMAAPPGSKVYGRLSVMLQAWCEVTTMFVVPPDAFQPPPKVNSAITRLVPRDPTTIRIADTKRFSDIVRAAFGQRRKTLRNSLADICTPAHFEHAGIRTNARAEQLEVTEFIALANAKNT

SEQ ID NO: 11400 - protein, 498 aa, Mycoplasma penetrans HF-2
MKMIKKTKITATLGPSITGKIFTLADFNKPENKGVIETAKKNLAALFDAGVNVVRFNFSHGDYEEQTIRLNLVREVAKEKGVNISTMLDTKGPEIRVYKTSEKEVEIKSDSKVRIYTTKKEIGTSEKFSVLDSTGTYNMAKDVQPGNTIFVDDGKLKLEVISSNVEEGIIETIARNTWILRENKRINLPDSNYSIPFMSDKDRNDIIFAIKNKFDYIAASFVNTGDNVREIKKILKEHGGEHIQIISKIETMTGIKSLDDIIDESDSIMVARGDLGLEVPYYDVPTYEKYIIKDCRHKGKTVIVATQMLDSLETKIQPTRAEVTDVFFAVERGTDCTMLSGETANGMYPINAVEVMAKIDVSSENFFDYGRAIDVYFKETPFMKEKVGTLATTIATLVAPKRVIDNHGFDYSSIVVFGNDTRLIQALSNIRCAAPIFFVTDKKEYATRFGLNYGVFVKVVDNVEHAIANKTEIIDAINSQLPEVKKTVVVINDSIYKH

SEQ ID NO: 11401 - protein, 471 aa, Escherichia coli
MIIPIIMAGGSGTRLWPLSRSLYPKQFLSLINENSLLQETLKRLDGLNCLPPVIVSNNEHRFIVAEQLRQSGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDFIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHISHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 11402 - protein, 119 aa, Nostoc sp. PCC 7120
MTGNTSGQPMTQISVNELALYLANENADIQLIDVREPQELAIAQIDGFVNLPLSEYAQWSEKVPTMFNPEAETLVLCHHGVRSAQMCQWLVSQGFTNVKNIAGGIAAYSLLVDSSIPQY

SEQ ID NO: 11403 - protein, 399 aa, Bifidobacterium adolescentis
MPKALLLENIHPDAAQSLRDHGFEVECLKGALSEDELIDALEGVDLLGIRSKTSVTRKVIDARPTLTAVGCFCIGTNQVDLEYAGKNGIAVFNAPYSNTRSVVELVIGDIICLMRRIPAHTHHMKHGMWDKSASGSHEVRGKTLGIIGYGNIGSQLSVVAEALGMRVLFYDIEEKLAMGNAHRCDTLNELLEQSDVVTLHVDGRKSNTGFFGEDQFEHMKQDAIFINLSRGFVADLDALKKHLDSGHLSGAAVDVFPIEPKKTGDEFLTDLADEDNMILTPHIGGSTLEAQKSIGQFVSQRLEDYWFKGSTMLSVNLPQITLSDIKSNFRIAHLHANLPGVLARVNRVLGEDGINIAAQALGTEGEIGYVVTDVAQRPDQRALDQLASIEGTIRMRVIS

SEQ ID NO: 11404 - protein, 469 aa, Aspergillus nidulans FGSC A4
MISCTTPLMKNADDDETGDIGIENKYYNAKQIKVDNPEEAIDEFLGVPALEQDKGDWELLTYVKSAVTRNYSEKSINNMLDYIEKGSDDEKAYQCMEEFYSLTLNSFQNTNNERLWLKTNIKLARLWLERREYGQLSKKVRELHRACQREDGSDDPSKGTYLLELYALEIQMYAETKNNKRLKALYQRALRVRSAVPHPKIMGIIRECGGKMHMSEENWEEAQSDFFESFRNYDEAGSMQRIQVLKYLVLTTMLMKSDINPFHSQETKPYKTDPRISAMTDLVDAFQRDDIHAYEEVLSKNPDVLADPFIAENIDEVSRNMRTKAILKLIAPYTRFTLSFISKHIKISVTEAQDILSFLILDKKLNAKIDQESGTVVVESASDVERLRSVEEWNESLRTLWQVTLKDGDGFKNDDVSQPTGIGMRGPLLYQSGLDDDTAGLLRSSGHRFRRGGKGSKAGGGLGMKTGLF

SEQ ID NO: 11405 - protein, 468 aa, Pseudomonas syringae pv. tomato str. DC3000
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIYSEQGSWMSDQDVEGGNKGHRPGIKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDIALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 11406 - protein, 332 aa, Phytophthora infestans
MNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 11407 - protein, 105 aa, Brassica napus
MSAINITNVSVLDNPAPFVSPFQFEISYECLTSLQDDLEWKLVYVGSAEDETYDQTLESVLVGPVNVGNYRFVLQADPPDPSKIREEDIIGVTVLLLTCSYMGQE

SEQ ID NO: 11408 - protein, 308 aa, Shewanella violacea
GTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 11409 - protein, 590 aa, Triticum aestivum
  misc_feature (117)..(117): Xaa can be any naturally occurring amino acid
  misc_feature (156)..(156): Xaa can be any naturally occurring amino acid
  misc_feature (460)..(460): Xaa can be any naturally occurring amino acid
  unsure (1)..(590): unsure at all Xaa locations
MPKKSKKSKSKRVTLKAKHKVLRKVKEHHRKKRKEAKKDGRSGKSKIEKDPGIPNEWPFKEQELKNLEVRRAMAIKEQEDKKEARRERARKRKLGLPDDEDMANDNDAAEADCCFSXVPKTNDHSERAFYKELVKVIEASDVILEVLDARDPLGTXRCVDMEKMVRKADPTKKIVLLLNKIDLVPKESVEKWLSYLREELPTVAFKCNTQEQRTKLGWKSSKLDKTSNIPQSSDCLGAENLIKLLKNYSRSHELKLAITVGIVGLPNVGKSSLINSLKRSRVVNVGSTPGVTRSMQEVQLDKKVKLLDCPGVVMLRSASSGVSVALRNCKRVEKMEDVITPVKEILGLCPQEKLLSLYKVPSFTSVDDFLQKLATLRGKLKKGGIVDVEAAAKIVIHDWNEGKVPYFTLPPKRDVVEDANAVIITEDGSEFNVDEIYKAESSYISGLKSMEEFSHIEIPXNAPPEIDEAMLEDPPTQSAPVKDESMSDVNDREGSKAAASGGTQHDKLYTAEGILDPRKKKAEKKRRKGNKFSVLNDMDADYDFKVDYQMKDASPADDEDGDGGKGEGEEPKGEDDKKDAPAAECEPMTS

SEQ ID NO: 11410 - protein, 522 aa, Zea mays
MNTLRRNKVRSQSEFSEDELVSSVLMKNGKKVVCGTPSGALLLYSWGYFNGCWYTMEGAGRDANPLSGYRIGKTLGIGSFGKVKIAEHILTGHKVAIKILNRKKIRSMDMEEKVKREIKILRLFMHPHIIRLYEVIDTPADIYVVMEYVKSGELFDYIVEKGRLHEEEARHFFQQVAFLHITMFIPKIAQCIAITVLKNCSMIISGVEYCHRNIVAHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIRLPRYLAVPPPDTAQQVKKVDEETLNDVIKMGFDKNQLIESLQNRLQNEATVAYYLLLDDRLCTTSGYLGSDFQESMDSSFSQVITETPTSATELQQHVFTEGTFGCLPLPCFAWLSIKIHRLVGLLPVSVLALSRIFIASPSDLKPLSAAGKPGLAERGEASWPHKPTKRA

SEQ ID NO: 11411 - protein, 72 aa, Triticum aestivum
  misc_feature (26)..(26): Xaa can be any naturally occurring amino acid
  misc_feature (34)..(34): Xaa can be any naturally occurring amino acid
  unsure (1)..(72): unsure at all Xaa locations
FSLEKQFEPMEKLFYRLVARTNQLEXRRPKKKFXVQKVMEENVRLRAMVDKKDAQLQAISDQCKFMVFNRPN

SEQ ID NO: 11412 - protein, 271 aa, Staphylococcus epidermidis RP62A
MKLVFYGAGNMAQAIFTGIINSNNLNANDIYLTNKSNEQALKSFAEKLGVNYSYDDEALLKDADYVFLGTKPHDFENLANRIREHITNDNRFISIMAGLSIDYIRQQLNTNNPLARIMPNTNAQVGHSVTGISFSNNFDPKSKNEVDELINAFGSVIEVSEEHLHQVTAITGSGPAFLYHVFEQYVKAGTELGLERNQVEESIRNLIIGTSKMIERSDLSMSQLRKNITSKGGTTQAGLDALSQYDIVSMFEDCLGAAVNRSMELSHKEDE

SEQ ID NO: 11413 - protein, 195 aa, Glycine max
EHIAMVKGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQILRDLGVRSMKLMTNNPAKYVGLKGYGLTISGRIPLVSLITKENKRYLETKRVKMGHVYGSEFNSKLNHQDTGNGKANSDDDSNAAAGL

SEQ ID NO: 11414 - protein, 379 aa, Glycine max
  misc_feature (77)..(77): Xaa can be any naturally occurring amino acid
  misc_feature (86)..(86): Xaa can be any naturally occurring amino acid
  misc_feature (94)..(94): Xaa can be any naturally occurring amino acid
  unsure (1)..(379): unsure at all Xaa locations
MSSTLAAIFGGAAGAVALVGIAIILIWFCLSRQRNVSRTSETGSSDPSQVGRHGAMELPIRDTRRFEMEELSLATRXFSDKNLIGXGKFGEVYXGLLQDGMLVAIKKHRGLASQEFVDEVRYLSSIHHRNLVSLLGYCQENNLQFLIYEYVPNGSVSSHLYGAGQQPREKLEFKHRLPIAQGAAKGLAHLHSLSPRLVHKNFKTANVLVDENFIAKVADAGLRNFLGRVDIAGSSSQVATDEIFLASEVREFRRFSEKSDVYSFGVFLLELLSGKQATESPFPDSNQNLVEWVLSNQDRGMMSYIIDRRLESSFTAEGMEEYIMLIIRCLDPSSERRPAMSYVEMELVRILDKEMNLTTIMGEGTPTVTLGSQLFKSTK

SEQ ID NO: 11415 - protein, 433 aa, Pinus taeda
MRVEELGGILKPASDLEAAANAKEKLKEKHQLPKESNRMVKHGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 11416 - protein, 314 aa, Glycine max
  misc_feature (304)..(304): Xaa can be any naturally occurring amino acid
  unsure (1)..(314): unsure at all Xaa locations
MWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKKXLWDFSMDLTK

SEQ ID NO: 11417 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 11418 - protein, 434 aa, Bacillus cereus E33L
MVYLNDKLSETKVFKDPVHKYVHVRDRVIWDLIGTKEFQRLRRIKQLGTTFFTFHGAEHSRFTHSLGVYEIIRRMIDDVFDGRPNWNAEDRLLCLCAALLHDVGHGPFSHSFEKVFSLDHEKFTQKIIVGDTEINRVLSRVDKDFPQKVADVIAKTSTNKLAISMISSQIDADRMDYLLRDAYFTGVKYGNFDMERILRVMRPYGNQVVIKNSGMHAVEHYIMSRYQMYWQVYFHPVTRSAEVILTKILHRAKSLHEKYYTFKNHPVHFYSLFEEEVTVEDYLKLDENVMYYYFQVWQDEEDPILSDLCRRFMNRNLFKYVEFTDKHGLDNWMELSSLFKKIGLDPEYYLVVDSTSDLPYDFYRAGEEEERLPILLLMPNGELRELSRESDIVEAITGKKRRDQKLFYPHDLIYEDGRKGKYKERIIELLEGEK

SEQ ID NO: 11419 - protein, 453 aa, Nitrosomonas europaea ATCC 19718
MPFIPHTEEDVAEMLTSIGARSIDELFDEIPAELKTGKLTQVPPGLSEMEISRLMYERAQQDGFYLSFIGAGAYEHHIPAAVWQITTRGEFYSSYTPYQAEASQGTLQLLYEYQTMMASLAGMDVSNASLYDGASALAEAALMAVRQHRTSRRILVPQTVHPVYRSVMRTIVRNQAIEVVEVPYDPATGQVAIDKLDQFAQEEFAALIIPQPNFFGVLEQVDALTDWAHDKQSLAVAVVNPTSLAMLKPPGEWGRRGADIAVGEGQPLGIPLSSGGPYFGFMTCKQELVRQMPGRIIGRTTDLEGKEGFALTLQAREQHIRRSKATSNICTNQGLMVTAATIYMSLLGPEGLYRVAAHSHANTVALVEQLEKLPGVKKAFHSPFFHEAALQLSVPADKVLNRLKAQGVLGGVLLENHYPDLKNTLLVCATETKTAEDLDKYTEVLRQALAASA

SEQ ID NO: 11420 - protein, 483 aa, Nitrosomonas europaea ATCC 19718
MLIFEHSRKNRRNYSQAPATRPAKNNIPDHLKRKSTPLLPEVSEMDTVRHYTRLSQKNFSIDTEFYPLGSCTMKYNPRACNSLAMLPQFLSRHPLAPEDTGQGFLACMYELQEILKDITGMAAVSLTSMAGAQGELIGITMIRAYHEAHGDTGRTEIIIPDAAHGTNPATAVMCGYKVIEIPTNRDGDVDMDALKAAVGPKTAGLMLTNPSTLGVFEKKVAEMSRIVHAAGGLLYYDGANLNAVLGKVKPGDMGFDVIHMNLHKTFSTPHGGGGPGAAPVGVAERLLPYLPVPIVAHEQGVYRWLTEEDRPQTIGRLSAHMGNAGVLLRAYIYVRLLGAEGMHRISEYATLNANYLMAELRKLGFEIAYPNRRASHEFIVTMKEIKDRTGVTAMNLAKRLLDKGFHAPTTYFPLLVPECLLIEPAETESKETLDRFVAAMKEILDEIATQPDMVKAAPHDMPLRKIDDVKAARELDLVWDPAG

SEQ ID NO: 11421 - protein, 445 aa, Bifidobacterium adolescentis
MDKQQEFALRTVEERDVRFIRLWFTDVLGTLKSVAIAPAELEAAFEEGLGFDGSAVEGLTRVSEDDMIVKPDPSTFQILPWRGGPQGTARMFCDVLTPDGEPSLGDPRHVLKQALAKAKEKGFTFYVHPEIEFYLFEKQDDWSRTPKPIDEGGYFDHVPRSPGMDFRRATVNMLEQMGISVEYSHHEAGPGQNEIDLRYADALTTADNIMTFRTVVKEISLERGIHASFMPKPLVDAPGSGMHTHLSLFEGDANAFYEAGQEFNMSVTARQFAAGILYHAAEICAVTDQYVNSYKRLWGGAEAPSYICWGHNNRSALLRIPQYKPGKGNSARMEFRALDPVANPYLAYSVLLAAGLDGIDKQMQLGEPTSDDVWELTDAERQAMGIQPLPESLDEALKIMEKSDFVADVLGEHAFEYFLRNKHQEWDEYRKQVTPFELKKYLPKL

SEQ ID NO: 11422 - protein, 305 aa, Ralstonia eutropha JMP134
MFIGVYAASPRPDVFSTLAMTTAPESQPASLQSWRIDADALRAALPQALQAWTLDLVEETGSTNADLTQACRQAPWSDAGTLRLAYRQTAGRGRQGRPWQGQAGLTFSVALPLALSPSRLSGLSLGVGLALAQALGDVEAALGARVGLKWPNDLQIDGRKLAGILIEAVPAGPQRVWAVIGIGLNLVRDAQMEVALGRELAGVAEAMPGFDAQRDATRLLAAVLARLGAMRDAFVAHGFAPMAAEWSARDAYRDQPVRLLHDGQVLAEGMARGVDGEGHLLLETPAGLERITSGELSLRPAGGAA

SEQ ID NO: 11423 - protein, 514 aa, Escherichia coli O6
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 11424 - protein, 453 aa, Mycobacterium sp. JLS
MTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAEVNLDEECRRLTMRSLGRSILGLDLDAKADVIAGPLPVAAGYAADRALKPVRAPRWLPTPQRRRANAAVATMKAVTNDILQACRADPTRDAPLVHALINASDPETGRSLSDDDICNELLVFMLAGHDTTATLLTYALWALGHHPDIQDRVAAEAYALGDRLPTPDDVGRLGYTVQVLNESLRLCPPAAGVGRLALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 11425 - protein, 286 aa, Symbiobacterium thermophilum IAM 14863
MIQWFPGHMAKARRILQENAPLVDVVLEIVDARCPLASRNPDLMALVAHKPQVLILNKADLADPAATRLWVERLNEPGRPAVALDAVRGTGAREVLAAIRRAFAPVLRAWTAKGRKPRPARVMAVGIPNVGKSSAINRLVGARRAPVGDKPGVTRGKQWIRIGKDVELLDMPGILVPKFEDQRDGLLLAATGAIKDEVFDQREVANHLLHLIWESLGAAVAERYGLTRLDPEPVANLEAIGRFRGLLRAGEQVDLDAAAQLVLREFREGRLGRVTLQPPDPPPGGE

SEQ ID NO: 11426 - protein, 250 aa, Corynebacterium efficiens
MVMTNGKLILLRHGQSAWNASNQFTGWVDVDLTTIGEAEAKRGGELLVENNVLPDVVYTSLLRRAIRTANLALDAADRHWIPVVRDWRLNERHYGALQGLNKAETKDKYGDEQYMAWRRSYGTPPPELADDAEYSQAGDVRYKDLESVPRTECLKDVVERFIPYFEEEILPRVKKGENVLIAAHGNSLRALVKHLDNISDDDIAELNIPTGIPLVYEITPEGTVVNPGGTYLDPEAAAAGAAAVANQGGK

SEQ ID NO: 11427 - protein, 148 aa, Flaveria bidentis
MEQTFIMIKPDGVQSGLVGEIIGRFEKKGFSLKGLKLLTVDRAFAEKHYADLSSKPFFNGLVEYIVSGPVVAMVWEGKNVVTTGREIIGATNPAESAPGTIRGDFAIDIGRNVIHGSDAVESARKVIGLWFPEGVANWSSSLHPWIYE

SEQ ID NO: 11428 - protein, 294 aa, Serratia marcescens
IVFRAAQERSDIEIVAINDLLDAEYMAYMLKYDSTHGRFNGTVEVKDGHLVVNGKTIRVTAEKDPANLKWNEVGVDVVAEATGIFLTDETARKHITAGAKKVVLTGPSKDATPMFVRGANFDKYAGQDIVSNASCTTNCLAPLAKVINDNFGIVEGLMTTVHATTATQKTVDGPSHKDWRGGRGASQNIIPSSTGAAKAVGKVIPELKGKLTGMAFRVPTPNVSVVDLTVRLEKPATYEEIKKAMKDAAEGSMKGVLGYVEDDVVSTDFNGEVLTSVFDAKAGIALNDNFVKLV

SEQ ID NO: 11429 - protein, 148 aa, Flaveria bidentis
MEHTFIMIKPDGVQRGLVGEIIGRFEKKGFSLKGLKLLTVDQAFAEKHYADLSAKPFFNGLVEYIISGPVVAMVWEGKNVVTTGRKIIGATNPAESAPGTIRGDFAIDIGRNVIHGSDAVESAKKEIALWFPEGVANWSSSLHPWIYE

SEQ ID NO: 11430 - protein, 294 aa, Serratia odorifera
IVFRAAQERSDIEIVAINDLLDAEYMAYMLKYDSTHGRFNGSVEVKDGHLVVNGQTIRVTAEKDPANLKWNEVGVDVVAEATGIFLTDETARKHIAAGAKKVVLTGPSKDDTPMFVMGVNLKSYAGQEIVSNASCTTNCLAPLAKVINDKFGIVEALMTTVHATTATQKTVDGPFHKDWRGGRGASQNIIPSSTGAAKAVGKVIPELNGKLTGMAFRVPTPNVSVVDLTARLEKPASYKEVCAAIKEAAEGELKGVLGYTEDDVVSTDFNGEKLTSVFDAKAGIALNDNFVKLV

SEQ ID NO: 11431 - protein, 203 aa, Oryza sativa
MRASRPVVHPVEAPPPAALAVAAAAVAVEAGVGAGGGAAAHGGENAQPRGVRMKDPPGAPGTPGGLGLRLVQAFFAAAALAVMASTDDFPSVSAFCYLVAAAILQCLWSLSLAVVDIYALLVKRSLRNPQAVCIFTIGDGITGTLTLGAACASAGITVLIGNDLNICANNHCASFETATAMAFISWFALAPSCVLNFWSMASR

SEQ ID NO: 11432 - protein, 142 aa, Brassica napus
TAAKAIVEAGIAVMGHVGLTPQAISVLGGFRPQGKTVDSAIKVVETALALQEAGCFSVVLECVPAPVAAAATSALKIPTIGIGAGPFCSGQVLVYHDLLGMLQHPHHAKVTPKFCKQFGNVGDVINKALSEYKQEVEAQAFP

SEQ ID NO: 11433 - protein, 144 aa, Lycopersicon esculentum
FIMIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 11434 - protein, 213 aa, Cytophaga hutchinsonii ATCC 33406
MPILVIVRHGQSEWNLKNLFTGWSDVELTPTGEHEAEYAGIVLRPYHFDIAFTSVLKRAIHTLSIILNQTGATIPIIENEALNERNYGDLQGLNKAEVGEKYGAQQLIAWRRSYTEVPPGGESLENTCQRVIPYYQEKIEPELKDGRNVLIVAHGNSLRALMMHLEKISPEDIAHVDLATGAPRLYEFSSKLDLNSVSYIKLPETPLDVSTLL

SEQ ID NO: 11435 - protein, 399 aa, Brassica napus
MASSSATLFKASPVKSDWLKGQSLLLRQPSSVSPFRSHVAPSALTVHAASAYADELVKTAKTIASPGRGILAMDESNATCGKRLASIGLENTEANRQAYRTLLVSAPGLGQYISGAILFEETLYQSTVDGKKMVDVLVQQNIVPGIKVDKGLVPLVGSNDESWCQGLDGLASRTAAYYQQGARFAKWRTVVSIPNGPSALAVKEAAWGLARYAAISQDSGLVPIVEPEIMLDGEHCIDRTYEVAEKVWSEVFFYLSQNNVMFEGILLKPSMVTPGAESKDRATPEQVASYTLKLLRSRVPPAVPGIMFLSGGQSELEATLNLNAMNQGPNPWHVSFSYARALQNTCLKTWGGREENVKAAQDTLLTRAKANSLAQLGKYTGEGESEDAKEGMFVKGYTY

SEQ ID NO: 11436 - protein, 149 aa, Staphylococcus epidermidis RP62A
MERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 11437 - protein, 182 aa, Glycine max
MSMAMVHPSVHPIEAPPMTEHAIAIAMPRHTLKDTQGMPGTLGGFLLRFAQFSFALVSLSVMATTSDFPSVTAFRYLVAAVSLQSLWSLSLGVADMYAILVRRGYRNVRIVRLFSIGDGITSTLTFFAACASAGITVLIGNDLNDCAQNHCSRFETATAMAFMSWFAASPSFILNFWTLASK

SEQ ID NO: 11438 - protein, 183 aa, Panax ginseng
MASSVISSATVAAVSRAVPAQASMVAPFTGLKSTAAFPVTRKVNDITSLPSNGGRVQCMKVWPPLGLKKFETLSYLPQLTQEQLSKEVDYLLRSGWVPCLEFELEHGFVYREHHHSPGYYDGRYWTMWKLPMFGCTDSSQVLKEVEECKKEYPNAYIRIIGFDNVRQVQCISFIAFKPPSAST

SEQ ID NO: 11439 - protein, 428 aa, Synechococcus sp. WH 8102
MNTSRSQAIFGAAQGLMPGGVSSPVRAFKSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKALFAENPDAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGSYEKLTATTEKLIAGIKEAATAAGLPFTGGSVSAMFGFFLCEGPVRNFEDAKATDSERFGKLHRAMLERGVYLAPSAFEAGFTSLAHSEADIEATVNAFRESFAEVA

SEQ ID NO: 11440 - protein, 236 aa, Triticum aestivum
  misc_feature (141)..(141): Xaa can be any naturally occurring amino acid
  misc_feature (144)..(144): Xaa can be any naturally occurring amino acid
  misc_feature (162)..(162): Xaa can be any naturally occurring amino acid
  misc_feature (176)..(177): Xaa can be any naturally occurring amino acid
  misc_feature (187)..(188): Xaa can be any naturally occurring amino acid
  misc_feature (193)..(193): Xaa can be any naturally occurring amino acid
  misc_feature (195)..(195): Xaa can be any naturally occurring amino acid
  misc_feature (202)..(202): Xaa can be any naturally occurring amino acid
  misc_feature (206)..(206): Xaa can be any naturally occurring amino acid
  misc_feature (210)..(210): Xaa can be any naturally occurring amino acid
  misc_feature (212)..(212): Xaa can be any naturally occurring amino acid
  misc_feature (219)..(219): Xaa can be any naturally occurring amino acid
  unsure (1)..(236): unsure at all Xaa locations
MDHAADAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIRTIFGXYMXKEPRHRDSGRKLLQPGKXMIAAGYCMYGIPAXXVLNTGNVSTXXLDPLXGXFNNDHPXTKYXERKXYXVNEGTQXWPEINPRWYTNPNNELF

SEQ ID NO: 11441 - protein, 475 aa, Bartonella henselae str. Houston-1
MVVKNGKQIKSKGSKLVSDFLKNLRGVDNWEQVSQWLAFRNVEDIECITPDQAGVPRGKMMLSKKFTSKTSLALPSAVFMATISGDYPEDGHGFEYPKTDGDLRLEPDLSTLSIVPWEEAPTAQVICDLVYQNGEVVDYTPRNVLRTVIDFYTQMGLKPVVSPEIEFYLVQKNPDPDYPLVPPVGRSGRSIGGGQGYSIAGVNEFDDLIDDIYHFSEAQGLEIDTLIHEEGAGQFEINLRHGDPIELADQVFMFKRTIREAALKHNMYATFMAKPIQGQPGSAMHIHQSVVDKKTGMNIFTQKDGKESVCFRHFIGGLQKHMAGVFVMLAPYVNSYRRLVPDLSAPVNLRWGYDNRTTAFRVPRSAPKGRRVENRLPSSDANPYLALAASLVCGLIGLQQKLEPDEPTTKNVNADNIELPRGLIEAVNLFEQDTAVRAILGEVFVSTYAAIKRQEFETFMEVISPWEREYLLLNV

SEQ ID NO: 11442 - protein, 303 aa, Bacillus licheniformis ATCC 14580
MYMLMKVVPRNLFVLCEDGKVFLFLEGGIKMKRIGFIGAGSMAEAMIKGLVKSGAMEPEAIFVTNQSNTARLRELSETYGVCGEADTAKVAARSDTLVLAMKPKDAAGGIAALRPYLRKEQLLISVLAGIPIHTIQHYAGLELPVVRAMPNTSAAIQKSATAFAASPLVTKEQMQEAADLFATVGSVTIVEESALDAVTAVAGSGPAFVYRFVEALQASAAELGLPEKTAKQLIIDMMAGAAQMLETGRDPSVMRKEITSAGGTTEAGLRMLDDHQFEQTVISCVKEAANRSAELRDMFAAKI

SEQ ID NO: 11443 - protein, 498 aa, Escherichia coli
MHTDSNGGHYILRFDNERKTNQRRRIMETNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 11444 - protein, 148 aa, Brassica rapa subsp. pekinensis
MGIIRKKHNKKSRRPSFKSVLTSILATQAAIFLLLLAGVSLAGTAVAFIASMPLFVVFSPILVPAGVATGLLATGLAAAGSSGAMAVSLILWVFKRVTGKEPPKIMSKVLRKVFPGGGTHLNWQQNQKPSQRRPAAAPSAAPAAAPST

SEQ ID NO: 11445 - protein, 441 aa, Brassica napus
MVGAKPIENGSDGGASTGLLHGRYELGRLLGHGTFAKVYHARNVTTGKSVAMKVVGKEKVVKVGMVDQIKREISVMRMVKHPNIVELHEVMASKTKIYFAMELVRGGELFAKVAKGRLREDVARVYFQQLISAVDFCHSRGVYHRDLKPENLLLDEEGNLKVTDFGLSAFTEHLKQDGLLHTTCGTPAYVAPEVILKKGYDGAKADLWSCGVILFVLLAGYLPFQDDNLVNMYRKIYRGDFKCPGWLSSDARRLVTKLLDPNPNTRITIDKVMDSHWFKKSSTRSRNEPVAATPEAEEDVDVSVHKSKEETETLNAFHIIALSEGFDLSPLFEEKKKEEKMEMRFATSRPASSVISSLEEAAKVGNKFDVRKSECRVRIEGKQNGRKGKLAVEAEIFAVAPSFVVVEVKKDHGDTLEYNNFCSTALRPALKDIFWTSTTPA

SEQ ID NO: 11446 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPIAKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 11447 - protein, 246 aa, endosymbiont of Riftia pachyptila
VCQGLISGRSGALRRDLYYFFAPRGDAPTTELNMPRRTKIVATLGPATDDPKVMDKLIHAGVDVVRLNLSHDPHDQQRERAERIRDRSRASGRQVGVLCDLQGPKIRIGRFKSDFVMLEEDGAFILDAECPLTDGDDERVGLTYPDLINDVARGDTLLLDDGAIVLWIAEVEGKQVHCKVVVGGKLSNNKGINKQGGGLSAPALTEKDKQDIKFAAEIDADYLAVSFVRCADDVRRGTSPAGGGRW

SEQ ID NO: 11448 - protein, 112 aa, Prochlorococcus marinus str. MIT 9312
MPKIENKPWGTFENILDETYCKVKRIIIKPGERPSYQYHYKRSEHWIIVSGSAKVTLEGEEKEFSVGDYIYIPLKAKHRVENIGKNDLIFIEIQTGQYFGEDDIVRVSNDYV

SEQ ID NO: 11449 - protein, 320 aa, Hordeum vulgare subsp. vulgare
MASAKATMGQGEQDHFVLKSGHAMPAVGLGTWRAGSDTAHSVRTAITEAGYRHVDTAAEYGVEKEVGKGLKAAMEAGIDRKDLFVTSKIWCTNLAPERVRPALENTLKDLQLDYIDLYHIHWPFRLKDGAHMPPEAGEVLEFDMEGVWKEMENLVKDGLVKDIGVCNYTVTKLNRLLRSAKIPPAVCQMEMHPGWKNDKIFEACKKHGIHVTAYSPLGSSEKNLAHDPVVEKVANKLNKTPGQVLIKWALQRGTSVIPKSSKDERIKENIQVFGWEIPEEDFKVLCSIKDEKRVLTGEELFVNKTHGPYRSAADVWDHEN

SEQ ID NO: 11450 - protein, 169 aa, Triticum aestivum
  misc_feature (43)..(43): Xaa can be any naturally occurring amino acid
  unsure (1)..(169): unsure at all Xaa locations
MAPTVMASSATSVAPFQGLKSTAGLPVSRRSNGASLGSVSNGXGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPG

SEQ ID NO: 11451 - protein, 320 aa, Bromus inermis
MASAKAMMGQERQDHFVLKSGHAIPAVGLGTWRAGSDTAHSVQTAITEAGYRHVDTAAEYGVEKEVGKGLKAAMEAGIDRKDLFVTSKLWCTDLVPDRVRPALEKTLKDLQLDYLDLYLIHWPFRLKDGAHKPPEAGEVLEFDMEGVWKEMENLVKDGLVKDIGVCNYTVTKLNRLLQSAKIAPAVCQMEMHPGWKNDKILEACKKHGIHATAYSPLCSSEKNLAHDPVVEKVANKLNKTPGQVLIKWALQRGTIVIPKSSKDERIKENIQVFGWEIPEEDFQVLCSIKDEKRVLTGEELFVNKTHGPYKSASEVWDNEN

SEQ ID NO: 11452 - protein, 312 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLDTMKSTSRESKREGRIVNLSSEAHRFSYPEGVRFDKINDKSSYSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 11453 - protein, 605 aa, Oryza sativa (japonica cultivar-group)
MGGGGGGGGRKDRGEGLGRALTRQRNKAAAAAKERGHALALARRARQPLESVIEVSDIDAVLQRAAEEYLLLGGGGGDGAGDVALSASLGSGLIDLDGTVETEEERRWLREEQEALHAGSLKVPRRPPWTPQMTVEELDANEKRAFLEWRRNLARLEENEKLVLTPFEKNIDIWRQLWRVLERSDLLVMVVDARDPLFYRCPDLEVYAQEIDEHKRTLLLVNKADLLPLNVRQRWAEYFKQHDILYLFWSAKAATADLEGKKLSSYSMENWNTADLDTKIYGRDELLVRLQGEAEYIVNQKGALRAEEGHESSRSDSVSTRPKHVVVGFVGYPNVGKSSTINALVGQKRTGVTSTPGKTKHFQTLVISEELILCDCPGLVFPSFSSSRHEMVACGVLPIDRMTKHRGAIQVVANRVPRNVLEQIYKITLPKPKAYEQLSRPPTAAELLRAYCTSRGHVSHAGLPDETRAARQILKDYLDGKIPHFELPPGDTDSETDPEETTDLEGSDTAVGATADHCASDEQDEEISQADPNISHVLSDLESFDLASEVSKNSTKKKKEASYKHHKKPQRKKDRSWRVGNDGADGSAVVRVFQKPAVNFATVTG

SEQ ID NO: 11454 - protein, 170 aa, Glycine max
MAHTKVDMGLVLVVMAMLCAGAAAQSQSSCTNVLVSLSPCLNYITGNSSTPSSGCCSQLASVVRSQPQCLCQVLSGGGSSLGININQTQALALPVACKVQTPPTSQCNNAAASPPTGTVAESPNSAPSGTGGSKNLPTTDNGSSSGNSIKLSIPLILILAATYVSTFTTY

SEQ ID NO: 11455 - protein, 468 aa, Acidithiobacillus ferrooxidans
MGYSPSDVVKLIQEKDIKFIDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPEFFVFDSVTWNIDMSGCAYKVDAEEAAWNSGKEYESGNMGHRLGVKGGYFPVPPVDSAQDLRSAMCLAMEEMGLKVEVHHHEVATAGQHEIGVGFNTLTPRRMRCKILKYVVHNVAAVRQTATFMPKPVVGDNGSGMHVHQSLGKDGKNIFAGDLYGGLSEIALYYIGGIIKHAKAVNALTNPSTNSYKRLVPHFEAPVLLAYSAKNRSASIRIPYVNSPKARRIEVRFPDSTANPYLAFSAMLMAGLDGIQNKIHPATAMDKNLYDLPAEEQANIPGVAASLEEALRALEADHDFLMKGGVFSESWLEGYLDVKWAEVQTLRVTTHPVEFQMYYSL

SEQ ID NO: 11456 - protein, 468 aa, Vibrio alginolyticus
MSVEKVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEESAEIPTVAYSLKDALAELDADREFLTAGGVFSDDFIDSYIELKSQDVERVNMTTHPVEFELYYSV

SEQ ID NO: 11457 - protein, 550 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 11458 - protein, 276 aa, Antirrhinum majus x Antirrhinum hispanicum
MALLTARPLNPAAIQCACFVILWIGLLCVNVGINGSGDLGEKLGANQRDFDYFQLALQWPGTFCRRTRHCCPNNGCCRGSNAPAEFTIHGLWPDYNDGSWPSCCTGKTFEEKEISTLLGDLNKYWPSLSCGSPSNCHGGKGLFWEHEWEKHGTCSSSVTGAEYNYFVTALKVYFKYNVTEVLREAGYVASNSEKYPLGGIVTAIQNAFHATPELKCSGDAVEELYLCFYKNFEPRDCATKSNKKSCPRYVSLPEYSSLKMANDGNEVSESALDSDI

SEQ ID NO: 11459 - protein, 300 aa, Oryza sativa
MRMALVRERAMVYGGGCDAEAFGGGFESSQMGYGHDALLDIDAAALFGGYEAAASAGCALVQDGAAGWAGAGASSSVLAFDRAAQAEEAECDAWIEAMDQSYGAGGEAAPYRSTTAVAFDAATGCFSLTERATGGGGGAGGRQFGLLFPSTSGGGVSPERAAPAPAPRGSQKRAHAESSQAMSPSKKQCGAGRKAGKAKSAPTTPTKDPQSLAAKNRRERISERLRILQELVPNGTKVDLVTMLEKAISYVKFLQLQVKVLATDEFWPAQGGKAPEISQVKEALDAILSSSSPLMGQLMN

SEQ ID NO: 11460 - protein, 349 aa, Leifsonia xyli subsp. xyli str. CTCB07
MLATIIHGERDVRLEEVPDPVLSTGGDAIVRVVATCVCGSDLWPYRGVTPTSQPRRIGHEFVGVVEAVGPEVATIEPGDFVIAPFYDCDMTCVNCENGVSASCLHGGWWGADDRSGAFADGGQGQKVRVPHADGSLVATPEYPREELIPSLLALSDVMGTGHHAAVSAGVRPGSTVVVVGDGAVGLCAVLASARLGASRIVAMSRHESRQALAREFGATDIVAERGDAGVAAVKGLLDGIGADCVLEAVGTKESMDQAIRSCRPGGMVGYVGVPNGGPELPVRPLFASNVGVNGGFAPVRNYVEELLRDVWSGAIEPGRVFDLQVPLSDIAEAYAAMDERRAIKALVRP

SEQ ID NO: 11461 - protein, 597 aa, Arabidopsis thaliana
  misc_feature (260)..(260): Xaa can be any naturally occurring amino acid
  unsure (1)..(597): unsure at all Xaa locations
MVEGRRRRRFSLSSQQLALLLLLLSFFLCFSVASPRAISDSDLLDETVANSSSSVASLNASSSSSLVKPKEGSFADIIDRALEKEFNESDQNEVADPGSFNNSVAGQQAVLETVARVKSTKKNETKEEKRFQLHDVFNLNNDNRAEDTPTLIDRKDNVFIISNSKSKYPVLQLDLRLISDLVVVIVSATCGGIAFACAGQPVITGYLLAGSIIGPGGLNFISEMVQVETVAQFGVVFLLFALGLEFSTAKLKVVRSVAVXGGLLQILLFMFLCGITVSLCGGKRSEGVFVGAFLSMSSTAVVLKFLMEKNSTNSLHGQVTIGILILQDCAVGLLFALLPVLEGNSGIVHGMLSIGKVVVLLLSFLAVLSILSRTCIPWLLKLMVSLSSQTNELYQLAAVAFCLLVAWCSDKLGLSLELGSFAAGVMISTTDLAEHTLEQIEPIRNLFAALFLASIGMLVNVHFLWTHVDILLPSVILGIFIKTPIVTTVVKGFGYNNKTALLVGISLAQIGEFAFVLLSRASNLHLIEGKLYLLLLGTTALSLVTTPLVFKMIPAVVHLGILLKWFSPDSTIEKGEIVRSESGKQRMILMSRQSHSS

SEQ ID NO: 11462 - protein, 923 aa, Lotus japonicus
MMELPATRILSQAVTCFLCLYIFIGSASATEGFESIACCADLNYTDPLTTLNYTTDYTWFSDKRSCRKIPETELRNRSNENVRLFDIDEGKRCYNLPTIKNGVYLIRGTFPFDSLNSSFNASIGVTQLGAVRSSRLQDLEIEGVFRATKDYIDFCLLKGEVYPFISQLELRPSPEEYLQDFPTSVLKLISRNNLGDTKDDIRFPVDQSDRIWKASSISSSAVPLSSNVSNVDLNANVTPPLTVLQTALTDPERLEFIHTDLETEDYGYRVFLYFLELDRTLQAGQRVFDIYVNSEIKKESFDVLAGGSNYRYDVLDISASGSLNVTLVKASKSEFGPLLNAYEILQVRPWIEETNQTDVGVIQKMREELLLQNSGNRALESWSGDPCILLPWKGIACDGSNGSSVITKLDLSSSNLKGLIPSSIAEMTNLETLNISHNSFDGSVPSFPLSSLLISVDLSYNDLMGKLPESIVKLPHLKSLYFGCNEHMSPEDPANMNSSLINTDYGRCKGKESRFGQVIVIGAITCGSLLITLAFGVLFVCRYRQKLIPWEGFAGKKYPMETNIIFSLPSKDDFFIKSVSIQAFTLEYIEVATERYKTLIGEGGFGSVYRGTLNDGQEVAVKVRSATSTQGTREFDNELNLLSAIQHENLVPLLGYCNESDQQILVYPFMSNGSLQDRLYGEPAKRKILDWPTRLSIALGAARGLAYLHTFPGRSVIHRDIKSSNILLDHSMCAKVADFGFSKYAPQEGDSYVSLEVRGTAGYLDPEYYKTQQLSEKSDVFSFGVVLLEIVSGREPLNIKRPRTEWSLVEWATPYIRGSKVDEIVDPGIKGGYHAEAMWRVVEVALQCLEPFSTYRPSMVAIVRELEDALIIENNASEYMKSIDSLGGSNRYSIVIEKRVLPSTTSTAESTITTQSLSHPQPR

SEQ ID NO: 11463 - protein, 313 aa, Glycine max
MWLFGRKGASGFSSSSTAEQVTEGIDGTGFTAIVTGASSGIGTETTRVLALRGVHVIMGVRNMLAAKDVKETILKEIPSAKVDAMELDLSSMKSVRKFASEFKSSGLPLNILINNAGIMACPFSLSKDKIELQFATNHIGHFLLTNLLLDTIKKTSRESKKEGRIVNVSSEAHRFAYSEGICFDKINDESSYNNWRAYGQSKLANILHANELTRRLKEDGVDISANSLHPGTITTNLFRHNSAVNGLINVIGRLVLKNVQQGAATTCYVALHPQVKGISGKYFSDSNLAKTTAQGTDSDLAKKLWDFSMDLTK

SEQ ID NO: 11464 - protein, 314 aa, Stanieria cyanosphaera PCC 7437
NGFGRIGRLVFRAGLNNPNIEFVGINDLVPPGNIAYLLKYDSTHGRFAGTVESQSDGIVVNGKFIPCVSIRNPEELPWSKYGVEYVVESTGLFTTHETASKHLTAVQKRVVISAPTKDPERVKTLLVGVNHQTFDPSKDTIVSNASCTTNCLAPIAKVINDNFGLAEGLMTTVHAMTATQPTVDGPSKKDFRGGRGAAQNIIPASTGAAKAVTLVLPELKGKLTGMAFRVPTPDVSAVDLTFRTEKATSYQEICAAMKQAAEGEMKGILGYTEEPVVSTDFTSDPHSSIFDAGAGIELNSNFFKVVAWYDNEWG

SEQ ID NO: 11465 - protein, 482 aa, Deinococcus radiodurans R1
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 11466 - protein, 313 aa, Fischerella muscicola UTEX 1829
NGFGRIGRLVFRAGITNPNIEFVGINDLVPPDNLAYLLKYDSTHGIYKGKVEAKDNGIIVDGHFVPCVSMRNPAELPWGKLGADYVVESTGLFTNYEGAANHLQAGAKRVVISAPTKDPDRVKTLLMGVNHQLFDPAKDTVVSNASCTTNCLAPIAKVINDNFGLTEGLMTTVHAMTATQPTVDGPSKKDWRGGRGAAQNISLSTGAAKAVALVLPELKGKLTGMAFRVPTPDVSVVDLTFKTAKATSYQEICAAMKAAATGELKGILGYTDEEVVSTDFQGDTHSSIFESGAGIELNSNFFKVVAWYDNEWG

SEQ ID NO: 11467 - protein, 169 aa, Helicosporidium sp. ex Simulium jonesii
ARGGAQELFGIQPDLTTMGKIIGGGLPVGAYGGRSDIMSLVAPAGPMYQAGTLSGNPLAMAAGLKTLQQLTPAVYVHLDMISRRLVDGLAKVAKSTGHDLYTSSVPGMFGFFFCRGPVHNFEEAKRADTVKFAKFFNGMLDQGIYLAPSQFEAGFTSFSHSIEDIDRTS

SEQ ID NO: 11468 - protein, 334 aa, endosymbiont of Riftia pachyptila
MTIKVGINGFGRIGRMAFRAIAKDFAGDIEVVGINDLLDADYLAYMLKYDSVHGNFDGDIAVDGSNLLVNGKNIRLTAERDPANLAWGDIGADLVIECTGFFLTEETCQKHIDAGAKKVVMSAPSKDGTPMFVHGVNHETYEGQAIVSAASCTTNCLAPVAKVLNDKWGIKRGLMTTVHAATATQKTVDGPSMKDWRGGRGILENIIPSSTGAAKAVGVVLPELNGKLTGMAFRVPTSDVSVVDLTVELEKDASYDDICAAMKEASESGPMSETLGYTDEKVVSTDFRGCGNSSIFDAGAGIALDGTFIKVVSWYDNEYGYTCNMLRFVKHVSA

SEQ ID NO: 11469 - protein, 431 aa, Vibrio vulnificus YJ016
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 11470 - protein, 90 aa, Zea mays
MAGPAKASWMVAMSVGAVEALKDQAGLCRWNYALKSIHRAAKAKANVRAGGSQSTKQLPASTAALVERRRAEKAEEALRTVMYLSCWGPN

SEQ ID NO: 11471 - protein, 510 aa, Pseudomonas syringae pv. syringae B728a
MTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 11472 - protein, 496 aa, Phaseolus vulgaris
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLVCNTTYTFFHFNMKPRKVESRIINEKLQMQGNSLESQSHFLIFGGGTRQCPGKELGIAEISTFLHYFVTRYRWEEVGGDKLMKFPRVVAPNGLHIRVSSFSN

SEQ ID NO: 11473 - protein, 434 aa, Raphanus sativus
MKGVRKTYNNSYTLSFLLAFFVFILFRLAFSINTLSSTESLTISSNRTLVSPGDVFELGFFRTNSRWYLGIWYKKLSERTYVWVANRDNPLSNSIGTLKISGNKLVILGHSNKSVWWTNITRGNESSPVVAELLANGNFVMRDSNNNSASGFLWQSFDYPTDTLLPEMKLGYDLRKGLNRFLASWRSSDDPSSGDFLYKLETGRIPEFYLSSGIFRLHRSGLWNGIRFSGIPEDQKLSYVVYNFTENREEVAYTFRMTNNNIYSRLTLSYSGYIERQTWNPSLGIWNVVWSFPLDSQCDVYRMCGPYSYCDVNTSPICNCIQGFNPSNVEQWDLKSWSGGCIRRTPLSCSRDGFNRMKNVKLPETTMAIVDRSIGVKECEKRCLSDCNCTAFANADIRNGGTGCVIWTGALEDIRTYFAEGQDLYVRLAAADLV

SEQ ID NO: 11474 - protein, 250 aa, Zea mays
  misc_feature (24)..(24): Xaa can be any naturally occurring amino acid
  misc_feature (57)..(57): Xaa can be any naturally occurring amino acid
  unsure (1)..(250): unsure at all Xaa locations
RVAANRSKAFPLGCVNKVAGGGTXIPPPSRLVGLGRGPLSLMSQAQSIYKSTFSYCXPSFRSLTFSGSLRLGPTSQPQRVKYTQLLRNPRRSSLYYVNLVAIRVGRKVVDLPPAAIAFNPSTGAGTIFDSGTVYTRLAKPVYEAVRNEFRKRVKPTTAVVTSLGGFDTCYSGQVKVPTITFMFKGVNMTMPADNLMLHSTAGSTSCLAMAAAPENVNSVVNVIASMQQQNHRVLIDVPNGRLGLARERCS

SEQ ID NO: 11475 - protein, 436 aa, Raphanus sativus
MKGVRKTYDNSYTLSFFLLFFVFILFRPAFSMNTLSATESLTISSNKTLVSPGNVFELGFFRTNSSSRWYLGIWYKKLTNRIYVWVANRDNPLSSSTGTLKFSGNNLVLLGDSNKSFWTTNFTRGNGDLRWVAELLANGNFVMRDSNNNDSSGFLWQSFDFPTDTLLPEMKLGYDLKKGLNRFLISWRSSDDPSSGEYSYKLEPRSFPEFYVFSDDIRVHRSGPWNGIQFSGIQEDQKSSYVVYNFTENGEEVAYTFQMTNNSIYSRLIISSAGYFQRLTWNPSSETWNMFWSSPASLQCDPYMVCGAYAYCDVNASPMCNCIQGFDPRNMEKWNLRSQSSGCIRKTRLSCSGDGFTRMKNMKLPETTMATVDRSIGVKECEKRCLSDCNCTAFANADIRNGGTGCVIWTGELEDIRTYVADGQDLYVRLAAADLV

SEQ ID NO: 11476 - protein, 223 aa, Campylobacter coli RM2228
MIFAANLKCNHTRSSFKIYANILNQYLEAKNDDIIVFPPSIAFLENELNFIQGAQNFYPCVNGAFTGELGKEHLDEFGIKCVLIGHSERRALGDENLIKAKFDFAKEHAYKIVFCIGEDLKLKNSNQTLDFLKKQLEVIDLDYKNLIIAYEPIYSIGSGVSAKKEDIAKVLEFLSSLTQAPLLYGGSVNEDNIKDILNIKHCSGVLIGSAALKAENFIKLIKG

SEQ ID NO: 11477 - protein, 436 aa, Raphanus sativus
MKGVRKTYDNSCTLSFLLVFFVLILFRSAFSINTLWSTESLTISNSRTLVSPGNVFELGFFRTTSSSRWYLGIWYKKVSERTYVWVANRDSPLSDSNGTLKITGNNLVILGHSNKSVWSTNLTRINERSPVVAELLANGNFVMRYFNKIGASGFLWQSFDFPTDTLLPEMKLGYDLKKGLNRFLTSWKNSDDPSSGEISYKLDTQRGMPEFYILKDGLRSHRSGPWNGIRFSGIPEDQKSSYMVYSFTENSEEVAYTFRMTNSSIYSRLKISSEGFLERWTTLESIPWNLFWSAPVDLKCDVYKTCGPYSYCDLNTSPLCNCIQGFMPSNVQQRDLRDPSGGCIRRARLSCSGDGFTRMRNMKLPETTMAIVDRSIGVKECEKRCLSDCNCTAFANADIRNGGTGCVIWTGELEDIRTYLADGQDLYVRLAAADLV

SEQ ID NO: 11478 - protein, 332 aa, Campylobacter coli RM2228
MAVKVAINGFGRIGRCVARIISKRDDIELVAINDTTDIELTKYLFKYDTVHGEFEGSVENEGDDLIINGKKIKVFKSRDIKELDFAKYGAQIVLECTGAHLTIEKCQGFLDMGVQKVIMSAPAKDDTPTYVLGVNSQNYKGENIISNASCTTNCLGPVCRVLQDDFGIEKGLMTTIHAYTNGQSIIDAKTKDKRRSRAAAQNIIPTSTGAAKAMKLVMPELNGKLHGQSMRVPVIDVSSVDLTAQLSKKVSKEELNEAFRKAAATNLKGILMVDDDERVSSDFITCSYGAVVVSDLTQVIADDFVKVVAWYDNEWGYSSRLVDMAVYIANKA

SEQ ID NO: 11479 - protein, 439 aa, Raphanus sativus
MKGVRKTYDNSYTSSFLLVFFVLVLVHPAISMYINTLSATESLTISSNRTLVSPGDVFELGFFRTTSSSRWYLGMWYKKFSERIYVWVANRDNPLSNSIGTLKISGNNLVLLDHSNKSVWSTNFTRGNERFPVVAELLANGNFVMRDSNNNDASGFLWQSFDYPTDTLLPEMKLGYDLKKGRNRLLTSWRNSDDPSSGDYSYKLEPRRLPEFYLLQGDVRAHRSGPWNGIEFSGIPEDQKLSYMVYNFTENSEEVAYTFRMTNSSFYSRLTISSEGYLERLTWAPSSAVWNVFWSSPNHQCDTYRICGPYSYCYVNTSPSCNCIQGFNPENVQQWALRISISGCKRRTRLSCSGDGDGFTRMKNMKLPETTMAIVDRSIGVKECKKRCLSNCNCTAFANADIRNGGTGCVIWTGQLDDMRNYVADGQDLYVRLAAADLV

SEQ ID NO: 11480 - protein, 296 aa, Rhodococcus sp. RHA1
MSEAEVPPVARGQAALLGPAEVRALAEEFGVRPTKQLGQNFVHDANTVRRIVATAGVGREDTVLEVGPGLGSLTLALLDVVDKVIAVEIDPNLAARLPVTVADRAPELADRLTVVGADAMRVKPSEIPGEPTALVANLPYNVAVPVLLHLFSELPSLRTALVMVQAEVADRLAASPGSKIYGVPSVKANFFGAVRRAGAVGRAVFWPVPKVESGLVRIDRYAEPPWPVDDAHRRRVFAVIDAAFAQRRKTLRAALGGWAGSPAEAERRLLEAGIAPSARGETLDAAAFVRLAATQP

SEQ ID NO: 11481 - protein, 438 aa, Raphanus sativus
MKGVRKTYDNSYTCFLLVFSGLILLHPALSMYFNTLSSTESLTISSNRTLVSPGNVFELGFFTPESSSRWYLGIWYKKLSERTYVWVSNRDNPLSSSIGTLKISNMNLVLLDHSNKSVWSTNLTRGNERSLVVAELLANGNFVVRYFNNNDTSGFLWQSFDYPTDTLLPEMKLGYDHKTGLNRFLTSWRNSDDPSTGEISYFLDTQTGMPEFYLLQSGARIHRSGPWNGVRFSGIPGDQELSYIVNNFTENSEDVAYTFRMTNKSIYSRLKTSSEGFLERLTWIPNSITWNMFWYLPLENQCDFYMICGPYAYCDVNTSPLCNCIQGFNRSNEERWAMQDWSSGCIRRTRLSCSGDGFTRMKKMKLPETTMAVVDRSIGVKQCRKRCLSDCNCTAFANADIRNGGTGCVIWTGELEDIRTYLADGQDLYVRLAAADIG

SEQ ID NO: 11482 - protein, 201 aa, Cicer arietinum
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 11483 - protein, 274 aa, Magnetospirillum magnetotacticum MS-1
MSQVVQTRRLQAVDLIKRKAEGRKIIALTAYHAHTANIVDAYCDFVLVGDSLGMVMHGMESTLPVTLEMMILQAQAVMRGTSRALVVVDMPFGSYEASREQAFLNAARVLKETGAGAVKLEGGARFAETVAFLTERGVPVMGHIGLTPQSVNTMGGFKVQGHGAGDEERLRADARAISDAGAFSIVLEGIVEPVARAIAGDPAIRAATIGIGATAACDGQILVLEDMLGLSDRVPRFVKSFGSLRTQIEEAVRAYADEVRAGRFPAEDHTYPPR

SEQ ID NO: 11484 - protein, 314 aa, Lyngbya aestuarii PCC 7419
NGFGRIGRLVMRSAIKNPEIEFVAINDLVPAENLAYLFKYDSTHGKLESQVEAKDDHIIVDGHSIRCTSVRNPDQLPWKEMGVDYVVESTGLFTTYDGASNHLSAGAKRVIISAPTKDPDKVKTLLMGVNHEEFNPQDHLIVSNASCTTNCLAPVAKVIQDNFGLAEGLMTTVHSMTATQPTVDGPSKKDFRGGRGAAQDIIPASTGAAKAVTLVLPELKGKLTGMAFRVPTPDVSVVDLTFKTEKSTSYKEICAAMKAASEGPMKGVLGYTEDPVVSTDFITDSHSSIFDADAGMELNSNFFKVVSWYDNEWG

SEQ ID NO: 11485 - protein, 340 aa, Magnaporthe grisea 70-15
MSAATKQDTKQDDATDLSREYDTPLGLAHTTMQALKDRIKLHYDLASDYYLSLWGQHVHHGYWPTDESKAKDTKEVAQTNLIDLLLEISKIPEGGSVLDVGCGLGGTTRHLASKLGCSVTGITISGKQVEIAKRLTKTEAEAEATKLGKDVAAAKAEVEEDADGFMKVGKGKVRFIELDAETMGEYFSGKDAFDAVWICEALSHFPNKELFFQNVHAVLKPGGCLTLADWFKAEGLTQKQFDDDIKPIEDGMLTPPLNTQAGYVDKAKAAGLKVLTEPKDISQDVKQTWDITWSLIQKPSLWAFALSQGRDGIAFLQSFRAMRRGYANNNFRYAVMSFEK

SEQ ID NO: 11486 - protein, 392 aa, Synechococcus sp. WH 8102
MPRPPELSARAVGLKPSLTLAIGAQAKALQQAGRDICSLSAGEPDFDTPDFIVEATRQALRDGITRYGPAAGDPELRAAVAEKLSSGNGIAITPEQVLITNGGKQAIYNLFQVLLNPDDEVLLPAPYWLSYPEMAALAGAKVKLIPTQAEEGFRLDLAAVEAAISPRSRLLLLNSPGNPTGRVMKRQELEDVAELVRRHPQLLVMSDEIYEFLLAEGEQHHSFAAIAPDLADRCFTVNGFAKGWAMTGWRLGYLAGHQDVIKAAAALQSQSTSNVCSFAQRGALAAIQGPRACVSAMAESYNRRRQLLTEGLQAIEGITLVEPRGAFYAFPQLPESAGGSMDFCSRALEQAGLAVVPGLAFGNDRCIRLSCAVSRETIRDGLSRLTQLLDET

SEQ ID NO: 11487 - protein, 101 aa, Arabidopsis thaliana
MEMKLLFTSAFTQMFGYSNHMDQASNCQSTRNKIIKMMKKEEFPSGFQVPLHYPKYSKSDYEVMDDLRLDLLLKQYGFSFEGSLEDKRVFAIGSFLWPDQL

SEQ ID NO: 11488 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 11489 - protein, 265 aa, Mycobacterium tuberculosis
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRGGVPRGAAALEHHHHHH

SEQ ID NO: 11490 - protein, 597 aa, Penicillium minioluteum
MGSISEISQSTAAPKQSRMAAWWKESTVYQIYPASFKDSDGDGVGDLKGIISKLDYIQTLGVDIVWLNPIFSSPQVDMGYDISDYYDIHPPYGTMEDVNVLADGLQKRGMKLLMDLVVNHTSDQHPWFQDAISSVSNPRRDWYIWKKPIIDKDGKPQPPNNWRSYFGGSAWEYDDRSGEYYLHLFAKEQPDLNWENVEVRKAVHRIIRFWLDKGVHGFRMDVINFISKDQSFPDGAIVSDSKWQNGSAHYACGPRLHEYLQEIGAILKEYNAFSVGEMPEVNDCDEIIKAVGFERGELNMIFHFEIVNLDHGENDKITPKNWNMQELKSVVSKWQKFMLENDGWNALYLENHDQPRIVSRFGSDQPEYRELSAKMLAAFLGFQSGTLFIYQGQELGMPNVPRHWGIDQYRDIETLNHWKEVVSEGLADPIVSLGEYRLKSRDNARTPMQWDGSANAGFSTSTPWISVHDDYTTLNAAAQLADKHSVYHFWSTILGLRKAFPDVLVYGSSTSFPVSIRICSATCECQIAAEWRLLSSTFARGLSHGPPLQFSKIKSGGIVLSNYPGRRSLKCISEEPLNLEPLETFLWLEDMEESSRL

SEQ ID NO: 11491 - protein, 288 aa, Corynebacterium glutamicum ATCC 13032
MGVSPLKRAFRRDPTTLASMNVDISRSREPLNVELLKEKLLQNGDFGQVIYEKVTGSTNADLLALAGSGAPNWTVKTVEFQDHARGRLGRPWSAPEGSQTIVSVLVQLSIDQVDRIGTIPLAAGLAVMDALNDLGVEGAGLKWPNDVQIHGKKLCGILVEATGFDSTPTVVIGWGTNISLTKEELPVPHATSLALEGVEVDRTTFLINMLTHLHTRLDQWQGPSVDWLDDYRAVCSSIGQDVRVLLPGDKELLGEAIGVATGGEIRVRDASGTVHTLNAGEITHLRLQ

SEQ ID NO: 11492 - protein, 315 aa, Triticum aestivum
IEQVCTKKQAGTGPEFPGYRRPTRPRDHTAARRQSRRGQHTEREERGERDRRGDHHRRAEMLAVFDQTVAKCPEGLRSPPAAGGGGTAAGGGGGAAALMKGFADANDAAVTVSLGAAGALAYSSANKNPLVPRMFGSVNDIFCLFQGHVENIGNLKQHYGLSKTANEVTILIEAYRTLRDRGPLPASQVVRDLSGRFAFILYDTVSKSTFVAADADGSIPFFWGVDSEDHLVFSDDNELLKAGCGNSFAPFPKGCFYTTSGGLQSFEHPLNELKAVPRVDSQGQMCGSTFKVDSEAKKDSGIPRVGSAADWSNHY

SEQ ID NO: 11493 - protein, 442 aa, Corynebacterium efficiens
MVDMSASPSGTSANVSRSIEWFEKAKMFTPGGVNSPVRAFGSVGGQARFIDRAHGSTLIDVDGNEYVDLVCSWGPMLMGHAHPAVLEAVQKTIVDGLSFGAPTIGEVELAQDIINRTSVEEVRLVNSGTEATMSAVRLARGYTQRPKILKFDGCYHGHVDSLLASAGSGVATFALPDSPGITGAQTRDTIVVPYNDIEAVRAAFAEFPGQIACIISEAAAGNMGTVAPQDHFNEHLLAIAHADGALLILDEVMTGFRTSYRGWFGVDKVRADLVTFGKVVSGGLPAAAFGGRAEIMNMLAPQGPVYQAGTLSGNPVAVAAGRASLSAATEEVYRTIDANADRLHGLISDALTREGVAHHIQRASNMLSIRFAEGEGHNFTDMKNADTFRFAPFFHALLDHGVYAPPSVFETWFVSSALTDDDFQKIDDALVPAARAAAAATA

SEQ ID NO: 11494 - protein, 352 aa, Oryza sativa
MAHAAAATGALAPLHPLLRCTSRHLCASASPRAGLCLHHHRRRRRSSRRTKLAVRAMAPTLSSSSTAAAAPPGLKEGIAGLYDESSGVWESIWGEHMHHGFYDAGEAASMSDHRRAQIRMIEESLAFAAVPDDAEKKPKSVVDVGCGIGGSSRYLANKYGAQCYGITLSPVQAERGNALAAEQGLSDKVSFQVGDALEQPFPDGQFDLVWSMESGEHMPDKRQFVSELARVAAPGARIIIVTWCHRNLEPSEESLKPDELNLLKRICDAYYLPDWCSPSDYVKIAESLSLELQLDMVCTSTCVPCRFAFSQEILAWWKTIRGAMVMPLMIEGYKKGLIKFTIITCRKPETTQ

SEQ ID NO: 11495 - protein, 265 aa, Wigglesworthia glossinidia endosymbiont of Glossina brevipalpis
MKKTNIYDLYKLKEQNKKFASITAYDATFANLFFKKGIRTILVGDSLGMTIQGHSSTVPVKIDEMMYHTKCVRRGAPSCLIISDLPFMSYNNINDALNNSKKLIQSGANIVKLEGGLWVSDIIHELNTRSIPVCGHIGLTPQSINMQGSYKIQGRNNNDAIRLMEEAISIEESGAKLLVLECIIQKLSNNITKKLNIPTIGIGSGKKTDGQILVMQDVLGITIEGKIPSFSKNFTKNKFGIEKAIELYIEEVENELFPSENHSFN

SEQ ID NO: 11496 - protein, 288 aa, Raphanus sativus
DEFMNEVTLIARLQHINLVQILGCCIDADEKILIYEYLENLSLDSYLFGKTQSPKLNWKERFDITSGVARGLLYLHQDSRFRIIHRDLKVSNILLDKNMIPKISDFGMARIFARDETEASTMKVVGTYGYMSPEYAMNGIFSEKSDVFSFGVIVLEIVTGTRNRGFYNLNYKNNFLSYAWSNWREGRALEIVDPVILDSLSPLTLTFQRQEVLKCIQIGLLCVQELAEDRPTMSTVVWMLGSEATEIPQPKPPDYCVGKSPYETASKQLDDDESWTVNQYTCSVIDAR

SEQ ID NO: 11497 - protein, 669 aa, Burkholderia pseudomallei K96243
MISPLEMTLLLLLASVVGVVVFRSLNLPPMLGYLTVGILVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSKDLAMSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPLLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIICGYGRAGQNLARMLEQEGIAYVALDLDPDRVTAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDARYSLLRGYFHGADDADDDDHEQVRLQSVPVDARADAVGRSLSELGLFALGLEVTAIRRHGIRGVEPDPETKLRASDIVVLRGLPEALAQAEERLSRHRREGGSAAVA

SEQ ID NO: 11498 - protein, 288 aa, Raphanus sativus
DEFMNEVTLIARLQHINLVQIIGCCIEADEKILIYEYLENLSLDSYLFGKTQRPKLNWKERFNITNGVARGLLYLHQDSRFRIIHRDLKVSNILLDKNMTPKISDFGMARTFTRDETEANTMKVVGTYGYMSPEYAMYGKFSEKSDVFSFGVIVLEIVSGKKNRGFNYGNNLLSYAWSHWKEGRALGIVDPVIIDSLPSLPLKFGQEEVLKCIQIGLLCVQELAEDRPTMSSVVWMLGSEATEIPQPKPPCHCFERSPYELDPSLSRQCYDDESWTVNQYTCSLIDAR

SEQ ID NO: 11499 - protein, 835 aa, Geobacter metallireducens GS-15
MIQKKRGKTVHIPGLTDLPPLPRDVPSLMEDFRHYYTYNLGRDKFCRSVHYHYKALALAVRDRLMEDWKNTRYAYLDADCKRGYYLSLEFLMGRALGNAMLNLGVTDTAAKALMDLGIAMEDLAEAEVDAGLGNGGLGRLAACFLDSCATLQLPVMGYGIRYEYGMFRQRIVNGHQVEEPDHWLRNGNPWEIERQEYTQRVCYGGRTERYGTGDGGFRVRWVDTHDVLAIPYDTPVPGYSNGTVNTLRLWKSVATDAFNLVEFNAGSYTESVAAKNEAENITMVLYPNDASESGKALRLRQQYFLASASLQDVIERWVVISKGDFSGFAEKNCFQLNDTHPSCAVPELMRLLMDEQGMGWDEAWGITTRTMAYTNHTLLPEALEKWPLSLFAQLLPRLLEIILEINARFLAEVASRWPGDHERLRRMSLIEEGPVPQVRMAYLAIVGSFSVNGVAALHSQLLAQGLFRDFHELWPHKFNNKTNGVTPRRWLAWCNPGLSRLITETIGDGWVSDLSRIGKIAAFADDPGFREKWREVKRANKERLAAMVLDKCCVAFDPEALFDVQVKRIHEYKRQLLNILHVIHLYDRIKRGDTEGWTNRCVLIGGKAAPGYFMAKLIIKLTSNVAQVVNADPQVGDRLKVAFLPNYRVTAMEVVCPGTDLSEQISTAGKEASGTGNMKFMMNGALTIGTLDGANIEIREEVGDANFFMFGLTAEEVEAARRGYDPGAIIEADADLGRVMNLLAFGHFNLFEPGIFDPIIGAITSPHDPWMVAADFRSYVNAQQRVAAAYRDREQWARMSIINSASSGKFSTDRTIREYNDGIWGLQPVPVLAAR

SEQ ID NO: 11500 - protein, 291 aa, Raphanus sativus
DEFMNEVTLVARLQHVNLVQILGCCIDADEKMLIYEYLENLSLDSYLFGENRRSKLNWKERFDITNGVARGLLYLHQDSRFRIIHRDLKVSNILLDKNMTPKISDFGMARIFAREETEANTMKVVGTYGYMSPEYAMHGIFSEKSDVFSFGVIILEIITGKRNRGFYNLNYENDLLSYAWSNWKEGRALEIVDPVIIDSFSPLSSTYQPQEVLKCIQIGLLCVQDLAENRPTMSFVVWMLGNEATEIPQPKWPGYCVRRSPYELDPSSSRQCDDDESWTVNQYTCSVIDAR

SEQ ID NO: 11501 - protein, 235 aa, Burkholderia thailandensis E264
MTLLMTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEAAINGWPGVVTVGLFAQRGADLCLLGTEHGVETLRYAAR

SEQ ID NO: 11502 - protein, 387 aa, Triticum aestivum
MAMVTAKLSSPAAARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQKALLVRAKANSLAQLGSYTGEGESDEAKKGMFQKGYTY

SEQ ID NO: 11503 - protein, 345 aa, Zea mays
VAPSLCDCVRVRVRVRSGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 11504 - protein, 400 aa, Frankia sp. EAN1pec
MRRRMATARGTVMARGTATARHTGGGPGRAGVPGVTRASTVSTEPGTAPQTTPGTTCSSPSGIRAPGGSPPSPTRCSGRSRARGATGESGGTSRAARVITFIGVVAVGCGGHRSEGKCSVVGSSVVAIVGAGRLGGALMSGLLRAGRTPSEVVAAERDPGRAAEITRRYGVEVVDPATAAAKAGVVVLATKPQDMGTVLAQLAPHVAPGALVVSVAAGITSAFVAERLAPGTPVVRVMTNTPLLVGEAMSAVCAGPGAGDEHVAAVEEMLRPVGRVVRVTETQLDAVTALSGSGPAYFFYLIEAMIEGGVLLGLPRALAAELVVQTAAGSARMLRDPGAGDSDGAGGAAGEHPSLLREAVTSPGGTTVAALRQLDRGGVRAAVLDAVVAAWTRSRELGAS

SEQ ID NO: 11505 - protein, 734 aa, Eremothecium gossypii
MVGRRKMGAEARRSGDSGGSGGSGEPQTATSGEKRELGGVGLLDWGADTILRRFAAEPEYIKVLARKKGARCFRRLFVAQELQPPVDSPLHANHSSQSLGQAAPAGDKARSVWLLRFSKDGKYLASGGKGRQLCVWKVIASPMERWNLLPVYGGDKHHSNTLSLLNQQLLKYSGKRTEAVPAPGPERKEIPFDLEQQYAPVFHPDPHRVFGEHLQDILDCDWSKNSFLLTASMDKTVKLWHINRTTSLKTFVHPDFVTCVRFHPHDDRFFFSGCLDHTVRTWSILEGEVAEAFNCGDLIMALDVSPDGNWLLIGTFNGYVHVLHTNGLKLLHSFHLLQKPNETENRPRHGPKITGVEFIRHKAYPWLGLLITSNDSRVRLFDMSTTRLLEIFRGFSNESSRISAHHLEMEDGESVVLSASENHWLYTWMLHHEEYMYSHSDLDNARTVPSPIDGKDPKKHSIRNIFRRSISFNSDILSESNPVARHHFPLFHHKAQHKGGCVKNSEYITFHAHHNPVTAATIAPKETTHVLSLSDDIICELNMKFGGEALEHLRTKSIREPGSPAGRSDHKRNHSAEKNYSQSTAKQNVGTIIVSAAATGQIRVFRTDVSSSVRAKALEAIRAAHGLPGSPERPLKPVLSALAHPLSAGVAKGKHICGDNRSAPSTTCPRCAPSAVNGQQDESASTAEQSTSSPKPTCDVCGGQKLSVVGKKTALQKTKSLYCLECGNHINRFK

SEQ ID NO: 11506 - protein, 540 aa, Campylobacter upsaliensis RM3195
MGDFLEIFLITSGLAVLLNVFFKKFEIPTIIGYILVGIIISYAYGFNGGAELSHIAEFGIVFLMFTIGLEFSFTHLMAMKKEVFLNGSLQVTICGLVCFLLVLGILGLGGKVGIIVGFALALSSTAVVLKILNDSGDIKEQYGRKALGILLFQDIAVIPLLLLVDIFSSNNQNITQLILTTLISVVILLTLLYLIGKYLIDRIFRFVIRASSNELFILTILFIVMGASFLAHYFGFSYSLGAFIAGVLIAKTKYKYKIEADLVPFRDLLLGLFFISVGMQINFKVVFENWDLILLLTLLVELLKFGVIFGILVIYNKKQVAIKTAFSIAQIGEFALAIFSLLQAKNMLDGQTTQILIVLSIITMILTPFILNNIRRISNAVEDIMQTQEVTQPQAVNSTLKNHIVIFGYGVIGQEVVQKIKNSGVPYLVLENDLNLVELGLSRGENVYFANAAQEETLKIANIEECAVAIITISNEARLTMLYQALESYKDIDIVIFTNSDSKKLFYSKIDKNVEIVQTERVLARALISAALEKRINKNA

SEQ ID NO: 11507 - protein, 389 aa, Synechocystis sp. PCC 6803
MRLTQRVSQVVPSITLEITAKAKAMRTEGIDVLSFTAGEPDFTTPPHIVEAAKLALDEGKTRYGPAAGEPALRQAIAKKLREKNNLPYEAANILVTNGGKHSLFNLMLAMIEQGDEVIIPAPYWLSYPEMVRLAEGTPVIVNTTAATDYKITPEQLRQAITSKSKLFVLNSPSNPTGAVYTPAEIRALAAVILEYEDLYVVSDEIYERILYDGTEHLSIGAVNDEIFQRTIISNGFAKSYSMTGWRVGYLAGELPLIQACSTIQGHSTSNVCTFAQYGAIAALENPQTCVETMVKAFTERRQVIVEGINQIAGLSCPNPKGAFYVFVDIAKTGLNSLEFSARLLESHQVAVIPGAAFGADDCVRFSYATDMDTIKQGLAELERFVSTLA

SEQ ID NO: 11508 - protein, 456 aa, Zea mays
MADGGAASRGPPDGSPPAALLLLQQPLLHAYEARKDPAACGREAHGHGFGLDPDGGGGGGASFVRTCFNGLNGLSGVGLLSIPYALSEGGWLSLALLLLVAAVCCYTGLLLQRCMDASPAVRGYPDIGALAFGRGGRLAASAFLYAELYLVAIGFLILEGDNLDKLFPGTSLSLGLRGAALVVSGKQLFVVLVALVILPTTWLRSLGVLAYVSASGVLASAVVVVCVLWTALADGVGFRARGRMLNVSGLPTALGLYTFCYCGHAIFPTLCISMKEKKRFSRVLVICFAACTLNYASMAILGYLMYGDDVKSQVTLNLPEGKVVSKLAIYTTLINPFSKYALMVTPLATAVEEKLLAAGRGGKSRSVSVLVRTLLVVTTVVVALAVPFFGHLMALVGSLLSVMASMLLPCIFYLKIFGAARCGRAEVALVATIIVLGSVVLATGTYASVKKIVQDY

SEQ ID NO: 11509 - protein, 402 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSEDEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVEKGLYDGKVLKAIEYEDICKIFH

SEQ ID NO: 11510 - protein, 241 aa, Zea mays
  misc_feature (228)..(228): Xaa can be any naturally occurring amino acid
  unsure (1)..(241): unsure at all Xaa locations
MAAGTISRIRLENFMCHSSLHIELDKHVNFITGQNGSGKSAILTALCVAFGCRAKNTQRAASLKDFIKTGCSYAAITVDINNHGEDAFKPEVYGDTIILERRITESASSTVLKDQHGRKVAHRKDGLNEITEHFNIEVENPCVIMSQDKSREFLHSGNDKDKFKFFFKATLLQQVNDLLATIRDNLNIAASIVEELEASIRPALRELDEIQEKIKNMEHIEEIAHEIXNLNKKLAWVWGYD

SEQ ID NO: 11511 - protein, 339 aa, Corynebacterium efficiens YS-314
MIITEGVDSFVFPHRSGPRVGLCRIFHVFGAVGFDFFDTVQGVAPRCVEHEGPRGIFPILAPMKTIVITGASDGIGAAAARIISTACPEDRLVLVGRNPGKTEGVAKQLDAEWHTADYADLDQVRRLAGELAALDRIDVLANNAGGIFAGPKKTVDGFELTWQINVVAPYLLTNLLMPVLLESRASVVATSSNGALFAKFDESDPNTFKGFTSDRAYGNAKLGNILFTKELHRRYHSAGMNAVAFHPGIISSNFGQEDAGLLGRMFQSPVSRFFSTPEFGGENLAYHIAGVPGIHWESGRYYDEKRRPGRQRAIAHDLDVARRVFDDMAASLEVEWPEG

SEQ ID NO: 11512 - protein, 315 aa, Rhodococcus sp. RHA1
MPSDYPVVPKRHAKVHILRQRGTSGPGPRLDSLMGFNNAQSPVPTVTLNDGNSIPALGFGVWQVPDDESHAAVIEALKAGYRSIDTAKIYENETGVGRALADSGIARDELFVTTKLWNEDQGYDSTLRAFDASLNRLGLDYVDLYLIHWPEPSADRYVDTFKAFQKIKADGRARSIGVSNFTPETLDRLIAETGEVPAINQVELHPRFNQADLRAFHTGKGIATEAWSPLGQGTVLEDESIAKIAAAHGKTTAQVIIRWHLQIGNVVIPKSVTPERIAANFDVFDFELTPDEINTVGSLTRADGRIGPDPDTLGA

SEQ ID NO: 11513 - protein, 291 aa, Raphanus sativus
DEFMNEVRLVARLQHINLVRILGCCIDADEKMLIYEYLENSSLDSFLFGKKRSSNLNWKDRFDITNGVARGLLYLHQDSRFRIIHRDMKVSNILLDKNMIPKISDFGMARIFAREETEANTKKVVGTYGYMSPEYAMNGIFSEKSDVFSFGVIVLEIVSGKRSRGFYNLNHENNLLSYAWSHWTEGTALEIVDPIIIDSSSSLPSTFQKKEALKCIQIGLLCVQERAEHRPTMSSVVWMLGSEATEIPKPNPPGYYVGRCSYENNPSSSRLCDDYESWTVNQYTCSVIDAR

SEQ ID NO: 11514 - protein, 249 aa, Zymomonas mobilis subsp. mobilis ZM4
MTIRKLIAGNWKMNGSLGMLHELDGIAKATFNHPELDVVICPSFTLIAPAIVRQPDMTFGAQDCHYDESGSHTGCVSAPMLREVGASYVIVGHSERRIEQNETNEEIRAKTTTAIANGLVTIVCIGESRAAHASGQALPIIGAQLDGCIPPDATSDNLVVAYEPIWAIGTGNTPPPESIAEMHASIRDRLCLLLGSEGKKVRILYGGSVTGKNAEELMAIPDVNGTLVGGASLTAEQFVPIIEAGGRLA

SEQ ID NO: 11515 - protein, 289 aa, Raphanus sativus
DEFMNEVTLVARLQHKNLVQILGCCIDANEKMLIYEYLENLSLDSYLFGKTRRPKLNWKERFDITNGVARGLLYLHQDSRFRIIHRDLKVSNILLDKNMIPKISDFGMARIFAREETEANTMNVVGTYGYMSPEYAMHGIFSEKSDVFSFGVIVLEIVTGKRNRGFNNLNYEHNLLNYAWSNWKEGRAIEIVDPDIVDSLSPLSSTFQPQVIKCIQIGLLCVQERAEHRPTMSSVVWMLGSEVTEIPQPKPPGYCVRSSYELDPSSSRQCDDDQSWTVNQYTCSVIDAR

SEQ ID NO: 11516 - protein, 291 aa, Raphanus sativus
DEFMNEVRLIARLQHINLVRILGCCIDADEKLLIYEYLENSSLDSYLFGKKRSCKLNWKHRFDITNGVARGLLYLHQDSRFRIIHRDMKVSNILLDKNMIPKISDFGMARIFGRDTSEASTRNVVGTYGYMSPEYAMYGVFSEKSDVFSFGVIVLEIVSGKRSRGFYQLNNDNNLLSYAWSHWTEGRALEIVDPVIVDSLSSLPSTSQPKEVLKCIQIGLLCVQERAEHRPTMSSVVWMLGSEATEIPQPKPPVYRLAKSFYANNPSSSRHCEDNESWTVNQYTCSVIDAR

SEQ ID NO: 11517 - protein, 453 aa, Rickettsiella grylli
MPFVPHTDVEIQEMLATLGVHTIDDLFDEIPPHLKTIEFSQIPSGFTEMELTQIIEKRSQENKKGLCFIGAGAYEHYIPAAVWEITSRGEFLTAYTPYQAEASQGSLQLIYEYQTMMARLTGMDYSNASLYDGATALAEAVLMAIRSNKKTHSIKILIPRTVHPHYRHTLQTIVTQQAIELIELDYCPEQGKILLSTLENDPKNDMCALVIPQPNFFGVLESVDELTDWAHSQNAFVIAVSNPLSLALLKEPGSWGTQGADIVCGEGQALGVPLAGGGPYFGFMCCKKPWLRQMPGRIVGRTRDKNNRPGFTLTLQAREQHIRRAKATSNICTNQGLLVTAATIYMSLLGSKGLQHVASLSHQRSRQLAALLTQLPEIEFIFNSPFFHEFVIRVPQPARDLLRELTTVGIHGGYDLSHHYPELGNALLVCATETKSQSDLKVYQHALLKLLSN

SEQ ID NO: 11518 - protein, 435 aa, Methanosarcina mazei Go1
MYPKQFLKFGETSLFQETVLRCLEVSDISEVFVVTNEAQKFFVIGQIKEAGYSIPPENILIEPEGKNTLPAIFFGMKEIEKKFGDSIVGVFSSDHVLDRAAMATISSAENLASDYLVTFGVVPTFPHTGYGYIKASEACSPGYRVSEFREKPDFETAKKYIEEGCLWNSGMFLFETRLFFEEARKHAPSVYGCFEKEGDINQIYECVDNISIDYGIMEKSDKVAVVRLDHKWSDLGNFAAIYDELEKDSVGNVIHDCDPMLLNSDGNLVYSRCGKIVSLIDVKDMVVVDTSDALLICPKSSSQKVKEIVSELKGRKDERAFIGQTVYRPWGSYTLLDASPGHKIKNITVLSDHKLSLQLHYHRSEHWVVVKGMACVEVDGKQFFLGPGESTFIRAGQKHRLSNPGKLPLEIIEVQLGELVDEEDIVRFDDVYGRR

SEQ ID NO: 11519 - protein, 288 aa, Raphanus sativus
DEFMNEVRLIARLQHINLVRILGCCIDADEKMLIYEYLENSSLDYFLFGKKRSSNLNWKDRFAITNGVARGLVYLHQDSRFRIIHRDMKAGNILLDKNMIPKISDFGLARIIARDQTEASTDNPIGTYGYMSPEYAMYGILSEKTDVFSFGVIVLEIVTGKRNRGFYQSTPEDNLVCYAWTHWAQGRALEIVDPVIVDSLSSTFQPKEVLKCIQIGLLCIQERAVHRPTMSSVVWMLGSEATAIPQPKPPVYCLIPSFYANNPSSSRPSDNDESWTMNEYTCSVIDAR

SEQ ID NO: 11520 - protein, 317 aa, Campylobacter coli RM2228
MKVFISTHPFGETSKIPLELLDKNGFEVRINNRGRKITSKELSKDIGEAEVLIAGTEKITEDVLRNAPNLKLISRVGIGLDGIDFELCRKYNIKVVYTPDAPTMAVAELCVGLILDLSRKISFTDANLKQGIWNRHMGMLLYGKTIGIIGMGRIGKSLIKLLSSFNVSFKVCDPNPDFAFLKIYNVELTNKTKLLKESDVVSLNLPLKKDTMNFLMLDDLKNMKKSSILINTARGGIINEDDLYIALKENLIAGAAVDVFEEEPYKGKLRELNNVVLTCHMGASTIESRTDMETQAVEEVVRYKNHIPLKNEVFKNE

SEQ ID NO: 11521 - protein, 495 aa, Erythrobacter sp. NAP1
MSKRDNTRIDPRGRKVKILATIGPASRSPEMLRKLFKAGADAFRVNMSHGEHADHAKAIASIRALEKEFARPIAILADLQGPKLRVGPFKDGQAVLRHSGHFTLDRDDTPGDETRVCLPHAELFGILERGQRLLINDGKIRLLVKEADEDKIFCTAEVGGVISDRKGVNVPDAEVPIPALTDKDKKDLAFAVEQGVDWIALSFVQRPADLAEARKLIASHAAGGHCPALCAKIEKPQAVGRLEEIIELSDAIMVARGDLGVELEPHEVPPLQKRIVAASRSAGKPVIVATQMLESMIESPMPTRAEVSDVANAVYDGADAVMLSAESAAGDWPEESVTMMHKIAAQVERDEGYRERIRMLDTPPDATTSDALAHSCMTIADTVPISAITVFTSSGSTARRVARERPGTPMLVLTPSMRTARRVALLWGAHAVVTRDIGSFEEMIAKGKRMALRHGFGTAGSKQVVLAGVPFGTPGATNLLHVVTLAGDELEKHRK

SEQ ID NO: 11522 - protein, 2406 aa, Arabidopsis thaliana
MGMVLFACLLLLIIFPTCGYAAINTSSPLSIRQTLSSPGGFYELGFFSPNNTQNQYVGIWFKKIVPRVVVWVANRDTPVTSSAANLTISSNGSLILLDGKQDVIWSTGKAFTSNKCHAELLDTGNFVVIDDVSGNKLWQSFEHLGNTMLPQSSLMYDTSNGKKRVLTTWKSNSDPSPGEFSLEITPQIPTQGLIRRGSVPYWRCGPWAKTRFSGISGIDASYVSPFSVVQDTAAGTGSFSYSTLRNYNLSYVTLTPEGKMKILWDDGNNWKLHLSLPENPCDLYGRCGPYGLCVRSDPPKCECLKGFVPKSDEEWGKGNWTSGCVRRTKLSCQAKSSMKTQGKDTDIFYRMTDVKTPDLHQFASFLNAEQCYQGCLGNCSCTAFAYISGIGCLVWNGELADTVQFLSSGEFLFIRLASSELAGSSRRKIIVGTTVSLSIFLILVFAAIMLWRYRAKQNDAWKNGFERQDVSGVNFFEMHTIRTATNNFSPSNKLGQGGFGPVYKGKLVDGKEIGVKRLASSSGQGTEEFMNEITLISKLQHRNLVRLLGYCIDGEEKLLIYEFMVNKSLDIFIFDPCLKFELDWPKRFNIIQGIARGLLYLHRDSRLRVIHRDLKVSNILLDDRMNPKISDFGLARMFQGTQYQDNTRRVVGTLGYMSPEYAWAGLFSEKSDIYSFGVLMLEIISGKRISRFIYGDESKGLLAYTWDSWCETGGSNLLDRDLTDTCQAFEVARCVQIGLLCVQHEAVDRPNTLQVLSMLTSATDLPVPKQPIFAVHTLNDMPMLQANSQDFLSVNEMTESMIQGSGGPMFEAAHEKSYLHYRKSELELCTLLQKMEKVLAATITRASPLSIGQTLSSPNGTYELGFFSPNNSRNQYVGIWFKNITPRVVVWVANRDKPVTNNAANLTINSNGSLILVEREQNVVWSIGETFSSNELRAELLENGNLVLIDGVSERNLWESFEHLGDTMLLESSVMYDVPNNKKRVLSSWKNPTDPSPGEFVAELTTQVPPQGFIMRGSRPYWRGGPWARVRFTGIPEMDGSHVSKFDISQDVAAGTGSLTYSLERRNSNLSYTTLTSAGSLKIIWNNGSGWVTDLEAPVSSCDVYNTCGPFGLCIRSNPPKCECLKGFVPKSDEEWNKRNWTGGCMRRTNLSCDVNSSATAQANNGDIFDIVANVKPPDFYEYLSLINEEDCQQRCLGNCSCTAFSYIEQIGCLVWNRELVDVMQFVAGGETLSIRLASSELAGSNRVKIIVASIVSISVFMILVFASYWYWRYKAKQNDSNPIPLETSQDAWREQLKPQDVNFFDMQTILTITNNFSMENKLGQGGFGPVYKGNLQDGKEIAIKRLSSTSGQGLEEFMNEIILISKLQHRNLVRLLGCCIEGEEKLLIYEFMANKSLNTFIFDSTKKLELDWPKRFEIIQGIACGLLYLHRDSCLRVVHRDMKVSNILLDEEMNPKISDFGLARMFQGTQHQANTRRVVGTLGYMSPEYAWTGMFSEKSDIYAFGVLLLEIITGKRISSFTIGEEGKTLLEFAWDSWCESGGSDLLDQDISSSGSESEVARCVQIGLLCIQQQAGDRPNIAQIYQRDMLKRLEKVALFSSYGYAAITTSSPLSIGVTLSSPGGSYELGFFSSNNSGNQYVGIWFKKVTPRVIVWVANREKPVSSTMANLTISSNGSLILLDSKKDLVWSSGGDPTSNKCRAELLDTGNLVVVDNVTGNYLWQSFEHLGDTMLPLTSLMYDIPNNKKRVLTSWKSETDPSPGEFVAEITPQVPSQGLIRKGSSPYWRSGPWAGTRFTGIPEMDASYVNPLGMVQDEVNGTGVFAFCVLRNFNLSYIKLTPEGSLRITRNNGTDWIKHFEGPLTSCDLYGRCGPFGLCVRSGTPMCQCLKGFEPKSDEEWRSGNWSRGCVRRTNLSCQGNSSVETQGKDRDVFYHVSNIKPPDSYELASFSNEEQCHQGCLRNCSCTAFSYVSGIGCLVWNQELLDTVKFIGGGETLSLRLAHSELTGRKRIKIITVATLSLSVCLILVLVACGCWRYRVKQNGSSLVSKDNVEGAWKSDLQSQDVSGLNFFEIHDLQTATNNFSVLNKLGQGGFGTVYKGKLQDGKEIAVKRLTSSSVQGTEEFMNEIKLISKLQHRNLLRLLGCCIDGEEKLLVYEYMVNKSLDIFIFDLKKKLEIDWATRFNIIQGIARGLLYLHRDSFLRVVHRDLKVSNILLDEKMNPKISDFGLARLFHGNQHQDSTGSVVGTLGYMSPEYAWTGTFSEKSDIYSFGVLMLEIITGKEISSFSYGKDNKNLLSYAWDSWSENGGVNLLDQDLDDSDSVNSVEAGRCVHIGLLCVQHQAIDRPNIKQVMSMLTSTTDLPKPTQPMFVLETSDEDSSLSHSQRSNDLSSVDENKSSEELNASS

SEQ ID NO: 11523 - protein, 337 aa, Thermus thermophilus HB8
MKTYALVMAGGRGERLWPLSREDRPKPFLPLFEGKTLLEATLERLAPLVPPERTLLAVRRDQEAVARPYADGIRLLLEPLGRDTAGAVLLGVAEALKEGAERLLVLPADHYVGDDEAYREALATMLEAAEEGFVVALGLRPTRPETEYGYIRLGPREGAWYRGEGFVEKPSYAEALEYIRKGYVWNGGVFAFAPATMAELFRRHLPSHHEALERLLAGASLEEVYAGLPKISIDYGVMEKAERVRVVLGRFPWDDVGNWRALERVFSQDPHENVVLGEGRHVALDTFGCVVYADRGVVATLGVSGLVVAKVGDEVLVVPKDWAREVREVVKRLEAQE

SEQ ID NO: 11524 - protein, 440 aa, Picrophilus torridus DSM 9790
MQEDEGFYLERLKADKIDFLQIQFTDITGHLKSLTVPKNRFEDVLYDGITFDGSSIPGFKPIENSDMKAMPDLSTYTIISQNSLGKTARFISKIFNPDGTRFDGDPRYVLERQIDRLKKENKHFYIGPEIEYFIFKRDDKNRPTVIPSDQGVYFDKNTDSSILLKEEIVKRLEDIDYYPEASHHEVAPGQHEIDVKYADAITMADRLIVIKSIVKDVAAKHGYYATFMPKPIKGINGSGMHVHQSIFNGDNNAFYDENNRYGLSKYALSYIAGILKNIKGASPILAPLVNSYKRLVPGYEAPVYICWANRNRSALVRVPAPSGKAKRIELRFPDSTGNHYLQFAVMLGMGLDGIENKAEIPDPVERNVFEMPLNERAELGIETMPGSLGEAIKEMERSETIKEILGEHIFENYIKLKRMEWEDYTTYVTDWEINRYLEVY

SEQ ID NO: 11525 - protein, 400 aa, Caulobacter crescentus CB15
MSRLSEALTRLKAGGMIVLVDDEDRENEGDLVMAAEFADAAAIAFMAKRASGLICLTLEAETIDRLCLAPMVSDNRTSRQTAFTVSIEAATGVDTGISAFDRARTIAAAIAPDAQAADLVSPGHVFPLRARPGGVLVRNGHTEASVDLMRMAGLRPAGVICEIMKDDGSMARRPDLEVFCREHDLPLLTIAELVAHRKATELLVDEVAAARLPSDHAGQAFSVRAFRSRIDGGEHLAMVAGPLTGAPLVRVHSECLTGDALGSRRCDCGEQLRESLRQISDSGNGALIYLRNHEGRGLGLANKIAAYALQDQGLDTVQANHALGFADDQRDYGVAAQILRALGVGEVKLLSNNPRKAAGLRANGVTVRREVPLLIPANPDNAAYLETKRDKLGHSLARAS

SEQ ID NO: 11526 - protein, 252 aa, Helicosporidium sp. ex Simulium jonesii
MARKFFVGGNWKCNGTKESVSALVKALSAAKLPSADKVDVVVAPTFLHLSQALSSLPSRVEVSAQNCWIKGGGAFTGEISAEQIVDLGAKWVILGHSERRHIMGESDATVADKVAYALSKGLGVIFCIGEQLSEREANHTMDVCTRQMAALASKISDWSRIVVAYEPVWAIGTGKVATPDQAQEVHGLCRRWVAQHVSPAVAETTRIIYGGSVTAGNCRDLAAQPDIDGFLVGGASLKPEFVDIVASAELKS

SEQ ID NO: 11527 - protein, 160 aa, Triticum aestivum
KQHYGLSKTANEVTILIEAYRTLRDRGPLPASQVVRDLSGRFAFILYDTVSKSTFVAADADGSIPFFWGVDSEDHLVFSDDNELLKASCGNSFAPFPKGCFYTTSGGLQSFEHPLNELKAVPRVDSQGQMCGSTFKVDSEAKKDSGIPRVGSAADWSNHF

SEQ ID NO: 11528 - protein, 226 aa, Helicosporidium sp. ex Simulium jonesii
QAHVLGKAKHTFTSAEEAVKALRAGPNGDVISDQWLEPFVIVDSDTQHPVGPIQDGDAVVIFNFRADRVIEISKAFEYAEFSSFDRERWPCTRFAGLMQYDGDLKLPANYLVAPPAITGTSGEIPSDKVPFNQLPLMKAREIAEAGKEALRSGKFDVVRINFANPDMVGHTGDLAATIKAVEVVDVCVKELLDVVDELGGRFLLTSDHGNADDMVQRAKKTLKPLF

SEQ ID NO: 11529 - protein, 283 aa, Streptococcus agalactiae NEM316
MATIQWFPGHMSKARRQVQENIKHVDFVTILVDARLPLSSQNPMLTKIVGDKPKLMILNKADLADPIRTKEWRDFYESQGLKTLAINSKEQSTVKKVTDIAKILMSDKIAKLRGRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTYYPDRLKERFKSINLEDEAPEIIMALTQKLGYRDDYDRFYNLFVKEVRDGKLGRYTLDIVGEHDGNN

SEQ ID NO: 11530 - protein, 471 aa, Coccidioides immitis RS
MASTLTFLARHAPKRLCVSSSIPNTAARLAAPRLFSNSSAARQYDESAYQATRLIPTGPDFRPHSPTAVGEASGLESDAGHNRKIRHYTVNFGPQHPAAHGVLRLILELNGEEIVRADPHVGLLHRGTEKLIEYKTYLQALPYFDRLDYVSMMTNEQCYSLAVEKLLNIEIPERAKWIRTLFGEITRILNHLMSVLSHAMDVGALTPFLWGFEEREKLMEFYERVSGARLHAAYVRPGGVHQDIPLGLLDDIYQWATQFGDRIDETEELLTDNRIWKARTQGIGVVSAADALNFGFTGVMLRGSGVPWDIRKSQPYDAYDQVEFDVPVGVNGDCYDRYLCRMEEFRQSLRIIHQCLNKMPAGPVRVEDYKINPPPRAAMKENMEALIHHFLLFTKGYAVPPGETYSAIEAPKGEMGVYIVSDGSERPYRCKIRAPGFAHLGCFDQISRGHLLADAVAIIGTMDLVFGEVDR

SEQ ID NO: 11531 - protein, 380 aa, Halobacterium sp. NRC-1
MNFSTRVTSVEPSATLAVSTLASELEADGVDVVDLSVGEPDFDTPESIVDAGKAAMDAGHTGYAPSNGVPELRDAIAEKLQGDGLDYEAGNVIVTPGAKQALYETFQAVVDEGDEVALLDPAWVSYEAMAKLAGGELNRVDLAPHDFQLEPALDDLADAVSDDTELLVVNSPSNPTGAVYSRAAMEGVRDLAVDHDITVISDEIYQRVNYGPAHVSLAGLDGMFERTVTINGFSKAYSMTGWRLGYLAGPEALVDQAGKVQSHSVSSAANFIQRAGVEAIRHTDDAIDEMVAAFESRRDLLVDLFAEHGTDVSTPDGAFYLMLPVADDDQAWCQDALKDAHVATVPGSAFGAPGYARLSYAASTDRLEAAVDRLAAEGYL

SEQ ID NO: 11532 - protein, 296 aa, Haloquadratum walsbyi
MTDATSGSDPDSTTPVDLTGEDFRDPDALRRRAGVSGDPNFDQHFLIDDRVLDRIPTYLLDSTDTTHILEIGAGTGALTDRLLAVGDTVTVIERDATLAAFLREEFAVMIDDGRLNIIEGDALEVTLPAFTTCISNLPYGISSEILFELLPADCPLIVMVQREFGERMAADPGTDAYGRLSVSAQHYATVEVVETVPPTAFAPEPAVDSALIRAEPRDPDYTVTDETFFLRFVKAVFTQRRKTVRNAIRNTAHISMLDTPDAVVNAADEALLSQRAGDLTPSEFAELATIAAEKGK

SEQ ID NO: 11533 - protein, 288 aa, Wolbachia endosymbiont of Drosophila ananassae
MNFSQLIFKILYNENNMKKFLLKPKKSLGQNFILSSEITKKIVALAGSLENFNVIEIGPGYGALTREILVHNPKSLLSIEKDRDLVKHHDQLLNEHQGKYRIIEADALHVTEEELIERPVKVIANLPYNISVVLFLKWLNNIKFFTNLTLMFQKEVADRITARPNSKDYGSLSVLSQLLCDIKKEFDIEPKEFFPRPKIHSSVITVNPLPIPKFAVNLETLTRLTRAVFSQRRKMLRNSLQNITNHTETVLENAKLSGNERPENLTIEQFCLLANNVECLFCKSPIAI

SEQ ID NO: 11534 - protein, 192 aa, Wolbachia endosymbiont of Drosophila ananassae
MNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 11535 - protein, 264 aa, Arabidopsis thaliana
MIVYFPSELTVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGDHERLRTISSGFSYENFRSN

SEQ ID NO: 11536 - protein, 158 aa, Haloquadratum walsbyi
MSEEAPVHERTFVMVKPDGVQRGLIGEIISRFEDRGLTLVGGKFTRLDTEVARDHYGEHKDKPFFDDLVSFITAGPVFAMVWEGADATRQVRSMVGETDPAESAPGTIRGDYGLDLGRNVIHASDHEDEGANEREIQLFFDESELYTYERIDDPWLYE

SEQ ID NO: 11537 - protein, 562 aa, Halobacterium sp. NRC-1
MSTQQEDDTPDVDDAAPATPASGSPAALEALIEDHVLEREDHLNAPGFVIRADAVQDVLSTLKTEAGFDHLSCVTAEEHEDRFESIYHLRKYDDPTQEVSIIVPTSRDNPVSETAEPVFRTADWHEREAYDLVGVEYDDHPNLERILLPDTWQGHPLGLDYNQNKPQIVTFDEHKNPLEGHEQAADDSDTMFLNIGPHHPATHGVLHVETVLDGEQVADVNPDIGYLHRCEEQMAQKGTYRHQIMPYPDRWDYGPGGILNEWAYARTAEDLADIDVPEYAQILRTMGGELCRIACHMLALGTFCLDIYGDFTAIFMYAMRDREVVQNILEDLTGQRMMLNYLRLGGVVWDIPEPRAEFFESVRDFLDELPERLDEYSDLITSNEIFQARTVNTGVLDYETAKDYGVTGPVARGSGVDYDVRRDDPYGYYPELDWDVVTEDGGDNYSRLLVRMEEVEQSARIIEQCVDLLEGWPEDERDIQANVPRTLKPEAGTETYRTVEGAKGELGVYIRADGTEKPGRFKIRSPCFSNLSALKEMSTGEYIPDLVATLGSLDVILGEVDR

SEQ ID NO: 11538 - protein, 274 aa, Agrobacterium tumefaciens str. C58
MSMVYKASGPLVLVGAGNMGGAMLSGWLKKGVPGSKVIVIDPRPSDAMRTTIAEAGATHSESVPEGVKAGILFVAVKPQMMDAILPSLKPLLGPETVVVSIAAGTTIATFVSHFGAVAAVRAMPNTPAMVGRGVTGAYANDLVTAELKTVVDGLLKVSGPVEWVEAESDIDAVTAVSGSGPAYVFYLVECMAEAGRKAGLPADVAMRLARETVAGAGELLHQSPEEAARLRQNVTSPGGTTAAALSVLMAEDGMQPLFDRAVAAAKTRAEELAG

SEQ ID NO: 11539 - protein, 488 aa, Rickettsiella grylli
MLIFELSQTGRVAKSQIRAFDSKDTTFNTQLTSIPENYLRKTKLCLPEVSELQVVRHFTRLSQKNFSIDTHFYPLGSCTMKYNPRGVHRLASLPAFLHQHPLLPETSCQATLRCLYEFQEILKDITGMSGVSLTPMAGAQGEFAGVAMIKAYHASRGDTARTEFLIPDAAHGTNPASAAMCGYSVREIPTNPAGDIDLDALYSAVGSHTAGIMLTNPSTLGVFEQHIEQIASIIHQAGGLLYYDGANLNAILGKVRPKDMGFDVMHLNLHKTFATPHGGGGPGAGPVAVGERLLPFLPIPIVAFEKNRYRWLHLQDRPQSIGRLSTFMGNTGILLRAYFYACLLGREGLKRVSEFATLNANYLLKQLQRIGYIPAFPQRRASHEFILTLKNLSKQANVTAMDVSKRLLDFGFHAPTTYFPLLIPECLLIEPTETESKQELDQFISAMEKILIEAKKNPTHLNNAPHHLRLKRLDDVKAVRELDLTWEN

SEQ ID NO: 11540 - protein, 227 aa, Methanocaldococcus jannaschii
MNNVEKAIEALKKGEIILVYDSDEREGETDMVVASQFITPEHIRIMRKDAGGLICTALHPDICNKLGIPFMVDILEFASQKFKVLRELYPNDIPYDEKSSFSITINHRKTFTGITDNDRAFTIKKLAELVKEGRFNDFGKEFRSPGSVTLLRAAEGLVKNRQGHTEMTVALAELANLVPITTICEMMGDDGNAMSKNETKRYAEKHNLIYLSGEEIINYYLDKYLKD

SEQ ID NO: 11541 - protein, 533 aa, Zea mays
  misc_feature (89)..(89): Xaa can be any naturally occurring amino acid
  misc_feature (123)..(123): Xaa can be any naturally occurring amino acid
  unsure (1)..(533): unsure at all Xaa locations
MHSTNLLLEEPIRMASILEPSKPSYFPAMTKIVGTLGPKSRSVDTISACLKAGMSVARFDFSWGDAAYHQETLENLKLSIKSTKKLCAXVMLDTVGPELQVVNKSETPISLEENGTVVLTPHXGQDASSSLLPINFSGLAKNCSLQAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 11542 - protein, 379 aa, Zymomonas mobilis subsp. mobilis ZM4
MSKNTPIVKGSTKRHPFLSSVEELIEEARNGRIFILVDDEDRENEGDLIIPAQMATPAAINFMATHGRGLVCLAMTKERVTSLGLAPMSRENNAPLQTAFTVSIEAKEGVTTGISAGDRARTIAVAIDSSRGAEDIVTPGHVFPLAAKSGGVLVRAGHTEAAVDIARLAGLNASGVICEVMKEDGTMARLDDLVTFAQRHNIKIGTIRDLIAWRREHDNNVELIEEKSFNSLYGGDWQAIRFRNKATGSESLALVKGQISADEPTLVRMHAIDPFTDMLGQTGSRQQLLSRSMEIIAKKGAGVVVLVQRSQENSADKSSVWAASRNQETIHRDYGIGAQILAELGVRDMILLTNSHHMPVALAGYGLNITGEQPITEGA

SEQ ID NO: 11543 - protein, 354 aa, Zea mays
AWSRPRYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 11544 - protein, 133 aa, Glycine max
  misc_feature (68)..(68): Xaa can be any naturally occurring amino acid
  misc_feature (76)..(76): Xaa can be any naturally occurring amino acid
  unsure (1)..(133): unsure at all Xaa locations
MAEHTFIMIKPDGAQRGLIGEIISRVEKKGSYLKGSKLVTVDRPFAEKHYARCAARPFFSGSVDYIIXGRVVAMIXDGRNVVTTGRKIIGTTNPAQSEPETIRGDFAIDTGRNVIHGSDAYDSAIKEIALWFP

SEQ ID NO: 11545 - protein, 105 aa, Glycine max
  misc_feature (76)..(76): Xaa can be any naturally occurring amino acid
  unsure (1)..(105): unsure at all Xaa locations
MASGSLKNMLSVAMNQGVVEARARIFGHQLNPTGMKTPHKLLRMKLFGEKVAQWYPHDIKKDDPLVMARQEQEAVXRLSKLEMLKRRGKGPPKKGQGRRAAKRNK

SEQ ID NO: 11546 - protein, 476 aa, Polaromonas sp. JS666
MKLVSIILSGGAGTRLWPVSRQALPKPFMHLGGSSLLQQAIERGQACGTDDSVIVTNQDYLFLTRNVIKQLSDPPNARYLLEPKGRNTAPAIALAALACTQEHGPEAVMLVLPADHLIPDTEAFVASALEAARQALQGQLVVFGISPTAPETGFGYIEVEKVSRHTQKALRFVEKPDLATAQGYLATGRYYWNSGMFCFTAGTILQALKEHAPEVLEAAEHAWTTSSTESGATQFDAHAFGLQPDISIDYAVMERASNVTLVPAKFGWSDVGTWPAVAQAYTADTSGNTFVDGEGTQFITVDTTGTHVQTDSHTAKVVATVGVHDLVIVDTPDALLIAHKSAAQKVKAVVDTLKERKHESTQLPASVNRPWGTYATLKEESGYKVKRITVNPGQSLSLQYHHQRAEHWVVVQGTAIVQVGDEEHTTLPGQYRYIPLKEKHRLTNTGENELVLIEVQCGGYLGEDDIVRLADTYGRA

SEQ ID NO: 11547 - protein, 112 aa, Helicosporidium sp. ex Simulium jonesii
MGGAVIQVTNKTEFDSHLSTAASKGKLVVVDFTATWCGPCKMIAPFFAKLSGEYPDVVFLKVDVDEVEAVAAEHGITAMPTFLFFKDGKQVDSLTGANQERLRAMLTQHAQS

SEQ ID NO: 11548 - protein, 511 aa, Idiomarina loihiensis L2TR
MTPTIKPLVLLILDGWGYREDAPDNAIAKANTPVMDRLWEKYPHCLVDGSGGAVGLPDGQMGNSEVGHVNLGAGRIVYQDFTRISKAISDRSFFSNTILCDALKKAKAAKGAVHIMGLLSAGGVHSHEDHLVAMIEMAVEQGAEDVYLHAFLDGRDTPPKSALPSIERFEALFARLGKGRFATLSGRFFAMDRDKRWERIEQSYKAVYHGLSGVTSANATDAVENAYERGETDEFVTPVVIGQPAPIANGDSVFFMNFRADRAREMTQAFVDKDFDGFDRGSRADISEFVMLTQYADTLEAPSAFPPEPLNNVLGEWLAKHDKTQLRISETEKYAHVTFFFSGGREQEFEGEKRVLIPSPKVKTYDLQPEMSSEQLTDELVAAIESQAFDVVICNYPNGDMVGHTGNFDAAVKACEAVDHSVGRVVSALEAVGGECLITADHGNAEQMSDATTGQAHTAHTNELVPFIYVGRPAKARNGRLSDVAPTILHLIGMEQPDEMTGTSLMTLEQD

SEQ ID NO: 11549 - protein, 122 aa, Helicosporidium sp. ex Simulium jonesii
TAFTVTVDAREGITTGISAQERARTIQALADPTTTAANLRRPGHIFPIRARPGGVLERRGHTEAGVDLARLAGCTPAGVLCEIVEEDGSMARGPSLQRFARRWNLKCVTIADLVHYREVMSV

SEQ ID NO: 11550 - protein, 231 aa, Agrobacterium tumefaciens str. C58
MDARQMKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 11551 - protein, 345 aa, Moorella thermoacetica ATCC 39073
MKALVFEGPNELKLRDVPLPEPGEDEILVKVAACLICGTDLRIFRGAKTRGVRIPSILGHEFAGVVEATGVNVKEFHVGDRVGVAPVIPCHTCFYCKNGLENVCANRTALGYEYEGAFAEYVCIPAPAVKGGNVYHLPSNISLEEAALAEPLACCLNGHHNSKVKLGDVVVILGAGPIGLMHLQLAKSSGASYVIISEPNEHRRAIAKEFGADRVVDPQTEDLNSIVKNVTDGLGADIIFLAIGIPALAQDALTLVKKGGTINFFAGFSVGDKAALDVNLIHYNEIKITGTSAARRDDYRKALDLIAKGKVKASKMITHRFPLDKAEEAFRIAGSSQGIKVAIIP

SEQ ID NO: 11552 - protein, 246 aa, Xylella fastidiosa 9a5c
MLTAYDAGFARILDANGVDLVLVGDSLGMVVQGHDSTLPVSVHDMVYHTACVARGVRQAMLVVDLPFQADASPERALEAATPLLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 11553 - protein, 390 aa, Pseudomonas syringae pv. phaseolicola 1448A
MPQPYSARSRAIEPFHVMALLARANELQAAGHDVIHLEIGEPDFTTAQPIIKAGQAALADGKTRYTAARGLPQLREAISGFYARRYGVDIDPQRILVTPGGSGALLLASSLLVDPGKHWLLADPGYPCNRHFLRLIEGEAQLVPVGPQERYQLNPELVAAHWNQNSVGALVASPANPTGTLLNRDELAALSQALKARNGHLVVDEIYHGLTYGVEASSVLEVDNEAFVLNSFSKYFGMTGWRLGWLVAPQDAVADLEKLAQNLYISAPSMAQHAALACFEPQTLEIFEQRRAEFGRRRDFLLPALRELGFGIAVEPEGAFYLYADISAFGGDAFAFCRHFLETEHVAFTPGLDFGRHQAGHHVRFAYTQSLPRLQQAVERIARGLRSWGA

SEQ ID NO: 11554 - protein, 158 aa, Triticum aestivum
  misc_feature (116)..(116): Xaa can be any naturally occurring amino acid
  misc_feature (130)..(130): Xaa can be any naturally occurring amino acid
  unsure (1)..(158): unsure at all Xaa locations
MGSAASPPRALDAATQEDLKRVSAHRAVDMVESGMTLGLGTGSTAAHALDRLGDLLRGGALRAVAGVPTSLKTEAHAARVGIPMLALADAAEIHLSIDGADEVDPDLNLVKGRGGXSLLPKKMIEGAGAXFVVILKKAKVVPRPRVQGAPRHNEGQPL

SEQ ID NO: 11555 - protein, 445 aa, Clostridium acetobutylicum ATCC 824
MEEINAKVVTKVPGPKSRELLKKREKYVAKGVSCSYPVFVEEAKGALVKDIDGNVFVDFAGGIGVQNIGHRDDGVVEAVKEQLDKYIHACFHVNMYEPYVDLAEKLTEITPGNFAKKAMFANSGAEAVENAIKIARAYTKKSGIISMNGSFHGRTNMTMSITSKYKPYKNGFGPFVCETYKADYAYCYRCPLGCKFKDCGIACAEKLKTMLKTVVSPDMIACLIVEPVQGEGGFVVPPKDYFKALQQICNENNIVFIVDEVQAGFARTGKFFAHEYFDVDADIITMSKSIANGLPISAVVGKAEIMDAACVGGIGGTYGGNPLSCVAAIKVIDKIKEANLNEKSIELGKSIMNRLNEMKEKYNVIGDVRGLGAMIGVEFVKDKDTKEPNKEIVSSILDYCFKHGVIFLNAGLLGNVLRFLPPVVMTDEQLKYGLDTLEEAIRIAI

SEQ ID NO: 11556 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 11557 - protein, 481 aa, Burkholderia vietnamiensis G4
MANVTYTDTQLLIDGEWVDAASGKTIDVVNPATGKAIGKVAHAGIADLDRALAAAQRGFEAWRKVPAHERAATMRKAAALVRERADAIAQLMTQEQGKPLTEARIEVLSAADIIEWFADEGRRVYGRIVPPRNLGAQQMVVKEPVGPVAAFTPWNFPVNQVVRKLCAALATGCSFLVKAPEETPASPAALLRAFVDAGVPAGVVGLVYGDPAEISSYLIPHPVIRKVTFTGSTPVGKQLAALAGQHMKRATMELGGHAPVIVAEDADVALAVKAAGGAKFRNAGQVCISPTRFLVHNSIRDEFTRALVAHAQGLKIGNGLDEGTTLGALANPRRLTAMASVVENARKVGASIETGGERIGSEGNFFAPTVIANVPLEADVFNNEPFGPVAAIRGFDKLEDAISEANRLPFGLAGYAFTRSFANVHLLTQRLEVGMLWINQPATPWPEMPFGGVKDSGYGSEGGPEALEPYLVTKSVTVMAV

SEQ ID NO: 11558 - protein, 476 aa, Solibacter usitatus Ellin6076
MPNQLQDFLTLSYAELEELNLQAKAERLGRAPTHQIQEQRLKYLTDEKRIKAVTVLFSDLEGRLHMLDYDKKFLVKSWDNLTFDGSSIRGFTAQRESDLRLSMDWSSFYWAPSDVFGAGKVLVFGEVIDKDGTPYSADIRGVLKAYAQSLYEKQGYTLNAANEIEGFLFNGSDAERRYHETAKFDYVNTGGYYHSLPGDPLRTFIDSCAEVQRAMGFQNEKDHPEVAPSQFEINYSYAEVVAAADQIQLYKLICRQVATRMGLTASFLPKPVVGVNGSGMHTNVSITKGGKNIFWDPKGEEKMSKFAWQFVDRILTHGNDLCLLLNASVNAYRRLDPHFEAPNQIKASAVDRGSMIRIPIGNERSSRVEVRSVGPDANPYMVMLGVFRTGLEGEISRIKNLRGAERYLPDNIYDAMANFKNAEWTTKLLGEDVKGRYADLKQASADRCPRLLGTFVKTPEVQYHHEVYNQFLWNMF

SEQ ID NO: 11559 - protein, 674 aa, Ralstonia metallidurans CH34
MPGRRACLAGTFQSPMHSPLELTLVLLAAAVFGVVAFRMLQLPPMLGYLAVGILIGPHALGLASDSGQTKYLAEFGVVFLMFSIGLEFSLAKLRAMKRLVFGLGGSQVILSMLAVVPASWMFNWLFPLSWQASVALGGALAMSSTAIVSKMLSERMELESEHGRNIISILLFQDLAVVPLLIVIPALSRDPGDLAFALGLATVKIAVALGAIFFLGQRLMSRWFHVVAARRSQELFMLNLLLVTLGMAALTERLGLSMALGAFMAGMLISETPYRHQVEEDIKPFRDVLLGLFFVTIGMLLNIRVVFDHVWLVLALLIVPILFKLVLIAVLARLFGSRQGVAIRTGLGLAQAGEFGFVLLNQIDGMGLVDPVLIQVILASMLLSMLAAPFLIQYSDAIVLRFAANEWLLQSLNMTRIAAQSLQTEKHAIICGYGRSGQNLAHMLEREGITYVALDLDPDRVRDAAAAGDTVVYGDAGRREALIAAGIHRAALVVVTYANTPSAVKVLHHVQELAPALPVLVRTVDDSELDILQKAGATEVVPEIIEGSLMLASHALVLLGVPMRRVVRGVQQARDARYSLLRGYFHGRDDEEDMVERDTVRLHAVSLGPEHTAVGRRLGALGLERIGVEVTAVRRRGIRAFDPEPDTVLEPGDIVVLRGTPEALESAEERLIKD

SEQ ID NO: 11560 - protein, 566 aa, Zea mays
  misc_feature (464)..(464): Xaa can be any naturally occurring amino acid
  unsure (1)..(566): unsure at all Xaa locations
MAEVVKLRQEHQNTRSDLQAMEEKLQDTEQKQQQMMAFMACVMQNPDFMRQLISQREMRKELEDAISKKRRRCIDQGHEAGSMGTGSSLEQGPQGVFEPQEPVESLANGVPSDLESSSVEAKGLEVRQGVSSGGSEHLNGRPSGELNDDFWEDLLHEGGLGADAGNAVGQDDMNMDMDPDLCSLYPCGVPVSIVFDQMSRRLQSPVVNTAISVFVLTDRNAGVPRAPRCRAVWISPDPSPAFGLPRARAHAPAPPRYKARHQSARGRRHHPDSRHACVVAIGKLGGSWQRELTRRRRARATARIASQLWAEVGPCAEMLAVFDRAVAPSPEGLRQPGAAGGGCAAGLADRFREARPDAVTVNLGGSGALAYSSSNQNPLLPRLFGAVDGVFCMFQGTIANVAVLKQQYGLSKGANEVSIIIEAYRTLRDRGPYPADQVVRDISGKFAFVLYDCSTKSVFMAAMXDTDGNVPFYWGVDTDGRLVVSDDAELVKSACGKSCAPFPKGFFFTTSGGLRSYEHPMHEVKPVPRVDSKGEVCGTTYTVDASARKETTIPRVGSAADWSSQY

SEQ ID NO: 11561 - protein, 470 aa, Zymomonas mobilis subsp. mobilis ZM4
MANSASDLLKLIKEKEIDWVDLRFTDPKGKWQHLTMASTVVGEDDLNDGFMFDGSSIEGWKTINESDMILKPDLDAFYIDPFSASPMLILICDIVEPATGEFYSRDPRSTAKRAEAYVKTLGLGDTVYIGPEAEFFLFDDVRFDSGYNGSFYRVDDIELPTNSGREYDNGNLAHRPGVKGGYFPVAPVDSAVDIRSEMVSTMLEMGLPMDKHHHEVAPAQHELGLTFGTLTQTADRMQVYKYVVHQIAQAYGKTATFMPKPISGDNGSGMHTHISIWDGGKPTFAGSEYAGLSENALYFIGGIIRHAKAINGLTNPSTNSYKRLVPGFEAPVLLAYSARNRSASCRIPYGTGEKSRRVEIRFPDATANPYLCYTALLMAGIDGIQNKIHPGEAMDCNLYDLPPEELAKVPTVAGSLREALDALSEDFDFLTKGDVFTEDQIKSYIEIKRAEVLRWEMAPSPVEFEMYYSL

SEQ ID NO: 11562 - protein, 262 aa, Oryza sativa
MEVATATEASAPAASRRSHPFPWLDLAISEPYYFLHLVAFFSYFAARSTVPSADDGLLLRREIQAVLTFLVLFVVKIVKEENWETCIADSLLYAKGLLLAVTLVIDYWLTVSYLLGFVVIYAVAQQPPYDGLGHSNHLTPLQLEGLLTEEPTTRFWLVEFRTSFSGTCIEASSVLPELSNIYSNKNISFGIIDLGHFPNAAAKFGISMWDHLPTYILFDKATEVARFPEIMNESKVFVPKITKKLLCQHFDLDRRLIEYLSR

SEQ ID NO: 11563 - protein, 173 aa, Triticum aestivum
MFLRRILSGGGGLAALRSARAVKETTGIVGLDVVSEARDVLIGLYTRTLKEIEAVPKDEGYRKAVESFTRYRLQICQEEEDWKRIEDRLGCGQVEELIEEAEDELKLIGKMIEWDPWGVPDDYECEVIEDDTPIPKHVPQHRPVALPEEFFKTLDAIKSDPALQGDSPPQVKS

SEQ ID NO: 11564 - protein, 278 aa, Vibrio alginolyticus
MMEIRQMEHKKIAFIGAGNMVRAIVSGLVANGYPAQNITATAPSEARRLPLEQDFGIRTTSDNIQAATEADVVVLSVKPQMMADVCKPLQAIDFTNKLVISIAAGINCSRLDDMLATKLNLVRVMPNTPSQLGLGMSGLFAPIHVTEHDKAFAAELMEAVGKVCWVEQESGINNVIAAAGSAPAYFFLFMEAMQAEAIAQGFDKESARLLVQQAALGAASMVVSNPETELSTLRENVTSKGGTTAEALRTFNEHQLSDIVAKAMQAAVARAEEMEKLF

SEQ ID NO: 11565 - protein, 742 aa, Erythrobacter sp. NAP1
MPRTAFQQLGITEGDVVEISGKRATAAIAMAAYPEDDSLDVVRLDGLQRGNAEAASGEHVEIVVAESRPATRVVFAPAQREMRLQGPAQALKRNFFKKPITAGDLVATTGQQPVQNMPPDVRQMLRAPAYALTQIRLSVHSTSPKGIVHIDENTEVELRTEFEEPRDARGMVNYDDVGGMEDTIQQLREMVELPLRYPELFTRLGVDPPKGVLLHGPPGTGKTRLAQAVANESDAEFFTINGPEIMGSGYGESEKRLREVFEEATRASPAIVFIDEIDSIAPKRSGVPGEAEKRLVAQMLTLMDGIESRANLVVIAATNRPDAIDEALRRPGRFDREIVIGVPDQRGRREILAIHTRGMPLEEAVDLSELARVTHGFVGADIAALAREAAIDAVRRIMPRLNLEERTIPQDVLEDLCVTRADFFSALKRIQPSAMREVMVQVPNVGWDNIGGVGDAIDKLKEGIELPLKNAEAFRRLGIRPAKGFLLYGPPGTGKTLLAKAVAKEAEANFISMKSSDLLSKWFGESEQQIAKLFARARAVAPCVVFIDEIDSLVPARGSGQSEPQVTGRVVNTILAEMDGLEELQSVIVIGATNRPALVDPALLRPGRFDELVYVGTPDKEGREHILGIHTKDMPLASNVDLAEIAEKTDRFTGADLEDVVRRAGLGALRRMGGDVKAVEMQDFEDALEDSRATVTPRMEAEYRRMRGELKKRAAEANPIGFFAPDSLAPARAKKHGSDEEA

SEQ ID NO: 11566 - protein, 263 aa, Oryza sativa
PNYRCNTSLLIDYCQDEVTHKYILIDVGKTFREQVLRWFIHHKIPCVDSIILTHEHADAILGLDDVRIVQPFSPTNDIEPTPIYLSQFAMNSIAQKFPYLVRKKLKEGEEVRRVAQLDWRVIESDLQKPFVTSARGFVPLPVIHGEDYICLGFLFGRKSKVAYISDVSRFPPSTEHTISKSGGGQLDLLILDCLSRTGSHNVHLCWDQTLDAVKRICPKRALLIGMTDEMDHHKDNETLEEWSRREGIDVQLARDGLRVYIDL

SEQ ID NO: 11567 - protein, 352 aa, Candidatus Kuenenia stuttgartiensis
MKAFAMLGIGSVGWIEKEKPVAGPYDAIVKPIAFAPCTSDIHTIEGAIGDRKNLVLGHESVGEVVEVGSEVKYIKPGDRVVVPAITPDWRSVELQDTGLGQHSGGMLAGWKFSNIKDGVFSEYFHVNDGDMNLAVLPDGITLEAAVMLTDMVTTGFHGVELANVEYGDTVVVLGIGPVGLMSVAGAQLMGAGRIVGVGSRPALIEAAKFYGATDIVNYRERSVVDRVLEMTNNRGADKVIVAGGNCDILIDAVKILKAGGAIGNINYFGGDEFIPIPREAWGVGMGHKAINGGLTPGGRVRMERLIELVKYSRLDPGKLVTHVFYGFDKIEEALQLMKEKPADLIKPVVLID

SEQ ID NO: 11568 - protein, 499 aa, Coccidioides immitis RS
MADRLLKKIPYTFKDPSLLDTRSLIGGKWVEARSGKTFPVFDPEDNKEVCQVTDLDVDDVCAAIDAASEAFKTFKNAPHRERRWLMRRWADLIKENKDDLAAICTLELGKPFTESLVTVKYGTDFLDWFEGEIERVYGETIPAARGNNRIFTIKQPQGVVAAITPWNSPIAMVTRKVGAAIAAGNTVICKPAPETPLCAIAVAKLFERAGGPPGVLNIITSSPETTPAVGAELCSNKLIRHLSFTGSTAVGRYLHTECSKTFKKTSMELGGNAPFIIFEDANIDKAVDGLISSKFRSSGQTCVCANRIFVHSSIISQFASRLHTRLGETFTYGSVWDRNVNFGPLYSPKAFDKLTRQTKDALERGGELIGEDPAKLQAQYGPNFYPPTIVTNANKDMLFMKEETFGPLAFLVPFETEEEAVAMANNVDAGLASYFYTEDISRMYRVSEALESGMVGCRVGLISACEQPFGGIKDSGMGREGGKGALDEYLNIKSVTVGI

SEQ ID NO: 11569 - protein, 952 aa, Mycobacterium leprae
MSVPNSSNKQTCFTARHIGPNSEDVATMLAVIGVESLDDLAAKAVPSDILDNVTDTGVAPGLDRLPPPATESETLAELGALARANTVAVSMIGQGYYDTLTPAVLSRNILENPAWYTPYTPYQPEISQGRLEALLNFQTLVSDLTGLEIANASMLDEGTAAAEAMTLMYRAARSTASRVVVDVDVFAQTVAVFATRAKPLGIDIVVADLREGLPDGEFFGVITQLPGASGRITDWTALIAQAHSRGALVAVGADLLALTLITPPGEIGADVAFGTTQRFGVPMGFGGPHAGYLALHTKHARQLPGRLVGVSVDSDGTPAYRLALQTREQHIRRDKATSNICTAQVLLAVMAAMYASYHGAEGLTGIARRVHAQARALAAGLSAAGVEVVHQAFFDTVLARVPGRTVQIQGAAKERGINVWLVDGDHVSVACDEATTDEHITAVLAAFAATPARASFAGPDIATRTSAFLTHPTFTKYRTETSMMRYLRALADKDIALDRSMIPLGSCTMKLNAAAEMESITWQEFTRQHPFAPVSDTPGLRRLISDLESWLVQITGYDAVSLQPNAGSQGEYAGLLAIHDYHVSRGEPHRNVCLIPSSAHGTNAASAALVGMRVVVVGCHDNGDVDLDDLRIKLSEHANRLSVLMITYPSTHGVYEHDIAEICAAVHDAGGQVYVDGANLNALVGLARPGKFGGDVSHLNLHKTFCIPHGGGGPGVGPVAVRSHLVSFLPGHPFAPELPQGQPVSSAPYGSASLLPITWAYIRMMGADGLRTASLTAIASANYIARRLDKYFPVLYTGENGMVAHECILDLRPITKSVGVTVDDVAKRLADYGFHAPTMSFPVPGTLMVEPTESESLAEIDAFCEAMIAIRGEIARVGAGEWSVEDNPLRGAPHTAECLLASDWDHPYTREEAAYPLGKAFRPKVWPPVRRIDGVYGDRNLVCSCLPVEAFV

SEQ ID NO: 11570 - protein, 311 aa, Streptococcus agalactiae A909
MKTYEKIYQILSKNNNFISGETMANQLNISRTAIWKGIKTLEELGLEIESVTNKGYRLVSGDILLPEQLEQEIGIKVSLNNNSASTQLDAKMGIESKLKTPHLFLAPNQKKAKGRFDRPFFTSNQGGIYMSLLLQPNVPIEDIKPYTVMVASSAVKAISRLTGITPEIKWVNDIYLDNKKIAGILTEAIASVESGLVTNVIIGLGINFYIKEFPRALTKRAGSLFTEQPTITRNQLITEIWNLFFNIPLEDHLKVYREKSLVLDRTVSFMDGQTMYSGKAIDITDKGYLVVELDDGQLKTLRSGEISLSSW

SEQ ID NO: 11571 - protein, 485 aa, Pseudomonas putida KT2440
MMIPVILSGGSGSRLWPLSRKQFPKQFLALTGEHTLFQQTIERLVFEGMDTPIVVCNKDHKFIVQEQLAALKLETQGILMEPFGRNTAPAVAMAAMKLVNEGRDELMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDGDIYDTCVLALERSQEDGDVLSIDEATFACCPDNSIDYAVMEKTQRACVVPMSAGWSDVGCWSSLWEVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPIASVHRLRNPGKIPLEIIEVQSGSYLGEDDIERFEDVYGRTSTPIERGVSVKTIAQ

SEQ ID NO: 11572 - protein, 227 aa, Clostridium acetobutylicum ATCC 824
MAKDNLKKISAKKALEYIKDNTVIGLGGGETIGYLCDYLKEKIKSGFNIKVVTPSIKTRNTCIENGIEVLYTSSVEHLDVAFDGCDQLDEKLNALKSCGGIHSKEKIIASMADKYILLTNESKFVKKLDSTYPIVLEILEESAGYVKRRISEIGGKATFRSSAAKDGFTITDSGNLLLDVFFDELGDAKELQKGLKGITGVVETSLFVDLVSQAIIAYEDDIKIISK

SEQ ID NO: 11573 - protein, 89 aa, Zea mays
  misc_feature (52)..(52): Xaa can be any naturally occurring amino acid
  unsure (1)..(89): unsure at all Xaa locations
MAVASAWAKPGSWALAAEEQDDLPPPPPPVSASDFPDLSTAATTKDPKKKKXQTVSLASFNIVKFDLPSSRGTTPDMVLSLPTGPRERT

SEQ ID NO: 11574 - protein, 279 aa, Symbiobacterium thermophilum IAM 14863
MRLATRILLSLNKLFPPPVHPFNLANQGTMRYADWQFERGHLTLEHYRPFLSPEEIMRGKTVLDIGSGAGGKTLYYATLGVKKIYGVDVVPHYEHEARALAAEKNLSDRAEFLTADATALPFPDDHFDVIIANDVMEHVAQPEAVLREAYRVLKPGGRFFTNFPPYYHPYGAHLSDVIGIPWVHAFFSEPVLIEAYRELVKDLPDADMRLRLRLGNPETNRTRITYINRMTIKRFRRIVEESPFRIAHWRLVPLRSFLKPLAAVAPEFFMKAVVCILEK

SEQ ID NO: 11575 - protein, 230 aa, Lycopersicon esculentum var. cerasiforme
ENVYMAKLADRAESDEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTS

SEQ ID NO: 11576 - protein, 389 aa, Kineococcus radiotolerans SRS30216
MRALVWNGVNDLAVETVADPTVLNPHDVVLKVSLTTTCGSDLHFIDGYLPGMQPGDVFGHEFMGVVVEVGPEVRSTAVGDRVVVPSFIACGTCAYCKREMYSLCDTTNPNGALQQPLLGYPSGGIYGYTHPFGGYAGSHAEYVRVPFGDVNCFPVPEGVDDVSALFTSDAVPTGFMGADFCDITPGDTVAVFGAGAVGLMAAASARLLGAERVIVVDRLASRLTLARDRIGAETIDYSEVDSVQEVLRESTGGRGPDAVIEAVGMEGHGTGLQNVVDRAKQAVRLETDRATPLREAVLACRKGGVVSILGVYGLTDSFPTGVVLNKGLTIKAAQQHGQRYVPRLLAHLAAGELDTSFLATHRMSLEDSVEGYRIFKEKEDDCLRAVFQP

SEQ ID NO: 11577 - protein, 384 aa, Triticum aestivum
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGCSQLNDLVADYKKGDLKVDEFITHRKTLGEINNAFDTMKQGDCIRAVVDMQKLEPKI

SEQ ID NO: 11578 - protein, 451 aa, Parvularcula bermudensis HTCC2503
MRYLPLSDQDRAEMRARIGVDRIDELFVDVPADALNPHLDLPDHQGELAVERFVSGLAAKNHAAGDGPFFAGAGAYRHHVPATVDHIIQRSEFLTAYTPYQPEIAQGTLQYLFEFQTQVATLTGMEVANASMYDGSTATAEAALMARRITKRRKVVCSGGLHPHYAAVVRTNLELIDDEVVVAPITPNGLGKIRQFIDEETSCVIVQSPDVFGNVRDIAAVAEAAHNVGALLIVVVTEAISLGLLKAPGLLGADIVVGEGQSIGNALNFGGPYVGLFAARKKHVRHMPGRLAGETVDADGRRGFVLTLSTREQHIRRDKATSNICTNSGLCALAFTVHLSLLGGEGLRRLAHLNHQAAARTADRLTAIDGVELVTPTFFNEFTVRLPSKAGPIVEALASMGIIAGVPGDRLWPEQEEFHDLLVVAVTETVSDEDIDQFGTALAQEIGRSSW

SEQ ID NO: 11579 - protein, 372 aa, Solibacter usitatus Ellin6076
MPIVSVPDAIQEIRAGRIIVVVDDEDRENEGDLTIAAEKVTPEIINFMAVQGRGLICLALTAERCDYLRLPLMSPTNTSMFGTAFTESIDALHGVTTGISAADRTRTILQAIDPDCRPSDLARPGHMFPLRAREGGVLVRAGQTEASVDLARLAGLTPAGVICEIMNDDGTMARVPQLIEFCKRHDMKMLSVAELIRYRMKNEKFIRRVAEGIIPTEFGDFRTIAYASDLNPEYHLALVRGDVSGKESVLVRMHSRCVFGDVFRSSQCECGQLVQNSLRAIAKEGQGVLVYLHETGPGFRVDSGQLVSHGRDFMHLKGEDGQRQLQHEHGLGAQILSDLGLHTIRLLTNHPRKIVALEGFGIEVEAQIPVGH

SEQ ID NO: 11580 - protein, 575 aa, Clostridium thermocellum ATCC 27405
MKLEAIYHKPYSEFAFPVAPDTLVIRLRTAKNDVNTCILIYHEKYDTSQRGKVKMDKVASDGMFDYYEVELNVGIKRIKYMFYLEDNYSIKWYSSDGFFDYMPQWGHFTYSYICKDDIFHEVEWFRNSTIYQIFPDRFAKFPPDTENSGKRTIHGGNIKGIIDRFDHLVKLGVDVVYLNPIFKSESYHRYDVVDYYEIDPMFGSKEELRELMDLCHKNGIKVIFDGVFNHSGDKFFAFRDVVEKGEKSKYANWYFINSFPVQGYPRPNYECFSFYGGMPKLNTGNPETAKYFLDVVKYWTVEFGVDGWRLDAADEVDRKFWRKLRDMLKDLNKDVVLIGEIFDEASSWLWGDQFDSVINYPLKAMINDLFAYRSIDVETFRNRISGYIMKFNKKVLSSLVNIISTHDTPRFLTLCNGDEKRFEMAVVFQFTFPGVPLIYYGDEIGMEGEGDPDCRRPMIWDEAKWNKKTLELYKFLIGLRKRFDALRTGEYGELPVTGCNGILAYRRGRGENGIIVAMNTLDRKENVVVETGDSFDTVKAFESLKDEERLNVDKKRINICLNPFEWRIYKACGEL

SEQ ID NO: 11581 - protein, 637 aa, Methanosarcina mazei Go1
MPIEDVLLDLKHKIEKNLPAGVTITDVEFEGPQLVLYTEEPRKFADDGNIIRNLAKELRTRIAMRPDPRVLATPEDSISIIEEVVPKESVISSYYFDPDSGEVIIEAEKPGLVIGKHGATLREITKQIGWIPKVVRTPPIKSRTVKNIREFMRNNLKERKEILKTVGRKIHRECTSKDQWVRVTALGGCKEVGRSCFLLSTPESRILIDCGVNVGSDENMTPYLYVPEVFPLNQIDAVIVTHAHLDHQGLVPLLFKYGYEGPVYCTPPTRDLMVLLQLDYIDVAAKEGKKIPYESGMVAKTLKHTIPLDYEEVTDIAPDIKLTFHNAGHILGSAISHFHIGDGLHNVVFTGDYKYEKTRLFDPAVNKFPRVETVISEATYGNANAFQPALKDAEKHLQMVVKNTIERGGIAVIPAFAVGRSQEVMIVLEESIRKGLIPEVPVYLDGMIWEATAIHATHPEYLNNDLRKLIFQKGQNPFLSECFKPVDSHEARQKIIQNPQPCVILATSGMMNGGPVMEYFKAFAEDPRNTLVFVGYQADGTIGRRIQKGWKEIPMTGKNGSTEMLKMNMEVQVVDGFSGHSDRRQLMEYVKRMQPRPERVFTEHGDEKACVDLASSVYKKLKIETRALTNLETVRLL

SEQ ID NO: 11582 - protein, 218 aa, Picrophilus torridus DSM 9790
MFENEKRMAAMEALKFVRNDMRIGIGTGSTAYYFIEGLSELVKNGLRITGIPTSKKSEELCRSFNIPVDYNIKDIDIDFDGADEFDPYGNLIKGGGGALVREKIVAYNSREFYVLVDHSKYSERLHKFPLPVEVLPFMSEKTLENIERLGCRASFRDDKKFISDNGNYIIDCVFSYTDPELESQIKMIPGVVEVGIFRHLSTKIFQGTIDGCRIIDVK

SEQ ID NO: 11583 - protein, 430 aa, Medicago truncatula
MSEKVLNNSPLNVPLLSEWKLGHSIDEEKVIVSHPSNKNTVSFFHTCVNGLNAISGVGILSVPYALASGGWLSLALLFCIAAAAFYSGILMKRCMEKNSNIKTYPDIGELAFGKIGRLIVSISMYTELYLVSIGFLILEGDNLSNLFPIEEFQVFGLSIGAKKFFVILVAVIILPTIWLDNLSLLSYVSASGVFASGVIILSISWTAAFDGIGVHQKGDIVNWSGIPTAVSLYAFCYCAHPVFPTLYNSMRNKHQFSNVLIVCFILTTAGYASMAIIGYLMFGSKVDSQITLNLPLNKISSRIAIYTTLVNPISKFALMATPITNALKDLLPRTYKNNRVTNMFVSTVLVISTVIVALVVPFFGSLMSLVGAFLSVTASILLPCLCYLRISGSYMKFEFETVTIVVIIFVAIAVGISGTYTSVVEIVQNL

SEQ ID NO: 11584 - protein, 964 aa, Gibberella zeae PH-1
MFTFCPLQGALSDSSASQSLLELDGGVKVLVDLGWDETFDVEKLKEIEKQVTTLSLILVTHATASHLAAYAHCCKNIPQFTRIPVYATRPVIDLGRTLIQDLYTSSPAAATTIPQSSLTESAYSLTQTATTARNLLLQSPNSEEIARYFSLIQPLKYSQPHQPLPSPFSPPLNGLTITAYNSGHTLGGTIWHIQHGLESIVYAVDWNQARENVFAGAAWLGGAGGGGAEVIEQLRKPTALICSSRGADRTAQPGGRTKRDEQLIDTIKACVTRGGTVLIPVDSSARVLELSYLLEHAWRTDAASEGGVLKSAKLYLAGRNMSSTMRYARSMLEWMDDSIVQEFEAFAEDQRRVNGANNKKEGGGPFDFKYLRLLERKAQIARLLSQNVENAGTEGRVILASDSSIEWGFSKDLIKGLAQDSRNLVILTDKPGLSKNGNPSIARTLWDWWKERKDGVSVEQNSNGDNIELVYAGGRELEIREPQRHALEGDELALYQQWLATQRQLQATQQSGGAAGLEAAADVVDDASSESSSDSEDEDGEQQGKALNVSTAIAQAGRKNVVLKDEDLGINVLIKKKGVYDFDSRGKKGRERTFPLTIRRKRQDDFGELIRPEDYLRAEEKEEDGQDSANVEMTDDKLGKKRRWDDVVKSGTGANKRPQAMRAGSHDGEEAGAGDGFVPDELDTVEDVETEEPVGPCKLSYQTETVQANLRIAYVDFSGLHDKRSLNMLIPLIQPRKLILVGGERDETLSLAEDCRRALGVDKSNPDNTGSERSVDVYTPEVGVVVDASVDTNAWVVKLADPLVRKIKWQNVRGLGIVTITGQLLATHLNEAAAADEDVANKRQKTEEPPSSTTLTNTAAAIPSATPVLDVLPANLISAVRSAAQPLHVGDLRLADLRRAMQSAGHTAEFRGEGTLVVDGTVAVRKTSAGRVEVESVGMPTARRSTFYEVRKMIYDNLAVVAGA

SEQ ID NO: 11585 - protein, 138 aa, Brassica napus
  misc_feature (44)..(44): Xaa can be any naturally occurring amino acid
  misc_feature (134)..(134): Xaa can be any naturally occurring amino acid
  unsure (1)..(138): unsure at all Xaa locations
SSAFASSASLAFLRPSLCSPPAAETLAASAASSNVSTVYISVIXDVISKVREDFITYGVGDAVLNELQALWEMKMLHCGAISGNIERTKAAAASAGGTSGTTPPVHDLNVPYEATSEEYATPTADMLFPPTPLXTPIQ

SEQ ID NO: 11586 - protein, 281 aa, Campylobacter upsaliensis RM3195
MQELVKLIQEAVIDISNALKFPDTSYSEEKNSSGDTQLKFDILSDEIITHHLSKSKALKALISEEKEEILKLNENAQFIVAYDPLDGSSLMDVNFAIGSIFAIYKEKVSPKNLKAALYSVYGARLELVCCEGKEVKLYRLNEGGKFDFVKELKMAEKGKINATGGTQKFWDNKHANFIKELFEEGYRLRYSGAMVSDIHQILLKGGGLFSYPATKDAPNGKLRAFFEIFPLAFIIEKAGGATTNGQNASLLELEFNQIHATSPCFFGSEYEINKLLKAYNG

SEQ ID NO: 11587 - protein, 143 aa, Pseudomonas aeruginosa PAO1
MALQRTLSIIKPDAVSKNVIGEILTRFEKAGLRVVAAKMVQLSEREAGGFYAEHKERPFFKDLVSFMTSGPVVVQVLEGEDAIAKNRELMGATDPKKADAGTIRADFAVSIDENAVHGSDSEASAAREIAYFFAATEVCERIR

SEQ ID NO: 11588 - protein, 161 aa, Aspergillus nidulans FGSC A4
MPLLEPTKLTSHRSFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 11589 - protein, 282 aa, Halobacterium sp. NRC-1
MTVDPAALQRQVSAPVVHRETCPSTNDIARAEARAGATDGTFVIADEQTAGRGRTGNAWASPPGGVWSSTVVRADIAASHVGRLTLAGGLAAADTAASFGVDARLKWPNDVVVAAADGSDQSKLCGVLTEAVIDEVPVAGKPVGSVLPETDPANADMSFAVLGIGVNAALDPDSLGDLDRAVTTLRAERGAVDPTAVAATLHEHLRTWVSRVQTAGGMDDAVAAVRERSATLGKRVRVTRFDDDPVTGTAVAIDDRGALVVERPDGARVHVTEGVCQRLRRA

SEQ ID NO: 11590 - protein, 269 aa, Corynebacterium efficiens
MSGIDAKKIRTRHIHEAKANGTKISVLTSYDAMTAAIFDEAGIDMLLVGDSAANVVLGRETTLSITLDEMIVLAKAVTIAAKRALVIVDLPFGTYEVSEQQAVESAVRVMRETGAAAVKIEGGVEMASTIRRIVDAGIPVCGHIGFTPQSEHALGGPVVQGRGSGADKLLADAHAVQAAGAFAVVLEMVPAEIATEVTNQLDIATIGIGAGNGTDGQVLVWQDAFGFNRGRKPRFVREYATLGDQLLEAARAYADEVGSGAFPGEVESY

SEQ ID NO: 11591 - protein, 188 aa, Medicago truncatula
MAFKGYILFLVMVLVANMCTQNEAQSGCTSTITSLSPCLNYIMGSSSNPSSSCCSQLSSVVQSSPQCLCSLLNGGGSSFGITINQTLALSLPSACKVQTPPVSQCKGGNGQTSPTSSTSPAGSPVDSPTESPEGAITPSANSDFPSGGAGSKSIPSTDGGSSNGSTIEVSFNLFLSLLAIVFCVITKF

SEQ ID NO: 11592 - protein, 824 aa, Chlamydophila pneumoniae CWL029
MEDFSSFDKNKVSVDSMKRAILDRLYLSVVQSPESASPRDIFTAVAKTVMEWLAKGWLKTQNGYYKNDVKRVYYLSMEFLLGRSLKSNLLNLGILDLVRKALKTLNYDFDHLVEMESDAGLGNGGLGRLAACYLDSMATLAVPAYGYGIRYDYGIFDQRIVNGYQEEAPDEWLRYGNPWEICRGEYLYPVRFYGRVIHYTDSRGKQVADLVDTQEVLAMAYDIPIPGYGNDTVNSLRLWQAQSPRGFEFSYFNHGNYIQAIEDIALIENISRVLYPNDSITEGQELRLKQEYFLVSATIQDIIRRYTKTHICLDNLADKVVVQLNDTHPALGIAEMMHILVDREELPWDKAWEMTTVIFNYTNHTILPEALERWPLDLFSKLLPRHLEIIYEINSRWLEKVGSRYPKNDDKRRSLSIVEEGYQKRINMANLAVVGSAKVNGVSSFHSQLIKDTLFKEFYEFFPEKFINVTNGVTPRRWIALCNPRLSKLLNETIGDRYIIDLSHLSLIRSFAEDSGFRDHWKGVKLKNKQDLTSRIYNEVGEIVDPNSLFDCHIKRIHEYKRQLMNILRVIYVYNDLKENPNQDVVPTTVIFSGKAAPGYVMAKLIIKLINSVADVVNQDSRVNDKLKVLFLPNYRVSMAEHIIPGTDLSEQISTAGMEASGTGNMKFALNGALTIGTMDGANIEMAEHIGKENMFIFGLLEEQIVQLRREYCPQTICDKNPKIRQVLDLLEQGFFNSNDKDLFKPIVHRLLHEGDPFFVLADLESYIAAHENVNKLFKEPDSWTKISIYNTAGMGFFSSDRAIQDYARDIWHVPTKSCSGEGN

SEQ ID NO: 11593 - protein, 226 aa, Bordetella parapertussis
MLTQQELKQQAADAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 11594 - protein, 168 aa, Triticum aestivum
  misc_feature (136)..(136): Xaa can be any naturally occurring amino acid
  misc_feature (146)..(146): Xaa can be any naturally occurring amino acid
  misc_feature (148)..(148): Xaa can be any naturally occurring amino acid
  unsure (1)..(168): unsure at all Xaa locations
MEASSCLRYQVRGFGSFRIWLCLLLLLVLQNCSPVLSDSPYLVGMGSYDITGPAADVNMMGYANTEQIASGIHFRLKSRAFIVAEPNGKRVVFVNLDACMASQLVNIKVLERLKARYGDLYNENNVAISGIHTHAXGPGGYLQYVXYXVTSLGFVRQSFDVIVDGIEK

SEQ ID NO: 11595 - protein, 275 aa, Kineococcus radiotolerans SRS30216
MTQATPQVTLHDGVGIPQLGFGVWQVPPEQTAEVVLRALQAGYRHIDTAAGYGNEAGVGDALRASQIPREDVFITTKLANSEHGRDKTLAAFDASMAKLGLDYLDLYLIHWPLQADDYVETWKAFEEIKASGRVRTIGVSNFQKTHLRKLLDETGTVPTVNQVEVHPYLVQEDLRSFHAEHGIATEAWSPLAQRAGLVEDPVVTGIAEQLGRTPAQVVIRWHLQQGNVVIPKSVTPERIVSNIDVFGFELPPEQVDALTGLDRAERTGPDPDVLG

SEQ ID NO: 11596 - protein, 257 aa, Prochlorococcus marinus str. MIT 9312
MLPSDLVKYKEQSQKIIALTAWDSISGSIAEQANVDLVLVGDSLAMVCLGYKSTLPLTLENIIYHTNAVSRGFKKKIEEQPLLVTDMPFLTYQCGEDKAVEYAGKIIQSTYAKAVKVEGAEPEIQKVISRLIRMGIPVMGHIGLTPQSYLNLGLKKQGESLESQEKIKKDASILEKLGCFSIVLEHMPELLAKEIQNNLTIPTIGIGAGNFCDGQVRVTADLLGLNDDQPPFCQPIIQGKHLFKDKLKEWVDSERLN

SEQ ID NO: 11597 - protein, 478 aa, Burkholderia vietnamiensis G4
MDITYDALHLFIDGEWIGASERETAPVINPATQIQIGRVPLATAADLDRALQAAVPAFDVWRNTVPAERARILKRAAELMRERAEHIATVMTLEEGKPLAESRDEVLRAADYFEWFAEEARRIDGRVVPSNRPGVQQLVKKQAIGPVAAFTPWNFPAITPARKLSAALAAGCSVIIKPGEESPATALALARALDDAGLPKGVLQVVFGVPDQVSTQLIASPVIRKVTFTGSVPIGRLLSARAAEGVKPITLELGGHGPVLVFNDADVEKAAVEGAANRFRGTGQVCISSTRFLIQREVYDEFVGHFVRATSALKVGNGMDAGTQVGPLANPRQLAKMEELIADAVERGATILAGGKRIEGEGYFFEPTVLADVPKDARVMHEEPFGPIAVLMRFDALADGLAEANRLPYGLSAYAFTSSARTAIDVADGLEAGMIGINQYRIVSTELPFGGMKESGHGSEGGTEGIEYYLTHKFISQA

SEQ ID NO: 11598 - protein, 168 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVIKEVEEVKKEYPDAYVRIIGFDNMRQVHCVRFIAFKPPC

SEQ ID NO: 11599 - protein, 218 aa, Wigglesworthia glossinidia endosymbiont of Glossina brevipalpis
MIEEKLKKQAAWAAIKYIKPGDIVGVGSGSTAEYFIDALGSIKNLIKGTVSSSRISSSKLKDLNIPLFDLNEVSLLNIYVDGADEINQKKHMIKGKGAALTREKIIASAAKKFICIVDSSKFVHVLGRAPLPIEVIPMARTLVSKKIIDIGGSPKYRKGIITENGNVLLDVHNLIILDSLFLEEKINNIPGVVSVGLFAHRAADIAIISGKNGIKIID

SEQ ID NO: 11600 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEVKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLDKETTYDEIKKVVKAAAEGKLKGVLGYTEDAVVSSDFLGDSHSSIFDASAGIQLSPKFVKLVSWYDNEYGYSTRVVDLVEHIAKA

SEQ ID NO: 11601 - protein, 220 aa, Thermococcus litoralis
MVREMELPSHKTKIIATIGPASKQKESIKKMIKAGMSVARINFSHGTLEEHAKTIETVRDVAEKLERRVAILGDLPGLKMRVGKIKGDSVTLRKGDKVVLTTRDIEGDETTIPVEFKDLPKLVSKGDTIYLSDGYIMLRVEEVRENEVECVVVNGGILFSHKGINIPKANLPIEAITPRDFEIIEFAIEHGVDAIGLSFVGSVYDVLKVKSFLEKKSADL

SEQ ID NO: 11602 - protein, 332 aa, Saccharomyces cerevisiae
  misc_feature (12)..(12): Xaa can be any naturally occurring amino acid
  misc_feature (48)..(48): Xaa can be any naturally occurring amino acid
  misc_feature (95)..(95): Xaa can be any naturally occurring amino acid
  misc_feature (233)..(233): Xaa can be any naturally occurring amino acid
  misc_feature (242)..(242): Xaa can be any naturally occurring amino acid
  misc_feature (287)..(287): Xaa can be any naturally occurring amino acid
  unsure (1)..(332): unsure at all Xaa locations
MVRVAINGFGRXGRLVMRIALQRKNVEVVALNDPFISNDYSAYMFKYXSTHGRYAGEVSHDDKHIIVDGHKIATFQERDPANLPWASLNIDIAIXSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRXPTVDVSVVXLTVKLNKETTYDEIKKVVKAAAEGKLKGVLGYTEDAVVSSDFLGXSNSSIFDAAAGIQLSPKFVKLVSWYDNEYGYSTRVVDLVEHVAKA

SEQ ID NO: 11603 - protein, 129 aa, Arabidopsis thaliana
MILAILALVIATFLYGGATTVQAGCRDTLTSLSPCLYYLNGGSSSPSWSCCRQFSTVVQSSPECLCSVVNSNESSFYGFKFNRTLALNLPTACNVQTPSPSLCNSKKLNYSNNIHFKNICLLIQIFCGL

SEQ ID NO: 11604 - protein, 351 aa, Streptococcus agalactiae A909
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYCPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 11605 - protein, 332 aa, Saccharomyces cerevisiae
  misc_feature (32)..(32): Xaa can be any naturally occurring amino acid
  misc_feature (324)..(324): Xaa can be any naturally occurring amino acid
  unsure (1)..(332): unsure at all Xaa locations
MIRIAINGFGRIGRLVLRLALQRKDIEVVAVXDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLAKEATYDQIKKAVKAAAEGPMKGVLGYTEDAVVSSDFLGDTHASIFDASAGIQLSPKFVKLISWYDNEYGYSARVVXLIEYVAKA

SEQ ID NO: 11606 - protein, 312 aa, Frankia sp. EAN1pec
MAEAPERRRWSAADVPDLNGRTAVVTGANSGIGFEAAKLLAGRGATVVMACRNPVKAQDALDTIRIAVPEADVSVLQMDLSSLTSVRKAADALVTERPVIDLLINNAGVMLLPQGKTEDGFEQHFGINHLGHFAFTGLVLEAVTASDAGRIVTVSSNGHRMGKIDFDDLDLAQKYRPFRAYARSKLANLLFTYELQRRLTAAGGSARSVAAHPGGANTEVGGNPSPVQRKLKKVVDHIPNPIVHSAFKGSLPLLRAAVDPSTRGGEYYGPSGLLKMTGHPVLVTSNAASRDTGTAERLWELSERLTMVTYPL

SEQ ID NO: 11607 - protein, 848 aa, Zea mays
MVSSPRLLFLLLAGASLCCVAAQKTDTLRQGESLSGAATLVSSPEGVFEAGFFAPDPKQPSRQYLGIWYHSISPRTVVWVANRVAPATSASPSLTLTVTGDLRVLDGTAANGTADAPLLWSSNTTSRAGPRGGYSAVLQDTGSLEVRSEDGVLWDSFWHPTDTILSGMRITLQAPGRGPKERMLFTSWASETDPSPGRYALGLDPGNSGQAYIWKDGNVTYWRSGQWNGVNFIGIPWRPLYRSGFTPAIDPVLGNYYTYTATNTSLQRFVVLPNGTDICYMVRKSSQDWELVWYQPSNECEYYATCGPNAKCTASQDGKAKCTCLKGFHPKLQEQWNAGNWSQGCIRSPPLGCETNQSGDGFLPMGNIKWPDFSYWVSTVGDEPGCRTVCLNNCSCGAYVYTATTGCLAWGNELIDMHELQTGAYTLNLKLPASELRGHHPIWKIATIISAIVLFVLAACLLLWWKHGRNIKDAVHGSWRSRHSSTQSQQNSAMLDISQSIRFDDDVEDGKSHELKVYSLDRIRTATSNFSDSNKLGEGGFGPVYMGTLPGGEEVAVKRLCRNSGQGLEEFKNEVILIAKLQHRNLVRLLGCCIPREEKILVYEYMPNKSLDAFLFNPEKQRLLDWKKRFDIIEGIARGLLYLHRDSRLRVVHRDLKASNILLDADMKPKISDFGMARMFGGDQNQFNTNRVVGTFGYMSPEYAMEGIFSVKSDVYGFGVLILEIITGKRAVSFHCHEDSLNIAGYAWRQWNEDNAAELIDPVIRASCSVRQVLRCIHIALLCVQDHADERPDIPTVILMLSNDSSSLPNPRPPTLMLRGREIESSKSSEKDRSHSIGTVTMTQLHGR

SEQ ID NO: 11608 - protein, 792 aa, Heterocapsa triquetra
MAVKMGINGFGRIGRLVFRAGMENQSVTVAAVNDPFMDLEYMKYLLKYDSVHKQFVGNVETKKEGDAEYLVVDGLPIRVFHEKDPGAIGWGAVGAAYVCESTGVFTTQEKAALHLKGGCKKVIISAPPKDDVKMFVMGVNHLDYSKDLTVVSNASCTTNCLAPLAKVINDKFGIVEGLMTTVHAMTATQLTVDGPSRGGKDWRGGRCASQNIIPSSTGAAKAVAKVVPALNGKLTGMAFRVPTPDVSVVDLTCRLEKGATMDEICTAIKDAAALDKAKGGMKDVLGFVDEEVVSTDFATCPLSSIFDKCAGIALTEKFVKLVSWYDNEWGYSNRLVDLACHMAVVDGVVPPPAKIVSIKAREIFDSRGNPTVEVDLVTDAHLFRAAVPSGASTGIYEALELRDGDKTRLLGKGVLKAVSNVNELIAPKLIGMDVTKQKEIDKLMVETLDGAQNDWGWSKANLGANAILAVSMAVCRAGAASMQMPLYEYIANLAGKPTDKYVLPVPSFNVINGGSHAGNRLACQEFMILPVGATSFKEALIMGCEVYHTLKDVIKKKYGQDACNVGDEGGFAPSVQDNNEALDVLMTALEKSGHAGKVKIGTDVAASFYKEGKYDLDFKNPDSDKSAWKTGAEMAKYYMEWFDKYPFVSIEDPFDQDDWEAYSGFQAMVGDKMQIVGDDLLVTNSKRINKALDVKACNALLLKVNQIGSITEAIDAACLSMRNGWGVMVSHRSGETEDSFIADLVVGLRTGEIKTGAPCRSERLSKYNQLLRIEEELGAKAVYAGENFRCPK

SEQ ID NO: 11609 - protein, 367 aa, Synechocystis sp. PCC 6803
MEIPGQSILPPMNTSSPVFIPVILAGGKGERFWPLSRRQRPKQFLSLDGSGVSLLQATAQRLLSLAGDWENLWVITAAPIAEGVFEQLPSLPKENCLVEPEGKDTAPAVAWASLEIAQQYGDDAIIGFFPADHWIKDQCAYEQTLKAAIAYAQEQDAIVTLGIKPHGPATGYGYIEQGTLEREIDGLPVYQVTRFTEKPDRATAQTFVDSGKFSWNSGMFIFRAGVVLRELDRHAPELLATLRAKGAAGYPALEKKSIDYVLMEKTQLAAVLPANFGWDDLGDWNALERLFPETEANVDLANHVNLHSRGCIVYASDENQIIATIGLKDVVIVREGNVTLVVPKDHTQDIKDLLKQLQSQPEYENLL

SEQ ID NO: 11610 - protein, 346 aa, Arabidopsis thaliana
  misc_feature (328)..(328): Xaa can be any naturally occurring amino acid
  misc_feature (337)..(337): Xaa can be any naturally occurring amino acid
  unsure (1)..(346): unsure at all Xaa locations
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQXNSKTSLRVXEWCCTASPC

SEQ ID NO: 11611 - protein, 164 aa, Oryza sativa
  misc_feature (30)..(30): Xaa can be any naturally occurring amino acid
  misc_feature (128)..(128): Xaa can be any naturally occurring amino acid
  unsure (1)..(164): unsure at all Xaa locations
AGIRHEVAQKVCGGDFFYIAENNVMFEGIXLKPSMVTPGAECKDRATPEQVSDYTLKLLHRRIPPAVPGIMFLSGGQSEVEATQNLNAMNQWPNPWHVSFSYARALQNTCLKTWGGQPENVKAAQDAXLLLRAKANSLAQLGKYTSDGEAAEAKEGMFVKNYVY

SEQ ID NO: 11612 - protein, 967 aa, Yarrowia lipolytica CLIB122
MSRQKKSREIRFGDYILGSTLGEGEFGKVKIGWRKDGKQPEQVAIKLIKRETVPPNSNREAKVHREINALKILTHPNIVRLEEVIQNDRYIGIVLEYASGGELFDHILTHKYLKEASACRLFAQLVSGVHYLHSKGIVHRDLKLENLLLDKHKNIIITDFGFANTFSRGSDGHVFDLMATSCGSPCYAAPELVVSDQKYTGRKVDVWSCGVILYAMLSGYLPYDDDPANPDSDNITQLYKYITTTALTFPEYVPPLPRDLLRRILVPDPRKRISLNDVRYHSWLAPHSRFLAITPKEWEDAVGKVAVPVKTHMPRSHSVQLSSGAPVFDSRLTKPSGVNIPNFSYNNRHSVGGTYSKPIQRQGESTIGATVSSNTPAGPRPISAGPCAATAAAASASKSHAAANPPTHASTPSVASLNIPEDTNNNSTSNSRQAPRSATYTGISQLTSPPGASPTSPKFDFDLPKPSIGTITEQPTPPSSPKVKEKGKEADDLGPRDLPAVPDTAPEATPPASAADTIPSAPATAPSAPVLEHQSFGASFGTSFSSSFAASDPSSPLVSSTRLPPGRKPRPTSYQPTPTQSSMQPPDSFPYMHMVNKNASVPGSANSVTPTSSQQSAQPVPLSLVTPSTAGSTFFRRPSSDDSQISFDERRKSGSFLVPQSSLPKVKYSDSMVQGELSSPQFRNSPSQVALSNWSNRNSVASMESGDEGVIGEVESVAEKKETDKEVVDTVAQSDTTLMPPPALPTSAQVPGKSTTPRAVSAESKTTSTSRTSMEKPLPVVPAASAAPAAVIPTAPSGAINPGAPNFSRPRPVSMQAPKAQTRSHRRGVASISYGADKLFGKIIGDNLDNDKDPRESKESVKDAKGGSSSAASGAGAPTAESTSKKRFSFFSNYSKESVESHEAHSTPSTSSRKILEPPALDRSHSMNQRQNRQVSASQVSTAESTHSSTARKVMDFFRRRSRVSAS

SEQ ID NO: 11613 - protein, 431 aa, Wolinella succinogenes
MERINSINDFNEAKQVIPGGVNSPVRAFRAVGGTPPFIKEAKGSYLVDEDGNRYIDFVQSWGPLLFGHADLDIQKAVEEAIKRGLSFGAPTTSETLLAKEIIALYEGIEKIRFTSSGTEATMSAIRLARGYTGRDDIIKFEGCYHGHSDALLVQAGSGLATFGNPSSPGVPQSFTKHTLLARYNDLESVRECFKKSSGVACVILEPIAGNMGLVPATQEFIQGLRKLCDEQGSVLIFDEVMSGFRASFGGAQALYGVIPDMATFGKVIGGGMPVGAFGGRSDIMACLSPEGAVYQAGTLSGNPVAMAAGIASIRKIKQGGEALFSRLESLALRLMEGFKKCAQKHQIPLQTTVRGSMFGFFFNHAPVSNFEEALQSDTALFAKFHQAMLERGVYLACSQFETGFICASMDESLVDEVIAKIDEALEEIGRG

SEQ ID NO: 11614 - protein, 1647 aa, Ustilago maydis 521
MSQPGARRAYHHGSQRGGSTINQKAALASAYQELGKELSSSKLKIVGNYTLQRPIGEGTFGKVRLGLHRLTNTRVAIKQIPKAHSASLTREIHHHRRLHHPNVMQLYEVIATEQYIWMVSELCAGGELYDYLVENQVLAEPEARRIFGQLCLAVAYVHSKGIVHRDLKLENILLDERCNVKLGDFGFTREFERNRLMDTFCGTTGYASPEMLAGKKYTGEQVDIWSLGVILYALLCGALPFDDDDEAVMKQKILQGDFEIPDCLSEEAHDLVVSILQHDPAKRPSIQSILAHPWFTKMMVNSPMSTLEEDQIATDYFASKPSASTSQSKQHDRFPPTLHKALAELDTATELDTADATSAAPPTNPADAFDFEDHDSSNSCHRHHLSASSEQSYHSARSDSESSGRRSTNTDLTDPTTADSLSGTDEVEGLDQAIVQLNASSRPSALANATAAASHPDKNAIGLHRNERLGSNGSDASLSGVPRPSTKTNTASLPTHHELPPVPDGTGQDDHLSIYQSVPLTKRGSQSSSRGHHRTPSRTKRRSLSSGGLSDHHPPMLGRKPVDYVSQLADLQPATFSTSIEQNLLHQLSALGLDVGQMVHSVVTDACDASGATWWMLLRKSKDRHSEQPDITSPIVQVIPAPGDHPAPINASAFSKAGQTVTPSSPAQFSPPPVPVKDPARRSEDKFRTQERPTTLEASSSENAGLAEQSIRRLQTVVSHEELDVSAAPALHTSTSELMMATKPATDRQSSVPASGPMPLAGLPASTVSLPNDRSLTSTPDSVSSRPKSQHRHTTAVASPAKLQHVALTTLEGSPTSEGSKARGNSQNDRPRSNSLSVRQFAQSVLGTKDRGSATSSPVRPPPEQVVVAGEALPLERAKSPTLFGRRNTVSNVKDSMVGRLSGPSTPKKTPVDMLDKPRKSTGKKSCETDLDRVKALERSADSASSSPSRSTTGQAVGVVSNAKVDSSVPSASQDSFSTMSVTPQGSEKSGHRGKAGSFFMSTVRTWLGGNEKPTRKSKTGKQASASHRGLGIDDGPMAAKSPTNSLSTSGSVSTLTYGTPSRSASVRRRSAHYQQTSATRRGGPRSPHLGTSSRRSSNGSSYQAHLELPPNSFQQSMNRPANMRRMSAGSITPTATLHGDYLNDVGGVSGASRHSRPSSSHSLAHSGAASRPGLHGKAGSTGSTSSAYRPGQASSVYSTGSGRRHPRPSQDGGTTVRRHRTYASSSGSPSRRNSFRHDSRPSSIKSRASSPGRAMSGLGELWAADAEADGDGGGTGARRSTRSTPRHSLEMRKTGEAFDSAAPHHQHHQHVVAQSIFVAHKSRSPYRPPSANPNLHGSLVRGSSQLSGRSNVSANSEDAGYVAPNSTLGLPATGTGAWRHSWGRPPPCWAGPVDPPPTSSYSKRSGAAGVEDDGRPKLRDVFANRDDDDWTDEEEEQTYSGGLGQMGTLSSAMSSSVGRVGSGIGASSSPYATRNLAALGSSGYSTQRAVNLDTANAPEIGLREAPFSSRYAGVRNMFQTATAGTPAFGSRSHHSVSLSLGNEFAPRLLSTTIHSPTVSAASLGGGLGCIGESADAHSVTVSSKPKPESSGTQTQAQQQQSSASASASASASQQQQSGGGSSGSGSRITASFHKPVQIIEEEEEDE

SEQ ID NO: 11615 - protein, 251 aa, Oryza sativa (japonica cultivar-group)
MLAVFDPTVAKCPEGLRSPPVAGGAVAAGGAGALMKGFAGAHADAVTVSLGPAGALAYSAANQSPLVPRLFGAVNDIFCLFQGHIENIASLKQHYGLSKTATEVTILIEAYRTLRDRGPLPASQVVRDLSGKFTFILYDTLSKSTFVAADADGSIPFFWGVDSENHLVFSDNVDLLKASCGNSFAPFPKGCFYTTSGGLQSFEHPLNELKPVPRVDSQGQMCGSNYKVDSEAKKDSGIPRVGSAADWSNHF

SEQ ID NO: 11616 - protein, 194 aa, Oryza sativa (japonica cultivar-group)
MFSNSGFVLLPRLFGAVNDIFCLFQGHIENIASLKQHYGLSKTATEVTILIEAYRTLRDRGPLPASQVVRDLSGKFTFILYDTLSKSTFVAADADGSIPFFWGVDSENHLVFSDNVDLLKASCGNSFAPFPKGCFYTTSGGLQSFEHPLNELKPVPRVDSQGQMCGSNYKVDSEAKKDSGIPRVGSAADWSNHF

SEQ ID NO: 11617 - protein, 401 aa, Blastopirellula marina DSM 3645
MSHRFSSVQSAVDAISRGEIVIVVDAEDRENEGDFVAAAEKITPESVNFMITHGRGMLCAPVLPDVCQRLDLHPIVETNNAPLQTSFITPVDHHTSKTGITAKERSDTIQALADPQTTVDDFVRPGHVYPLLAKEGGVLRRAGHTEASVDLARMAGLRPAGVLCEILDEAGDRADRDQLIELAEKFKLEIISIEQLIAHRRVNEKLVSRAAEADLPTKYGQFKIIVYSVEYETQEPVVLIFGEPEKQERPLVRLHSSCFTGDLISSLRCDCGDQLQMALETISKEGHGALVYLPQEGRGIGLTQKIRAYGLQDHGLDTVEANHALGFKADMRDYGIGIQILKDIGLRQIRLLTNNPKKTDAFIYGGFDLEVVDQVPMASPVNEFNEKYLATKRDKMGHTLP

SEQ ID NO: 11618 - protein, 267 aa, Kineococcus radiotolerans SRS30216
MSGTLALVGAGVMGQTLLGGLLRAGREPGGVLVVDRRPGRARELHERFGVRVVDDVGAVAGASTVLLAVKPQDLLALLDSLAGHLAPDALVVSLAAGVTTAAIEARLPAGTAVVRVMPNTPSLVDEGMAGLSGGSACGDEQLAEAEDLLRSCGRTVVLAEKHLDAVTALSGSGPAYVFYVVEAMVEAGVLLGLPRATATELVVQTVVGAGAMLRETGQHPTVLREQVTSPAGTTAAALRQLDDSGVRAALVAAVEAAAARSRQLSGS

SEQ ID NO: 11619 - protein, 257 aa, Zea mays
  misc_feature (7)..(7): Xaa can be any naturally occurring amino acid
  unsure (1)..(257): unsure at all Xaa locations
VALRNCXRVEKMEDPVTPVKEILGICPHEKLLSMYKVPSFSSVDDFLQKVSTVRGKLKKGGVVDVEAAARIVLHDWNEGKIPYFTLPPKRDAVEDSDVVIISEDGKEFNIDEIYKAESSYIGGLKSIEEFHHIEIPPNAPPAIDKEMLEDGSKPSEPAQENREEQMSDANDPQGSKPATASTQNDKLYTAEGILDPRKRKAEKKRRKANRFSVLNDMDADYDFKVDYQMEDAADGEDEDAGDEAKEDNEPMTGVDDS

SEQ ID NO: 11620 - protein, 262 aa, Oryza sativa
  misc_feature (102)..(102): Xaa can be any naturally occurring amino acid
  misc_feature (118)..(118): Xaa can be any naturally occurring amino acid
  misc_feature (132)..(132): Xaa can be any naturally occurring amino acid
  misc_feature (166)..(166): Xaa can be any naturally occurring amino acid
  misc_feature (192)..(192): Xaa can be any naturally occurring amino acid
  misc_feature (205)..(205): Xaa can be any naturally occurring amino acid
  unsure (1)..(262): unsure at all Xaa locations
FLSRCFWLSNTHQHHRYCRFPPEACFLSKSPMLGSMNASLVCCANPSNNRPRNSDISRQQKDGLLFGKKKALPRNIYDCENIYDFDCYIVFSKGGPAISVLXASNSRPLATSTPGIRXKIVELFEMIQAQLXRGQHPEHKRPEPTEDQWERGSVDPILNLLRKHSXELKRKINDGKELSSDETWRGNDSGNXQNSRIFGVKNDIXGRANVLLHTRPTPNCRRRSLVRGVRFQPVVTNGDMQLQMPSLSQIAWLIMTSLSQIA

SEQ ID NO: 11621 - protein, 255 aa, Wigglesworthia glossinidia endosymbiont of Glossina brevipalpis
MIDYDLLSKIIRKLSNAKSYKIEKLFNSRFFCDELINKYFIKMNSIGIDIFIKQNKYFFLKNPINLLNKKYISKKCFPNKVTFLDIIDSTNNYIYKNKLNFLSGDSCIAEYQTKGRGKRGKKWFSSFGNNICLSMYWNSKKKIQTISILSFTIGKIIKKILYNIGISKVEVKFPNDIFVNDKKISGILIETYNNIDNTIDVIIGIGINLNLNIKISNLIDQKWTDLNKNKTPIDRNFLISYVICSVRKELSKLEI

SEQ ID NO: 11622 - protein, 291 aa, Carboxydothermus hydrogenoformans Z-2901
MNLWSPTTLKEILARHNLTLSHGLGQHFLTDFGILAKIVEKAEITKDDAVLEIGPGAGVLTRLLAQAAKYVVAIEIDKKLLPVLAETTGDLGNVVVVNADAREINFDRVMAEQTGGEFGFEGKPYLIVANLPYYATSPLIFKVFEEGYKVSSMTLMMQKEVAERITAKPGSKIYGSLSVACQYFSEPRIVLKVPRTVFFPPPEVESAVVRFTLKENSLTSEERLKFFQIVRAAFATRRKTIAKSLSGALNLKRNYVEEVLLKVGIKPDLRAEQIPPESFYRLSQEVVGGKW

SEQ ID NO: 11623 - protein, 98 aa, Zea mays
  misc_feature (59)..(59): Xaa can be any naturally occurring amino acid
  misc_feature (65)..(65): Xaa can be any naturally occurring amino acid
  misc_feature (75)..(75): Xaa can be any naturally occurring amino acid
  unsure (1)..(98): unsure at all Xaa locations
FDLDDTCQIGEIISRFEKKGFYLMDLKLVNVERSIAEKHYADLASKPFFQGLVDYIISXPVVAMXWEGKRVDTTXPKIVGATNPLRFEPGNLRGALCL

SEQ ID NO: 11624 - protein, 90 aa, Arabidopsis thaliana
AFNGLMCSSSISDTRKANNDMGSITSNGGRVNCMQVWPTIGKKKFETLSYLPDLTDSELAKEVDYLIRNKWIPCVEFELQHGFVYREHRN

SEQ ID NO: 11625 - protein, 271 aa, Xanthomaculina hottentotta
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIVEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDLKGIMSYSEDALVSTDLNGDNHSC

SEQ ID NO: 11626 - protein, 144 aa, Glycine max
TTQQPPFQGLGTSSKLTPLQLESLLTEGTTTRLWLVEFRSSYSPACIRSSQQFPELSITYSSKNLSFGIVDLGLFPNAAERFGISLSGSMGQLPTFILFENAAEVARFPELDFEAAYFHPKITKGLLSRHFELDRHLLEYVSGK

SEQ ID NO: 11627 - protein, 341 aa, Idiomarina loihiensis L2TR
MKALSKLHAKPGIWMTDVEKPECGYNDLLIKIKKTAICGTDVHIYKWDDWSQKTIPVPMVVGHEYVGEVAAMGDGVRGFEIGDRVSGEGHITCGHCRNCRAGRRHLCRNTYGVGVNRPGAFAEYLALPAENAFKLPDDVTDEMAAVFDPFGNAVHTALAFDLVGEDVLITGAGPIGIMAAAVARHVGARHVVITDVNEYRLDLARKMGVTRAVDVSKEKLSDVMTELGMKEGFDVGLEMSGVPSAFSQMLETMNHGGKIAMLGIPPENIAIDWNQVIFKGLVIKGIYGREMFETWYKMASLLQSGLDISPILTHEMPIDDFEKGFETMISGQSGKVILNWD

SEQ ID NO: 11628 - protein, 231 aa, Oryza sativa (indica cultivar-group)
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISRCMNAGAEDFIVKPLQSKDVQRLRKCSPANTQCCDAGSDGKPPLLLLPSDHVVVDATAASPPPPPSRRRAHFAGVAMVLHSSSVELSHYFPFLFKFILLVYAILCLGELLHRWSNGCFLNLWCA

SEQ ID NO: 11629 - protein, 154 aa, Methanopyrus kandleri AV19
MAEVQREFVMIKPDGVVRGLVGEVIRRLERKGLKIVALEMRQLDRETAEKLYEEHRDKPFFEDLIEYVTSGPVVVMIVEGRKAVKVVRNIIGATDPAEAAPGTVRGDFALDIGRNVVHASDSPESAEREIEIVFGKDLSTIDYERCDEEWLYES

SEQ ID NO: 11630 - protein, 482 aa, Xylella fastidiosa 9a5c
MLPTSHTPCMESAPPMNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDEAAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFENSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIIVSGTAEVTRGSEILLLTENQSTYIPLGVTHRLRNPGKLPLELIEVQSGSYLGEDDIVRFEDTYGRT

SEQ ID NO: 11631 - protein, 877 aa, Zea mays
MSGGGDGGDKEAFFHCLDRVPSGLHLDADFPSDDEEDDEDDVRVSFTSAAGDQHFKSFRYQAAVPVEDDEDDDDDDDDDEDTSKYDMWMSDEPMSIQERRRRLHQGLGMASSRDLALRRHSMKKRPADVPRAMSRSVSRSKPPPSPIPANAASAANVPSTTSVAQAAAAAPRPAKEVITRRRSDSNLVVRDGASVSGKPPSQQPLRRVLSLPARPDARDSTPVVGKPQAGAPRGLPVVPPQAAPGIKGGKGDGDEGSKNNRDGEKEVAVVAASTPKDASSSTQQQTGVLGLEEFEKFIGNTPIMKLMRRGTSQNQPAPLPAGVPPKADKSGGKKKGGWLKNIKSVAIGFMQDKDANAKSGVVSAAAAVPKSVPTNASAGSAAPPAAGSERPKVHQYGKSSKELTGLYMCQEIQAHEGSIWSIKFSADGRRLASAGEDSVVRVWQVVETSAPPCSLAMDGKSGPLAPLPSPGAADGASSTTTPALASMPKKPAKGKSGGRDALPEHLVVPDKVFALAEQPACVLEGHQDDVLDLTWSKSDQQLLSSSMDKTVRLWDTESQACLKTFAHSDYVTCIQFNPVDDRYFISGSLDAKVRLWSIPDRQVVDWTDLNEMVTAASYTPDGQGAIIGSHKGSCRLYKTADCKLSAEAQIDIQPKKRKAQAKKITGFQFAPGNPAEVLVTSADSQIRVFDGVTMVQKFRGFKNTSSQITAAYTSDGRYAVCASEDSHVYLWRTTRVPPAAAIGIGMKPKAWCTIRSYENFYCKDVSAAVPWTQSPSPPGAGDGSPTGGSPASADKPPQVASCNDESCSVAAKPEGGDPSSCSAAAAEPSSSARQGGAKGDGGNAWGLVVVTASLGGEIRVYQNFGMPFRIKGQANFF

SEQ ID NO: 11632 - protein, 355 aa, Ustilago maydis 521
MSAPTTMKAVVIQGPEQVAVLERPIPKPGKGEVVVKVNLAALCGSDLHIYRGHQAVPRYDFVLGHEFVGEIHEAGEGIKNWKRGDKVVSPFTISCGDCFFCNRNQTGRCTQSRVFGSVPLDGAQAEYVLVPLADTTLYPIPDDVPEEIMLLTADIFPTGYFVANNAYTMLNEAERKDVTAVVIGCGPVGLCAITAACSFFKTVYAVDSVPERLAEAKKHGAIPLHLTDDDPVKTVKEATGGRGADVALEVVGAGPALDLAVSIVRNFGVISSCGIHTHTVTLQGPDLYNKNLRFQFGRCPVRAVFDPAVKLLSKHHDLFASFIQHTRPIEDAPEYYKLFNDRKVLKTVFKMNHAQ

SEQ ID NO: 11633 - protein, 794 aa, Oryza sativa
  misc_feature (779)..(779): Xaa can be any naturally occurring amino acid
  unsure (1)..(794): unsure at all Xaa locations
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTDQAYTLNLXVIKALRTHPRIRRLV

SEQ ID NO: 11634 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 11635 - protein, 94 aa, Brassica napus
RLVDLPPQEEISGMGMSKVIRADQKRFFFDLGSNNRGHYLRISEVAGVDRSSIILPLSGLKQFHEMVGHFVDIMKDRLEGMTGANVRTVESSQR

SEQ ID NO: 11636 - protein, 326 aa, Kineococcus radiotolerans SRS30216
MKIVITDCDHDSLAEERAVADAAGAELLLAPSAAAADVVAAATGADALVVQYARVDADLLDALPTVRAVGRYGVGVDTVDVDACTARGVAVCNVPDYGTESVSDHAIALALAAARRIAWMDRRVRAGAGELAPLRPVHQFGGRVFGVVGLGLIGAATARKAAGLGYRVVATDARRAPGTTVDGVEVVTLDDLLARAHVVSLHVPLTEGTRHLIGAAELARMRPDAVVVNTSRGGVLDTAALADALRAGRLHGAGLDVFEEEPLPPGHPLATLDTAVLTPHLAWYSEESYGELKRRTVQNVVDVCAGRPPADVLNPEALGTPAGGRR

SEQ ID NO: 11637 - protein, 220 aa, Oryza sativa
MFNRLFGKPKEQANASALATLDKLNETLDMLEKKEKVLEKKAAAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALSAPLGASADFDEDELEAELEELEGAELESQLLEPVAAPPVHPVQVPGTRIPTRPAPQKASAEEDELAALQAEMAL

SEQ ID NO: 11638 - protein, 148 aa, Arabidopsis thaliana
MPERIKEKLMKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFRERE

SEQ ID NO: 11639 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 11640 - protein, 69 aa, Zea mays
MATHRLVMVRHGESSWNQENRFCGWFDAELSEKGAEEAKRGATAIKDAKIEFDICYTSVLKRAIRTLWT

SEQ ID NO: 11641 - protein, 276 aa, Carboxydothermus hydrogenoformans Z-2901
MINWYPGHMFKTKKALLAQVKLVDVVLEIRDARIPLSSKNPDIEEICKNKPRIVLFNKKDLADVEKTEEILKKLPWPEGVYYCLVESKATGGLKEVWNIIEKVYGQYKEKWSGKGLRPRPLRGMVVGIPNVGKSTVINRLLKRSVKTGAKPGVTRGVQWIKLSDKLELMDTPGVLWPKLGDMEVGLKLGATGSISDEVLPVIEVANWLLKILCTYRKPEFFNRFNLNGSENLNEIYEKIGRRRGLFLRGEEIDYQKVALVILKEFRQGLLGKYTLD

SEQ ID NO: 11642 - protein, 441 aa, Parvularcula bermudensis HTCC2503
MTAAGSNDYPSTELLVARRNDACPMGLPSKSGLYAERAEGAEIWDVDGKRYIDFIAGIGVLNVGHRHPKVQEAIKSQLDKVVHTAFGVAQYEPYIALAERLNELVAKAGNGASAYKTMFVNTGSEATEQVCKFARRITGRPGLIAFEGAFHGRTLLATALTGKAEPYKAGFGPFPPDIYHAPYPNPYMGMSVEGALNCLHHIVGTSIRAEDVAAVIIEPVQGEGGFIPAPIDYLRGLKEFCETHGILLIADEVQTGFARTGRMFAIEHAGVEPDFLICAKSIAGGLPLGAITGKASLFDKIAPGGMGSTFGGNPVACAAALAVLDVIEQEGLIERAEVIGQRIEARWRDLAEGPARGIFGDIRRAGAMAAIECVRDADAREPNPDFAAALQSMARDKGLIFLTAGRKAHVIRTHVPLTIADDLLEEGLDLFAEATLATLKG

SEQ ID NO: 11643 - protein, 241 aa, Glycine max
  misc_feature (131)..(131): Xaa can be any naturally occurring amino acid
  misc_feature (153)..(153): Xaa can be any naturally occurring amino acid
  misc_feature (171)..(171): Xaa can be any naturally occurring amino acid
  unsure (1)..(241): unsure at all Xaa locations
LTYLFLFCINNYTVLTTGYVYLGARTTDELIANADYIGTAGKGILAADESTGTNGMRLTSITVKNIEYNKRALKELIFTDPGVLKYFSGVILYEETLYHSTIASQPFVNVLNEAGELTGINVDKGTVELAXTNGETTTHGLDGLDQRCAKYYXAGARCAKWTAKLQIVPNXPSELSMHENSYGLLRYTGICQENRLITIVEPEILGERPHDIDKCSRVTEQLLTLCYKAMNDHHVLIEGTL

SEQ ID NO: 11644 - protein, 371 aa, Malus x domestica
MGKGGMSDGDHADRCCGEAINGDVQQENMAAWLLGVKNLKIQPYKLPNLGPHDVRVRLRAVGICGSDVHHFKNMRCVDFIVKEPMVIGHECAGIIEEVGSEVEHLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 11645 - protein, 394 aa, Adiantum capillus-veneris
MSIRLEDIDPVVVSMGPHHPSMHGVLRLVVALQGENVVDCELILGYLHRGMEKIAENRTTSQYLPYVTRWDYLATMFTEAVTVNAPEKLANIQIPERASYIRVIMLELSRIASHLLWLGPFLADIGAQTPFFYIFREREMIYDLFEAATGMRMMHNYFRIGGVAADLPYGWIDKCLDFCQYCLPKIYEYERLVTKNPIFLKRVQGVGFINRQEAINWGLSGPSLRASGVQWDLRKIDHYECYDKLDWQIQWQGEGDSLARYLVRIDEMKESINILRQALKLLPGGPYENLEGRRLVQKKDKIDWNGFNYQFVGKKSSPTLKLPKQEHYVRVEAPKGELGIFLIGDDSVFPWRLKIRPPGFINLQIVPQLIRGMKLADIVTILGSIDIIMGEVDR

SEQ ID NO: 11646 - protein, 426 aa, Zea mays
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTRAEKRTFLRQRVEARLAALLLENQEYTEALTLLTSLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDPKTEETFPATLETISNVGKVVDSLYVRSAKIMA

SEQ ID NO: 11647 - protein, 708 aa, Yarrowia lipolytica CLIB122
MNKTPLHSDVVKPKGPPSGPKPQYHKKKTPNNTGLGKTLMNRKAKEGRVYVTDSGETRYTTEENKEAGWVKLRSVTQEKALDEFLATAELADTDFTAERRAHTTIINTHDNSNPYLLTKAEAEKLREKQLENAGKLTVPRRPVWTEDTTSTQLDREEKEAFLRWRRSLAELQENQDLLLTPFERNIEVWRQLWRVCERSDLVVQIVDGRNPLQFRSEDLELYVKEIDPRKRNLLLVNKADLMTEEQRQIWADYFKKHGIRYAFFSAAKAKEELEALEAREEAQATKKPAKKPVKNDDSDDEVSALERELAQFVPKEESEDEDEEEDEEDEEDDVEPSVTEIQEAVPANAHEEAKATDESKPDTENMHYSVMATPTSILSVDQLEQLFLAEAPAPMQPAPAGQEPRLNIGLVGYPNVGKSSTINALVGSNKVSVSATPGKTKHFQTILLSPKVMLCDCPGLVFPNFGNTNGELVCNGVLPIDQLREFTGPATLVSRRVPKYFLESVYGIKIYTRPVDEGGLGYPTATEFLVAYAKARGYMRGASQGNPDESRAARYVLKDYVNGKLLYCHPPPDYREDLDDEDAGILFNKGLYTLNQLPPSRQKQLLDAAVHSGIAREDFDLERDIDKLSFSQHATGAGGFGGKGFSSLGEHLDADYFGKNSSGGNMSTPFHQRGAAQGTKKHFKGKKVKARNARSTNDNYGGTYGDII

SEQ ID NO: 11648 - protein, 452 aa, Eremothecium gossypii
MYSKEDWGGKIEPYIEVNMQKLEGKALVAVFGFQDFRKLGYQDHGELRMVCTQEAVNAQRCTAEELGQLLVRKKVYNPETGQNETLRSEVKSMRVEKEGVLEPRYPVKETGFYCVFVYAPDVKYAGEVTFQNAFGHLPASDVNNLMLYGLLAVAYAIAMALYMFAVWKHKHELLLLQKYILAFFLFLTLETILVWSAYDLVNRKGVTAGTITYNVFISIINAGKVSMSCFLILIVALGYGVVYPKLNRKLMRRVQVFTAFNFVTMAAAIIHSSLTRAENVGVSLLLSVFPVLTLIVFYVLIIRSLGSTLGYLREHKQVVKLNAYRKMFMLIIGSIVLNILGVFFSIFSMARRNDDEIISNLWKTKFIMEVWPSFVYFLVFVVFAFMWRPTDTSYMLACSQQLPTDPENVTDFDLDDLQSLNDDASNRRVNDDEINFSDEEGPGSYHPSHQGK

SEQ ID NO: 11649 - protein, 239 aa, Arabidopsis thaliana
MDFNASSFFTFDNHRSLISPVTNGGAFPVVDGNMSYSYDGWSHHQVDSISPRVIKTPNSFETTSSFGLTSNSMSKPATNHGNGDWLYSGSTIVNIGSRHESTSPKLAGNKRPFTGENTQLSKKPSSGTNGKIKPKATTSPKDPQSLAAKNRRERISERLKVLQELVPNGTKVDLVTMLEKAIGYVKFLQVQVKVLAADEFWPAQGGKAPDISQVKEAIDAILSSSQRDSNSTRETSIAE

SEQ ID NO: 11650 - protein, 470 aa, Leifsonia xyli subsp. xyli str. CTCB07
MMSWHPSGSLAVLTADEIPSLQRRRLLRRITVLSTFGGLLFGYDTGVISGALPFMRFEGVALSPFEEGVVVSSLLFGAAAGSLVGGRIADRSGRRRLLIGLAIVFFAAALGCTFAPSIAVMVAARVLLGIAVGAASVAVPLFLTEVSPAQRRGQIVTHNELMIVSGQLAAFTVNAAIAAAVPEHAEVWRWMLVVASLPAVVLFFGMLVVPESPRWLILQGRFAEGRAEHQAEREAAEIRDAIEHAPSASFADLVRALGTPWIRRVFLVGVGIAMVQQLTGVNSIMYYGVQILQRAGFDAQAALVGQIANGVISVLATFGGIWLLGRVGRRPLLITGLIGTTSALLLVGTSSAVLAGTPALPFATLTLTVLFLTFQQGAVSPVTWLMLAEIFPARIRGVAFGAAALVLWLTNFLVGFLFPQLVSGMGISPTFFVFAAVGCGALLFVVRALPETRGRSLETLERELEAHYTR

SEQ ID NO: 11651 - protein, 402 aa, Legionella pneumophila str. Paris
MKHSLATIEEAVATLKAGKMIILMDDEDRENEGDLVIAAEHATPEAINFMSRLGCGLICLPMAEELIDKIQLPMMARHNKSPYGTAFTVSIEAANGVSTGISARDRARTIQVAIDPKSGPSDIISPGHVFPLRARKRGVLERPGQTEGSVDLVRLAGLTPAAVICEIINEDGTMSRRDELALFSKKHQIPLVTIKDLINYRIRHENLINPVATTQIPLEENGVFTMTVFENQIDSGEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVDALRLLTNNPLKIASLERYGMKITQRIPLEIKPSRENHCYLKTKKIKLGHLLAID

SEQ ID NO: 11652 - protein, 464 aa, Bacillus cereus ATCC 14579
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 11653 - protein, 332 aa, Shigella flexneri 2a str. 301
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 11654 - protein, 323 aa, Caulobacter crescentus CB15
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 11655 - protein, 151 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(32): Xaa can be any naturally occurring amino acid
  misc_feature (38)..(38): Xaa can be any naturally occurring amino acid
  misc_feature (55)..(55): Xaa can be any naturally occurring amino acid
  misc_feature (58)..(58): Xaa can be any naturally occurring amino acid
  misc_feature (68)..(68): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(109): Xaa can be any naturally occurring amino acid
  misc_feature (115)..(115): Xaa can be any naturally occurring amino acid
  misc_feature (125)..(126): Xaa can be any naturally occurring amino acid
  misc_feature (130)..(130): Xaa can be any naturally occurring amino acid
  misc_feature (135)..(135): Xaa can be any naturally occurring amino acid
  misc_feature (142)..(143): Xaa can be any naturally occurring amino acid
  misc_feature (146)..(147): Xaa can be any naturally occurring amino acid
  unsure (1)..(151): unsure at all Xaa locations
MASSMXSSAAVXTSPXQAXMXAPFXGLXSSAXFPVTRXANNDITSIASNGGRVSXMKXWPPVGKKKFXTLSYLPDLXEVXLGKEXYXLLRNXXIPCXEFELXHXFXYXXHGTTPXYYDGRYWTMXXLPLXFGCTXSAQVLKXXQEXXTEYP

SEQ ID NO: 11656 - protein, 339 aa, Zea mays
  misc_feature (110)..(110): Xaa can be any naturally occurring amino acid
  misc_feature (128)..(128): Xaa can be any naturally occurring amino acid
  unsure (1)..(339): unsure at all Xaa locations
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKXAAAHLKGGAKKVVISAPXSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 11657 - protein, 404 aa, Rickettsia typhi str. Wilmington
MKYKYRNREINNKNTMTNKTITLNLGPQHPATHGVLRLILEMDGEVVNNADPHIGLLHRGTEKLIEHKTYLQAIPYFDRLDYVSPMCQEHAFALAVESLLECSVPRRAQFIRVLFSELTRILNHTLNIGSQALDIGATTPLLWLFEEREKIMEFYERVSGSRMHANYFRPGGVAEDLPEKLLEDINKFIEQFPSKLNDIENLLNENRLWKQRLVDIGVVSQKDAMDWGFSGPMLRGSGIAWDLRKSNPYDVYDEMDFEVPVGKNGDCYDRYLVRILEMYESIKIIKQCIAKMPKGQVKTDNPKLTPPTREKMKESMEAMIHHFKLYTEGYDVPIGETYKAVEAPKGEFGVYLYSQGGNKPYRCRIKAPGFAHLQGLNFMSKGHLISDVITIIATLDIVFGEIDR

SEQ ID NO: 11658 - protein, 335 aa, Hypocrea koningii
VPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 11659 - protein, 337 aa, Hypocrea koningii
APIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 11660 - protein, 482 aa, Vibrio angustum S14
MTFSFGGLFKQQAFINGQWSDAFSGKTVNITNPATNEVIGHVPLMGVEETNIAIDAADKAYRLWSKTTAKHRSLILRQWYELIVSHSDELAHILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFDDADLSRAIDGVMVSKFRNAGQTCVCTNRIYVHSDVYQQFVEKLAEKVSALTVGNGVDNGVTIGPLINRAAVEKVEKHINDAMMKGANLVIGTREASTNCFVQPTVLSNVTDNMLVASEETFGPLAAVFKFTDEQDVITRANNTDSGLAAYVYTQSLSRAFRVSEALEYGMVGVNEGLISTELAPFGGVKESGIGREGAHQGLEEYTEMKYTLMGGL

SEQ ID NO: 11661 - protein, 196 aa, Triticum aestivum
MAAKAVQWPVMVVVVMMGAAVASVGADMDADRSECAEQLVGLAPCLQYVQGQARSPAPDCCGGLSQVLDKSPKCLCVLVKDKDDPNLGIKINASLALALPSACGNTKANVSHCPQLLHLPPNSKDAAIFSPGGDKGTAAAPAKDNTASTANSRAQQAASAGTASSTATAGVALAALLAGYLALLLPADFLATAATF

SEQ ID NO: 11662 - protein, 380 aa, Zea mays
SESESEAASGRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADAAVRVSPRAEDLADEVERIRAAMGSDIDVSLDCAGFSKTMSTALEATRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 11663 - protein, 299 aa, Aspergillus oryzae
MASSTLCILGCGNLGGAILKSLIDGPKDKHGSAPFTRFIACVRSQESEQRLTTQFSHQSQSLTVTRDNIKAVQESDVVVLGVDPAVVEKVLSTPSLTEALSNKLLISVAAGWTRQKLETTLYGSPTTTSNAEGRAWVVRTLPNIAASVSQGLTAIEISEPEVPEHYQKITDAVFDNLGKTVHIPPTLMDATTAVAGSTPAFFAVIVDAMIDAAVAVGVPRDLARTMTVQAMTGTAALLQSGMHPAVLRDQGTSPEGCTIGGLMVMEEAGVRGHVGRALREAVTIARLMDGTRHLNDTRQ

SEQ ID NO: 11664 - protein, 151 aa, Prochlorococcus marinus str. NATL2A
MTLERTFVAIKPDGVQRGLIAEILGRFETKGFKLVGLKQLTPSKELAEKHYGVHKDRPFFSGLVDFITSGPVIAMVWEGEGVIASARKLIGATKPLEAEPGTIRGDLAVNIGRNVIHGSDGSDTAVFEINLWFQENELVDWNPSDQAWRVE

SEQ ID NO: 11665 - protein, 337 aa, Claviceps purpurea
MAVKVGINGFGRIGRIVFRNAVEHPEIEVVAVNDPFIDPEYAAYMLKYDSSHGVFKGEIKKDADGLIVNGKKVKFHTERDPSAIPWKASGAEYIVESTGVFTTTEKAKAHLTGGAKKVIISAPSADAPMYVMGVNEKTYDGKADVISNASCTTNCLAPLAKVIHDKYTIVEGLMTTVHSYTATQKTVDGPSGKDWRGGRGAAQNIIPSSTGAAKAVGKVIPDLNGKLTGMSMRVPTPNVSVVDLTVRIEKGATYDEIKATVKEAANGSLAGILGYTEDDIVSSDMNGNTNSSIFDAKAGISLNKNFVKLIAWYDNEWGYSRRVLDLLAYVAKADASK

SEQ ID NO: 11666 - protein, 567 aa, Synechococcus sp. WH 8102
MATSNQQLIVQRLIMMELQYGRLLNSSSQHQQDDPIRFDDIAEALAAIRNGACVVVVDDEQRENEGDLICAAQFATPEAINFMATEARGLICLAMEGKRLDELDLPLMVDRNTDANETAFTVSIDAGAEHGVSTGISAEDRARTIQVALNPKTRPAELRRPGHIFPLRAKPGGVLKRAGHTEAAVDLAQLAGLTPSGVICEIQNSDGSMARLPELRAYADTWGLKLISIAELIRYRLDNERFVRRQAHAELPSQFGSFQAIGYCNELDGSEHVALVKGDPASLREPVLVRMHSECLTGDAFGSLRCDCRPQLEAALRQIEREGEGVVVYLRQEGRGIGLINKLRAYSLQDGGLDTVEANERLGFPADLRNYGVGAQILSDLGIHRLRLLTNNPRKIAGLGGYGLQVEERVPLVMDAGDHNADYLAAKRDKLGHLMDSDGPCTVLAVAVNDRTESLPSIRSRVEDLAETHGQTLEALHEPRLLALWDRPQFVWKLTPEVDAPLALLQSIAQLESTQRIGLLRVSTERSALHPSQTLEREERSLVELIQTNGDERLTQRPSLLHWSARD

SEQ ID NO: 11667 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 11668 - protein, 401 aa, Glycine max
  misc_feature (222)..(222): Xaa can be any naturally occurring amino acid
  misc_feature (268)..(268): Xaa can be any naturally occurring amino acid
  misc_feature (293)..(293): Xaa can be any naturally occurring amino acid
  misc_feature (313)..(313): Xaa can be any naturally occurring amino acid
  misc_feature (326)..(326): Xaa can be any naturally occurring amino acid
  unsure (1)..(401): unsure at all Xaa locations
MVKKSKKSKSKRVSLKKKYKVIRKVREHNRKKTKEAKKLRLSGKKKVEKDPGIPNDWPFKEQELKALEARRAKAIEELEQKKAERKERARKRKLGLLEDEDNSKLSEMNTLKGSTVGKTKDSSDRAFYKDLVKVIEASDVLLEVLDARDPLGTRCVDIEKMVMKSGPDKRLVLLLNKIDLVPKEALEKWLKYLREELPTVAFKCSTQQQRSNLSDCLGAATXPPPKLLKNYSRSHEIKKSITVGLIGLPKVGKSSLINSLKRSHVVNXGSTPGLTRSMQEVHLDKNVKLLDCXGVVMPKSQENDASVVLKNCXRIEKLDNPINPVXEILKLCPPEQLVTHYKIGSFKLGDVDDFLLKVGTVRGKLKKGGIVDINAAARIVLHDWNEVNLHILGALYLITSM

SEQ ID NO: 11669 - protein, 811 aa, Desulfitobacterium hafniense DCB-2
MFSDKNGFKDAYLEKFAEIKGKSIEEGTLWDKYHTLVVLLREEISLSRAFINYADPKNRPAKQVYYFSMEFLIGKLLHNYLINIGIQDIVAEGLEELNIDLQELLAQECDAGLGNGGLGRLAACFLDSMAFLGIAGHGNGIRYKYGLFEQKIVNGYQTEVADHWLKNGYPWEVRKPDKSVVIKYKGKVRVENIDDRLVFHHENYEPVLAVPYDIPIVSYENPFLVNNLRLWSAEPLSSELDLALFNQGNFTQALSNKSEVEAISYILYPEDSNLAGRELRLKQEYFFVAAGLATIVRNYKKNHGSLRDFSQGVSIHINDTHPALCIPELMRILIDEEGMDWEESWNITVDAISYTNHTIMPEALEKWPLDLFRNLLPRITMIIEEIDRRFKEKLLRRFFNSEELFRSTPIIKEGQIYMANLAMIGSHSVNGVAKLHTEILKKHVFKDFHRIFGYKFTNLTNGVNHRRFLLTANPLLSELITEGIGPGWKTNAGELAELHRFKEDSAFLDRLAQVKYQNKLRLAEIIAMGQGIQIDPHSLYDVHVKRIHAYKRQLLNVLKVMDLYNRLLADPGSVQGTYTFIFGGKAAPGYHYAKSIIKLIHVIADKINQEPRIKEQLKVVFMENFNVSSAERIYPAADLSEQISTAGKEASGTGNMKFMMNGALTIGTLDGANVEIREAVGEDHIFIFGLTAEEILAHNLNRTYRSWDEYHANPCLENILEQLISKQFMENDWEFRTVYDSLLLYNDEFFVLKDFAAYMKTFGEAADRYAAQEQWLRSSLHNIAESGVFSTDRTIREYAHQVWRVRCRRMD

SEQ ID NO: 11670 - protein, 528 aa, Bifidobacterium adolescentis
MAQSQAEQQAQAQIAGEPTRTKERQPQPATGTAADPTAQAQQNDEQGGLERKMETRHLTMISLGGVIGTGLFLSSGYTIHQAGPLGAIIAYAIGSVLVYFIMLSLGELSVAMPYAGSFHLYAKRFIGPGTAFTIAVLYWLNWAVALASEFTAAGLLMQRWFPHSPAWIWSAAFIVVVFLLNILSVRLYGESEFWFASIKVFAIIAFIIIGLLAMFGAIPIAGYSHAPMFENFYSDGWLPNGVLPIFSTLLTVVFAFSGTEVVGVAAGETKDPSKAIPKAVHTTVLRLAIFFIGSIAVMAALIPWRKSGVDTSPFVLVFQSIGMPFAGDIMNFVVLTAVLSAANSGLYVCSRMVWSLAQEGMIPRKLAKTNFHGVPVFAVMFSMAGSLLALLSSVVAASTVYLALVAVSGLATLVVWASVSVCHLRFRHQWLAQGHTVGELKYRAPGYPFVPIVAIVMCVGALVLVICDPSQRSTLLYMIPFVALCYTGYYASVAWRTKRHGGQDDAQNALQSVPQDVSQPHREDGQED

SEQ ID NO: 11671 - protein, 502 aa, Thermus thermophilus HB27
MEALWVTAAFALGLLASRLALPPLVGYLVAGFLLAGTGIRGTAFLHQIAEIGVLLLLFSVGLKLRLKDLLDPRVLLSGGLHLGLFATLAFLYTKNLPLAIALGFSSTVLVAKVLEDKKELTSYHGRIALGILVFQDLVAVGLLTLYGGEGVSPWAALVLLFPLLRQGVAWLLEKSGHEELLVLFGLGMALGSGELFQHVGLSPELGALLTGALLSGHAKSAELTKGLWSLKEAFLVAFFLDIGLREGLQGLDLGLAAGLTLLSLLKAPLFFLVLLLVGYRARTAFVAGMYLGNHSEFALIVGVALERAGLFTDLSALALAVALSMALSAPLARYSHTLYKRLEPFLLRLERPGSHPDAEPERLEGTVLVVGMGRTGDAVYRVLEAQGESPVGLDADPAKVERHREKGRPGPLRRRRGPGALGKAGPQGAQGRGPRPAGPGGQDPRRPLAQGAGLPGACGRHQLLPRGGPRAGPGRGPPHLPSVPRSGGKAWGAGPGEPRYNG

SEQ ID NO: 11672 - protein, 520 aa, Kluyveromyces lactis NRRL Y-1140
MSNPALQVYGGDEINAIVIDPGSFVTNIGYSGTDCPQSIMPSSYGNVETDGDTKRIFNEQPLLFPRAGMEIKPIVENSTIVDWDRAQEQWEYALNTDLKFESNKGTPVLLTEPIWNSEASRKKSLEILLESMEFEACYLAANSSAVSFAMGRPTCLVVDIGHDVSTVSPVIDGMTLSKSSTRNYVAGKYLNHLIAKNLKPREIVPIFQVLKKKPDFVKRTLSFDVNESVINFANERQFFQEFKETLLHIAPKSLSSFKDELATQTKRSLEAPWGEELIFDADTRYSFAEQLFRPVKEDFPEGWPASTDGIVKTWHNDYVPLKRTKPGTSTNTKEKENTAESTPVPASTEQEAVDSPSQEPNENGKRPVENKEDSSNNEQNSNEIKNEDANSNESSAKATVPSNGIQAKGEDEVAGIVDLINKSMMEADVDLRATLAHNVVLTGGTSKIPGLSDRIMHELNKSLPALKFRMLSSGHLRERQYQGWLGGSILASLGTFHQLWVGREEYEEVGPERLLKDRFR

SEQ ID NO: 11673 - protein, 199 aa, Solanum tuberosum
IQQNAQGLARYAIICQENGLVPIVEPEILTDGNHDIKKCAAATETVLAAVYKARNDQHVLLEGTLLKPNMVTPGSDSPKVAAEVIAEYTVTALRRTVPPAVPGIVFLSGGQSEEEATVNLNAMNKLEVLKPWTLSFSFGRALQQSTLKTWCGKKENVGTAQEAFLTRCKANSDATLGKYTGGSGSGAASESLFVKGYKY

SEQ ID NO: 11674 - protein, 263 aa, Treponema pallidum subsp. pallidum str. Nichols
MNVGFLGFGAMGRALAEGLVHAGALQAAQVYACALNQEKLRAQCTSLGIGACASVQELVQKSEWIFLAVKPSQISTVLRDRQSFQGKVLISLAAGMSCAAYEALFAADPHQGIRHLSLLPNLPCQVARGVIIAEARHTLHHDEHAALLAVLRTVAQVEVVDTAYFAIAGVIAGCAPAFAAQFIEALADAGVRYGLARDQAYRLAAHMLEGTAALIQHSGVHPAQLKDRVCSPAGSTIRGVLALEEQGLRRAVIHAVRAALSSS

SEQ ID NO: 11675 - protein, 513 aa, Apium graveolens var. dulce
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 11676 - protein, 91 aa, Prochlorococcus marinus str. NATL2A
MSISVTSPCPESTFDELGIKNWPIWTCDASSFDWTYDDKETCLLLEGEVTVTPNGGESVKFGAGDLVVFPAGIDCRWDVHKAVRKHYRFGD

SEQ ID NO: 11677 - protein, 314 aa, Magnetospirillum magnetotacticum MS-1
MRALVWHGTQDIRCDTVPDPQIEDDRDAIIRVTACAICGSDLHLYDHFIPAMKKGDIMGHEFMGEVVETGRGVNGALKKGERVVIPFTIICGECDQCKRGFFSVCERSNRNRSMAAKVFGHGTAGLFGYSHLTGGYPGGQAEYVRVPFADRTHIKVPDSLTDEQVLFLGDIFPTGWQAAVQADIQPHDTVAVWGAGPVGQMAVRSAILLGARQVICIDSVPERLDMARAGGAITIDNSVESPVERLNELTGGKGPEKCIDAVGMEAHSPRALEQVYDRVKQAMMLESDRASVLREMIYVCAPPASSRFPASMAA

SEQ ID NO: 11678 - protein, 587 aa, Erythrobacter sp. NAP1
MAGELTMSPVMQDALVILGSAGIVIPVFARFRITPIIGFILIGILVGPYGLGSLVDQFEWLQYVSISDPDRLTPFADFGIILLLFAIGLELSFNRLWQLRRLVFGLGSLELLIIGSISAGFFGYASGMATEAALALGFALAFSSTAIVLPISGTKSPVGRAALSMLLFEDIMIVPIIFILGALAPTASGDSVSDLTNTLIQGGIVILVLLVAGRFALPSLFSQAARTKSPELFLAASMLVVIGASLATAATGLSPIVGALIAGLLIAETEYHGEVESIMEPFKGLALGVFLITIGMSIDLRVIWADLGTIMGAVVGVLVFKAVVTGALLRMMGARRSTAAETGVLMASPSETTLIVLAAATSALVVDTETAQFWQIVTAIGLTITPLLAKLGRAIARRVEAVPDLPDDDDGEPRTIIVGAGRVGRLIADMMTAHDQPHVLIDSDPDVVDAAKRKGYRVMFGDAARGDVLARVGIAEAPALVFTMDEPVLAQRLVARLRADHSELLIVVRARDTDHAAQLYRAGASHAVPENLESSLQLSEAVLVDIGVAMGPVIASIHEKRDEFREQLEVDGGLKSPPKLRTSTVEN

SEQ ID NO: 11679 - protein, 108 aa, Triticum aestivum
IYRYSDAKDRLEFMERTLKWRHLAPTAPNSLGCYPYTDKDPFLVETCPHVYFVGNQDRYETRLLKGTEKQQVRLISIPRFCESGIAVMLNLRNLECSTLSFSTSFEDA

SEQ ID NO: 11680 - protein, 397 aa, Oryza sativa
MGAEAEHRMSPSPAPAPAPPTPVGRTDGDAPPMVLGLQLSALIDHVARVDWSLLNRIPGDRGGSQQANEFKKEDFKGSKWLVVRYARQNMEQILEAIRIAKQEGLSVSLDLASFEMVRDYRTQLIDLLETGNIDLCFANEDEARELLGGELTFDPEEALAFLAKYCKWAVVTLASKGCIAKHGKQVVQVAATGESNAVDATGAGDLFASGFLYGLVKGLALEECCKVGACSGGSVVRALGGEVRPENWQWMLRSGGINSMSSSAALALALRRATSSAHKQKQKQALALTDAAASRIRQLLSLRHRPYLRLGVKARGCNGLSYTLNYADEKGKFDEVVEDKGVKVLIDPKALMHVIGTKMDYVDDPLRSEFVFINPNSKGECGCGESFMTTSSKGSTS

SEQ ID NO: 11681 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 11682 - protein, 362 aa, Yarrowia lipolytica CLIB122
MTNLPLLTRKEVESHNTKSSCYVTVDNLKVYDVSSFLEEHPGGGDLIVDFAGKDVTEIMGDLVSHEHSEAAYEMLDELYLVGILATPEQEAKLLTRENRHDFKLEKNAEDELTVTTDFTRDYKTNQFLDLNKPLLMQVLRAKWTKEFYLEQVHKPRHYGNGSAPIFGNILEPLSKTPWFVVPCLWIPVDLYCIYLSAQGLPFYCIIPMFAFGLFVWTFIEYGLHRFAFHLDDHLPRYQVAYALHFLLHGVHHYLPMDKMRLVLPPTLGVILITPFYFLAFALFPYYWAYAGFAGAFLGYIMYDCTHYFLHHMNLPPYFKALKKYHLDHHYKNYELGFGVTSSFWDKVFNTELVETSVKSKGL

SEQ ID NO: 11683 - protein, 572 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTFDPVRKQYYWHRFFSHQPDLNYENPAVQEEIVSALRFWLDLGIDGFRLDAVPYLYQQEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDAV

SEQ ID NO: 11684 - protein, 138 aa, Triticum aestivum
  misc_feature (21)..(21): Xaa can be any naturally occurring amino acid
  misc_feature (80)..(80): Xaa can be any naturally occurring amino acid
  misc_feature (99)..(99): Xaa can be any naturally occurring amino acid
  misc_feature (102)..(102): Xaa can be any naturally occurring amino acid
  misc_feature (110)..(110): Xaa can be any naturally occurring amino acid
  unsure (1)..(138): unsure at all Xaa locations
MAPAVMASSATTAAPFQGLKXTAGLPVSRRSCSAGLSSVSNGGRIRCMQVWPIEGIKKFETLSYLPPLSTEALLKQVDYXIRSKWVPCLEFSKVGFRLXREXNSSPRVLXTVRYWDKCGNCPIVRGCTDAKGCGWREV

SEQ ID NO: 11685 - protein, 341 aa, Triticum aestivum
LYRTSLYKKAGWYRSGIPGISSTHASALPSSPHRLGNHGSNLREPADFLTAEDLMSTWNKALRPSPPLNKPLLPFEEWHIGFSEIAVGTRVGIGFFGEVFRGIWNGTDVAIKVFLEQDLTMENMEDFCNEISILSRLRHPNVILFLGACMKPPHLSLVTEYMEMGSLYYLIHTSGQKSKISWRRRLKMLRDICRGLMCMHRLKIVHRDLKSANCLVNKHWTVKLCDFGLSRLLSNSAMSDNSSAGTPEWMAPELIRNEPFTEKCDIFSLGVIMWELCTLSRPWAGKPPVQVVYSVANEGARLEIPDGPLGSLIADCWTEPEKRPSCQEILTRLLDCEYTLC

SEQ ID NO: 11686 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 11687 - protein, 259 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYPFLIKIQNRN

SEQ ID NO: 11688 - protein, 90 aa, Triticum aestivum
MAAPAKASWLVAMSVGAVEALKDQAGLCRWNYALSSIHRAAKARANVRGGVSQGPKQLAASAAAVAERRRAEKAEEGLRTMMYLSCWGPN

SEQ ID NO: 11689 - protein, 432 aa, Bradyrhizobium sp. BTAi1
MSSSLHAVACERGIKYFLISYTDLFGVQRAKLVPAAAIDGMVKTGAGFAGFATWLDMTPADPDVFAMPDPASLIQLPWKPEVGWLAADPWMNGKPVAHAPRNLLKRMVADAAAQGYELKSGVECEFFLITADGSAPSDVADKQSKPCYDQQALMRRYEVIAEICDAMLALGWKPYQNDHEDANGQFEMNWEFDTALTTADRHAFFKYMVRSIAEKHGLRATFMPKPFVDLTGNGCHAHVSVWKDGRNLFEDEAGELGVSELGYQFLGGIMHSADALAALFNPTVNSYKRINAARTTSGATWAPNSVTYSGNNRTHLIRIPEAGRFEVRLADGAANPYLLQAGLLAAGLDGIANDRDPGPRLDINMYTDGHAVKTGKKLPLNLLDAIRALQASPVMAEKLGDFIPCYVKLKTEEWNAYARHLTEWERETTLDC

SEQ ID NO: 11690 - protein, 602 aa, Aspergillus oryzae
MATQHKTQSSPVNAAWWKEASVYQIYPASFKDSNGDGIGDIPGIISELDYLKALGIDLNWLSPILQSPQVDMGYDVSDYYRIHPPYGTVEDVDALIQGLHQRGMRYVMDLVVNHTSDQHEWFKQSRSSSDNEYRDWYIWKKPKYDANGVRQPPNNWGAYFGGSAWQYDETTDEYYLHLFAPEQPDLNWENPKVRSAVHQIMRYWLDKGVSGFRMDVINMISKDQSFPDAPITDPKAQWQHGAMHYCCGPRLHEYLQELGRVLKEYDAFSVGEMPNVYDPVEIGKAVGFDRGELAMAFQFEIMDIDHGPAGKFSPHKYRMSDLKHIVSKWQDFMYENEGWNALYLENHDQGRTISRFTSAGPEYRATAGKMLATFLGLQGGTPFVYQGQEIGLVNVPETWGIEQFRDIETLNYWNEITAAYPNDTELHKVTSQQFRVKSRDNGRTPMQWTSGKFAGFTAAHNGPWIDVHDDYEDWNAASQVGNPNSVFQHWAKVLALRKAHKRLFVYGSYKLIDEANNDLFTYLRVYGSQSALVLANFTGKEVSWVVPAETISILKNGAVLLESYQRHRPVRPDGTIAVMPFESFVMFLDSPNARVGAGGGKL

SEQ ID NO: 11691 - protein, 270 aa, Zea mays
MEKAGQKRRPLTVMASSSSQVAAARGMGMTNPLAEWTDRVRSLEAGVRAWLAKQPTHVEAAVVTAVGAVQGAALGGLMGTLAPDGGAALPVPPPPPGTDPKVLASFKQAQALAGGPLVQARNFAVMTGANAGISCVMRRIRGVEDVQGSMAAAFGSGALFSIVSGMGTPNPVANAITTGVGFAVFQGGFFMISQKFSQPQSGDTYYSRGRSMLQKLGLQNYEKNFKKGLLTDQTLPLLTDSALRDVKIPPGPRLLILDHIKRDPELTKAN

SEQ ID NO: 11692 - protein, 170 aa, Brassica napus
  misc_feature (134)..(134): Xaa can be any naturally occurring amino acid
  misc_feature (147)..(147): Xaa can be any naturally occurring amino acid
  misc_feature (150)..(152): Xaa can be any naturally occurring amino acid
  misc_feature (154)..(157): Xaa can be any naturally occurring amino acid
  misc_feature (159)..(159): Xaa can be any naturally occurring amino acid
  misc_feature (161)..(168): Xaa can be any naturally occurring amino acid
  unsure (1)..(170): unsure at all Xaa locations
LSLSLPNLMETQTSGCDNIVGDDTWRAEAEIGGNERALQALRELIIFPFRYPLEARTLGLKWSRGLLLYGPPGTGKTSLVRAVVQECDAHLTVLSPHSVHRAHAGESEKVLREAFAEASSHAGSDKPSVIFIDXEIDVLCPRRSSRXKQXXXIXXXXFXLXXXXXXXXSP

SEQ ID NO: 11693 - protein, 382 aa, Kineococcus radiotolerans SRS30216
MRAMVYRGPYRVRVEEKDVPRIEHPNDAIVRVTLAAICGSDLHLYHGLMPDTRVGTTFGHEFIGVVESVGSSVQSLVPGDRVMVPFNISCGSCFYCARGMLSNCHNVNPNATAVGGIYGYSHTAGGYDGGQAEYVRVPFADVGPTLIPEWMHDEDAVLLTDATATGYFGAQLGEIREGDVVVVFGAGPVGLVAARSAWLMGAGRVIVVDHLDYRLEKARTFAQTETVNFAEHDDVVVHLKRITDHLGADVAIDSVGAEADGNFRQHVTGAKLKLQGGSAVALNWAIDSVRKGATISVMGAYGPIPNSVKFGDAVNKGLTLRMNQCPVKRQWPRLFEHVRNGHLTPRDLVTHRIPLEHIAEGYHIFSSKLDDCLKPLIVPTPA

SEQ ID NO: 11694 - protein, 400 aa, Solibacter usitatus Ellin6076
MRILIADEFEQSGREQLNALGCEVRFAPKLKDEALVAEVDSFRPDVLVVRSTKVPEAVLAAGALKLVVRAGAGHNTIDVGAASRRGIYVSNCPGKNSVAVAELAFGLILALDRQIADNVIALREGRWNKSGFSKARGLFGRTLGLIGVGQIGREMIPRARAFGLPVVAWSRSLTPESAKALGVEYKPSPAEVAAAADIVSVHVALNPQTKGMLNAEWIAALRPGAYFINTSRAEVVDQEALSRAVTEKGIRAGLDVFAKEPAGGAGDFADEIVKLNGVYGTHHIGASTEQAQEAIAAETVRIIRTFLQTGKVPNVVNLARTTPATCALVVRHLDRPGVLAAVLDSVRAAGINVQEMENIIFEGAEAAVARIHLETVPDEDVLGRIRGSNPHILEANVIIL

SEQ ID NO: 11695 - protein, 135 aa, Arabidopsis thaliana
  misc_feature (25)..(25): Xaa can be any naturally occurring amino acid
  misc_feature (88)..(88): Xaa can be any naturally occurring amino acid
  misc_feature (108)..(108): Xaa can be any naturally occurring amino acid
  unsure (1)..(135): unsure at all Xaa locations
VPQAGRIYSFPEGNFPMWGDKLKKXLFFFKAPGPIGNPFSPRDIGSLVGNFPRAFLYGGIYGDPRDPKSKNGKLRLLYKGAPISFFFXQTGGKGFYGPFKGLKIPPPXKHQRVPLSLGSPKEVKNLGKDLALVMD

SEQ ID NO: 11696 - protein, 143 aa, Arabidopsis thaliana
  misc_feature (97)..(97): Xaa can be any naturally occurring amino acid
  misc_feature (104)..(104): Xaa can be any naturally occurring amino acid
  unsure (1)..(143): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCXEFELEHXICVPVSTENTSIRLQILEFHCGTFKFLREGKGGPLPLIR

SEQ ID NO: 11697 - protein, 241 aa, Thermoplasma volcanium GSS1
MPDYEKQKRNAAVEAASYVKTGMVIGIGTGTTARYLIEELGRRVSEENLKIKGVCTSKKSEELARAAGIEISENPEQIIDLTIDGADQVNLHGTLIKGGGGALLREKIVAYNSKEMYVIVDSRKIDDENFGSFPLPVEVVPFLHRMTLENLRKICPSTDLRKNSDGTLFITDNGNYIADMKFGRIRETNELEKKIKSIPGVVDVGLFNNIADKIFEGNDDGCNIYVVSEKGRIEKEKGQFK

SEQ ID NO: 11698 - protein, 393 aa, Ehrlichia chaffeensis str. Arkansas
MSDRVKITPMTLNFGPQHPAAHGVMRLVLEMGGEVIERIDPHIGLLHRGTEKLIEYKTYLQALPYFDRLDYVSPMCQEHAYSLCVEKLLKCEIPIRAKYLRVIFCELTRILNHLLNISSQALDIGAMTPLLWMFEEREKILGFYERASGARFHSAYIRPGGVAADVPDDLIDDIFKFIKTFPKFIDDVDELLTENRIWKQRNVDIGIVSKEQALDWGFSGPMLRACGIPWDLRKSQPYEIYEDLEFEIPIGKKGDCYDRYLVRMAEIRQSIKLLEQCLNRLPNGPIKTDDRKIAPPKRSEMKESMEALIHHFKLYSEGYSVPIGETYMAVEAPKGEFGVYIVSDGTNKPYRCRIRAPGFAHLQAIDMMAKGHMLADLTAIIGSLDIVFGEIDR

SEQ ID NO: 11699 - protein, 176 aa, Arabidopsis thaliana
  misc_feature (126)..(128): Xaa can be any naturally occurring amino acid
  misc_feature (130)..(130): Xaa can be any naturally occurring amino acid
  misc_feature (149)..(150): Xaa can be any naturally occurring amino acid
  misc_feature (158)..(161): Xaa can be any naturally occurring amino acid
  misc_feature (164)..(164): Xaa can be any naturally occurring amino acid
  misc_feature (167)..(169): Xaa can be any naturally occurring amino acid
  unsure (1)..(176): unsure at all Xaa locations
FITIVITSMLLGFGNSDLAQDREECTNQLIELSTCIPYVGGDAKAPTKDCCAGFGQVIRKSEKCVCILVRDKDDPQLGIKINATLAAHLPSACHITAPNITDCISILHLPRNSTLAKEFEDLREGXXXNXNFTSPSQIHKDGPGGGKAXXVKGIGWKXXXXLGXGFXXXLGLFTPS

SEQ ID NO: 11700 - protein, 147 aa, Oryza sativa (japonica cultivar-group)
MMYMRATHRDEEGKKVTEKVAVPETRHPDTARHFERKLDQQGLHRMERHPANGSRGIGAPPPKSGRGGKFTWEGPDSIVDSQLDPLPAAIDRNDPNYEEEEGDHEREADVVGEVEVAKVAGDARDGVARVDVVAPPQLHEKLQLQPQ

SEQ ID NO: 11701 - protein, 313 aa, Yarrowia lipolytica CLIB122
MPIITETFKLNDGRSIPALGLGTASDANVEEVTYAAIKDGYKHIDTAYIYKSEEAIGKGIKRAIADGLIKREELFVTTKVWPTFHGRVKESLDYSLKDLGLDYVDLLLVHWPAALHPDPNDRHAYVPKNADGSAHYTDNNDWISIYEELEKEQAAGRTKSIGVSNVSEKYLKELLKRVKTVPAVNQFENHPYLPQKKEIEFNKKHGILVTAYSPLGSSNGKIKLHENPVVAEIAKKHNATTGSVLINWHISQGRSVIPKTRSVERVKANAQKVDLDSDDLAKLDKIWEQTGTQRAIGLDWLDKAGDNLGFEDK

SEQ ID NO: 11702 - protein, 474 aa, Thermus thermophilus HB8
MSFPLIFERSRKGRRGLKLVKAVPKAEDLIPKEHLREVPPRLPEVDELTLVRHYTGLSRRQVGVDTTFYPLGSCTMKYNPKLHEEAARLFADLHPYQDPRTAQGALRLMWELGEYLKALTGMDAITLEPAAGAHGELTGILIIRAYHEDRGEGRTRRVVLVPDSAHGSNPATASMAGYQVREIPSGPEGEVDLEALKRELGPHVAALMLTNPNTLGLFERRILEISRLCKEAGVQLYYDGANLNAIMGWARPGDMGFDVVHLNLHKTFTVPHGGGGPGSGPVGVKAHLAPYLPVPLVERGEEGFYLDFDRPKSIGRVRSFYGNFLALVRAWAYIRTLGLEGLKKAAALAVLNARYLKELLKEKGYRVPYDGPSMHEFVAQPPEGFRALDLAKGLLELGFHPPTVYFPLIVKEALMVEPTETEAKETLEAFAEAMGALLKKPKEWLENAPYSTPVRRLDELRANKHPKLTYFDEG

SEQ ID NO: 11703 - protein, 384 aa, Zea mays
MKVQWQPSSSYESTTSSAARRASRPTIRSLLRASLQTRNYITTVPCNFPDLLPPCFLRLHPLTSARSPRSRVPSAGKMSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 11704 - protein, 457 aa, Frankia sp. EAN1pec
MSTHTETPVDGSAETITGAQPYEAGFTESSAGRVYTVTGGDWEQVLGVGEDDGERITVNMGPQHPSTHGVLRLVLEIEGETVTETRLVIGYLHTGIEKSCEYRTWTQAVTFLTRADYLSPLYNEAAYCLSVEKLLGITGEVPERATVIRVLVMELQRIASHLVWLATGGMELGATTGMIFGFREREKILDLLETITGLRMNHAYIRPGGLAQDIPDEVIPEIRAFLDYMPKRIREYHALLTGQPIWKARMVDVNFLDAAACLALGTTGPVLRAAGLPWDLRKTMPYCGYETYEFDVPTALEGDSYARYLVRIEEMGESLKIIEQCLDRLRPGPVMVADKKIAWPSQLAIGSDGMGNSLEYIRKIMGTSMEALIHHFKLVTEGFRVPAGQVYTQIESPRGELGYHVVSDGGTRPFRVHVRDPSFVNLQAVPALTEGGQVADVIVGVASVDPVLGGVDR

SEQ ID NO: 11705 - protein, 253 aa, Dehalococcoides sp. CBDB1
MRQIIIAGNWKMNTTLSEACTLVQSMKCELERIEGIEKIICPPFISLYPIKTILENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 11706 - protein, 402 aa, uncultured archaeon
MMRTVIRDPIHGYIELDALAIAIIDTAAIQRLRRIKQLGFAYLVYPGANHTRFEHSLGTYHLTNVLLDTLEVSKAEEKELLVASLIHDIGHGPYSHVTEPLLKKITGKSHEDIEDIIFKQDAEHSKNIANVLEEHCVDKRKVMRYIKGVGGDDDDDHDFSRFLNGEIDVDKMDYLVRDAYYTGVAYGVVDNIRLIQGLEFFNGRLVITEKGVLPAEYLLFSRFLMSPTVYKHHTARIAQLMFLKALEYRIESRSDALALRQMDDSELDIALRNAKGYPREMMVRINERRLFKRAVYTSINDLCVAEELRTEKRRKELEEEISKRAGVDMNYVILDIQGEKGEDVKESAAKVVVGNDLRSLREVSSLVSMLSQAFQENYKVGVYTLEKYRVEVKKAAELVLWR

SEQ ID NO: 11707 - protein, 569 aa, Ustilago maydis 521
MQVKLSSSSLVSESVLGKLAATAHSHRPTTFIGYVALAIGTVVLLLGLLITYSLAKMLYRTTIYHYYISPLRHLPGPDPKPFLGNVEEFAKKPGAGAELDWSRKYNKDGVYRSTFLFGREAIHFHRPKALRQILVEDPYTYPKPALAWKLLGLIAGYGLLTVEGDTHRKMRKTMNPAFSLTNLIEQFPVYYAKIYPLVDVLNQKVEESPEESAVIDCDAWVNKALLDIICLTAFGYDADSVNNPSNELASAYHAVTSMQNGRNQARLNLLLNLPFGDTVLDWASDTSGWDWFLKRCKPGTAWQTFFQLLNGMHRIKNVSKEILYKQLNSGERAAQGGQFKAIIDIIEESYLTENDGKPKSLKQAERDMITQVLTFLGAGHETTASGVSWTLWNLATHQDIQDKLRKECKGLMDQDDRPPYSAIKGLAYLDAVINESMRITPPVPRTIRMASKASYIDGIYIPKNTLLPISNRAINMDPTVWGEDADEFKPERWFNLPDKYDRTFSMITFIAGAHACIGRTMSYLEMKAVICILVSNFKFEPVSKDQSPIMDTLITMKPQGGLELRVSKV

SEQ ID NO: 11708 - protein, 313 aa, Glycine max
MWPFSRKGSSGFSSSSTAEQVTEGIDGTGLTAIVTGASSGIGTETSRVLALRGVHVIMGVRNMLAAKDVKEKILKEIPSAKVDAMELDLGSMESVKKFASAFKSSGLPLNILINNAGIMACPFSLSKDKIELQFATNHIGHFLLTNLLLDTIEKTSRESKKEGRIVNVSSEAHRFAYSEGIRFNKINDESSYNNWRAYGQSKLANILHANELTRRLKEDGVDISANSLHPGTITTNLFRHNSAVNGLINVIGKLVLKNVQQGAATTCYVALHPQVKGISGKYFSDSNVANTTAQGTDADLAKKLWDFSMNLTK

SEQ ID NO: 11709 - protein, 94 aa, Zea mays
PVLGREQKARDAVLFPSKNAATGFSRKLPPQQVKVFKEPPGVFQVVPSQTFQVHGPGFGPPQGPTPPLGLLLRGFKIQKTVFSMAVWPRFYQCV

SEQ ID NO: 11710 - protein, 134 aa, Aspergillus niger
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKSGKGPGSQEL

SEQ ID NO: 11711 - protein, 492 aa, Rubrivivax gelatinosus PM1
MDMKNSPLATLADPTLLKTAALIDGAWVDRGEHFAVTDPATGQVLAQVANLGAADAEAALAAAARAWPAWRAKTAKERASVLMKWYQLLLQHADDLARIMTAEQGKPLAEAKGEVGYGASFIEWFAEEAKRVYGETVPTTDNNKRYLVLKQAMGVCAAITPWNFPIAMITRKVAPALAAGCPVVIKPAEQTPLSALAVAELAQRAGMPAGVLNVLTADAERSIQIGNVLCASDTVRHLSFTGSTEVGRILMKQCAPTIKKLSLELGGNAPFIVFDDADLDSAVEGAMISKYRNAGQTCVCANRLYVQAGVYDAFVEKLAAKVKAIKVGNGFEAGVTQGPLIDEAALAKVESHVADALAKGAKLLTGGQRIGERFYSPTVLAQATGEMLCAREETFGPVAPVFRFETEAEVVALANDTEFGLASYFYSRDVGRIFRVGEALEYGMVGINTGLISTAEVPFGGVKQSGLGREGSHHGIDDYVEIKYLCLGDIQK

SEQ ID NO: 11712 - protein, 260 aa, Triticum aestivum
MPQGDYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRTGKRKTKQWKRMVTKATFVGPGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 11713 - protein, 394 aa, Chromobacterium violaceum ATCC 12472
MITTIVGGLVFAFALGALALRLRLPPLVGYLCAGILVGPFTPGFQADTALAPELAELGVILLMFGVGQHFSIKDLMAVKAIAVPGALVQITVATLLGIGLSHFLGWPLGEGVVFGLALSVASTVVLLRALEEYGWLDSEDGKVAVGWLVVEDLVMVLTLVLLPAFAGALGGGQAAPSLAQLGWTLALTVAKVAAFVALMLIVGRRFIPWMLELIVHTGSRELFRLGVLATALGVAYGATQLFQISFALGAFFAGMVMAESPFSHRAAEESLPLREAFAVLFFVSVGMLLDPEVLLKDTAVLLTTVLIIVVGKSAAAYGIVRLFRRGHHTSLRIAASLSQIGEFSFILAGLGMSLGLLSARGQALILAGSIVSILFNPMMFALAERFSRRAQAAA

SEQ ID NO: 11714 - protein, 181 aa, Zea mays
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 11715 - protein, 139 aa, Nostoc punctiforme PCC 73102
MARYQETTQTDTLHLPSTITSRGVAATELRPWGAFTVLEEGRGYKIKRIEVKPGHRLSLQMHHHRSEHWIVVSGTARVTCGEKEVLLSNNESTYVPQCTSHRLENPGVIPLVLIEVQNGEYLGEDDIIRYQDDYARTKD

SEQ ID NO: 11716 - protein, 478 aa, Pyrococcus horikoshii OT3
MRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 11717 - protein, 476 aa, Enterobacter sakazakii
MDTFIHPTNLCFFTQPLSPGKLSKPPHWRRIPRLAAHPVYPWCSPDRLSHWNLSLFTDCQEVVMKALTYHGPHNVKVENVPDPIIEAQDDIILRVTATAICGSDLHLYRGKIPQVHHGDIFGHEFMGEVVETGSAVKDIRKGDRVVIPFVIACGDCFFCKLQQYSACENTNKGTGAALNKKQIPAPAALFGYSHLYGGIPGGQAEYVRVPKGNVGPFKVPPVLSDDKALFLSDILPTAWQAVKNGQVQKGSQVAIYGAGPVGLLSAACARLLGAEQIFMVDHNDYRLAFAKERYGVIPINFDENDDPAAFIIENTPGNRGVDAVIDAVGFEAKGSLTETVLSNLKIEGSSGKALRQCIAAVRRGGVVSVPGVYAGFIHGFLFGDAFDKGISFKMGQTHVHAFLPELLPLIEQGLLTPEEIVTHYLPLEDAARGYKIFEKREEECRKVILVPGAATPEAAREKVTALMNAPLQPLQP

SEQ ID NO: 11718 - protein, 448 aa, Streptococcus pyogenes MGAS8232
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPIEANIYTMTMEERNEAGIIDLPSTLHNALKALQKDDVVQKALGYHIYTNFLEAKRIEWSSYATFISQWEIDHYIHNY

SEQ ID NO: 11719 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 11720 - protein, 334 aa, Corynebacterium glutamicum
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHGDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 11721 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDATELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 11722 - protein, 95 aa, Prunus avium
LWPSNYSNPTMPSNCNGSRFKKELLSPRMQSKLKISWPNVVSSNDTKFWESEWNKHGTCSEQTLNQVQYFEISHEMWNSFNITDILKNASIVPHP

SEQ ID NO: 11723 - protein, 95 aa, Prunus avium
LWPSNYSNPTMPSNCIGSQFNDSKVYPKLRSKLKRSWPDVESGNDTRFWEGEWNKHGKCSERTLNQFQYFERSHEMWNFHNITEILKNASIVPHP

SEQ ID NO: 11724 - protein, 398 aa, Laminaria digitata
MSLKKKEFNKKLKHFTINFGPQHPAAHGVLRLILELNGEVVQRADPHIGLLHRGTEKLIEAKTYFQALPYFDRLDYVSMMCQEHTYALAVENLLQISVPKRAQYIRILFAEITRILNHLLAVGCHAMDVGAMTPFLWAFEEREKLMEFYERVSGARMHASYFRPGGVSQDISIGLINDIFSFAAQFGQRLDEMEEMLTDNRIWQERLVDIGVVSAQEAIDWGFSGVMLRGTGVRWDLRKNEPYDAYSELSFQGVVGKTGDCYDRYLVRVEEMRQSLSIIYQCLNKMPEGSIKIDDAKISPPSRADVKQSMEALIHHFKLYTEGVTVPLGETYTATEAPKGEFGVYLVSDGSNRPYRCKIKAPGFSHLQALNFMANSHMLADVVTIIGTQDIVFGEVDR

SEQ ID NO: 11725 - protein, 94 aa, Prunus avium
LWPSNYSNPRMPSKCTGSLFNFRKYPQLRSDLKISWPDVESGNDTRFWESEWNKHGRCSEASLNQMQYFERSHAMWISYNITEILKNASIVPHP

SEQ ID NO: 11726 - protein, 337 aa, Anabaena circinalis 90
MTIIYPPKNFPSKTKNHKVLLIGKMYDEIGEKLLAEYTNVEIIKEPKQHQIHEAIQDVSGVFVRYPTKLDAQAIGLAKNLKVISTSGFGTDAIDIAAATKRGIVVVNNPGLSTTAVTEHTLSMILALAKKLTFLNQCVKAGNYLIRNQVQPIQLEGKTLGIVGLGRIGSAVAKICSTALQMRVLAYDPYVPSGKADTVRATLVQDLDYLLTESDFVSLHPELTDETCEMFDLEAFKKMKPSAFLINTSRGKVVRQPDLVTAIREKLIAGAAIDVFEPEPPAINNPLYEFDNVIFSPHLAGVTPEAGMAAALSAANQILQVLQGEKPPYIINPKVWNS

SEQ ID NO: 11727 - protein, 477 aa, Polaromonas sp. JS666
MPSRATKIVVTLGPASSDPVLLEKMIRAGVNVVRLNFSHGTAQDHVDRAKLVREAAQRAGREVAIMADLQGPKIRVGKFAEGKVRLEAGEKFILDASRTEPGDLKGVGLDYKELPRDVKAGDVLLLNDGLIVLTVEAVRGEEVHTIVKLGGDLSNNKGINKQGGGLTAPALTAKDMEDIKTAMSFRADYVAVSFPKNATDMEMARQLCDVAAAPYKHKPGLIAKIERAEAIPKLEEILRVSDAIMVARGDLAIEVGNAAVPALQKRMIKMARALDKVVITATQMMESMIVNPVPTRAEVSDVANAVLDGSDAVMLSAETAAGKYPLETVEEMAKICEEAEKAEYKELEADFTGKTFTRIDQSIAMGTLFTAHHLGAKAIVALTDSGSTPLWMSRHDIRVPIYALTPHLATQRRMALYRNVRPLLMDTSADRDTALAQAEGHLLRRNIVQSGDVYAITCGEPMGAPGGTNMLKICRVA

SEQ ID NO: 11728 - protein, 206 aa, Ustilago maydis 521
MVGTLVLTRHGQSEWNKLNLFTGWKDPALTELGREEALTGAKRVAATGIKFDVAFTSALQRAQTTLGIQLKEIGQEDIPIHKDQALNERDYGELSGLNKDDARKKWGEDQVHIWRRSYDIPPPGGESLKLTAERVWPYYHKEILPLVKQGKNVIVAAHGNSLRAMIKDIENISDDDIVGLELATGVPILYKLDSDGKVVSKEILQG

SEQ ID NO: 11729 - protein, 470 aa, Erwinia carotovora subsp. atroseptica SCRI1043
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 11730 - protein, 152 aa, Arabidopsis thaliana
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (88)..(88): Xaa can be any naturally occurring amino acid
  misc_feature (93)..(93): Xaa can be any naturally occurring amino acid
  misc_feature (105)..(105): Xaa can be any naturally occurring amino acid
  misc_feature (126)..(126): Xaa can be any naturally occurring amino acid
  misc_feature (143)..(143): Xaa can be any naturally occurring amino acid
  unsure (1)..(152): unsure at all Xaa locations
MASSMLSSNAVVKSQAQATMVAPFTGLKSSASLKVTRKANNDITSITSNGGRVSRMKVWPPIGXKKYQTLTXLTXLGESERLRKLAKXLRNKXVPSVELELQHGXMLRDHGYTPGYSDGWYWTMWXLHMFGILESAQVFKAVXSCNYEYPGA

SEQ ID NO: 11731 - protein, 537 aa, Coccidioides immitis RS
MAHVENADIEPISSPGNGSDVSTLASADIPSNRIGKSQLSQEISPHALEKLDTARTCVSDDIPGNRRQIGVLTATFLVFNRIIGTGIFATPSTILALTGSVGMSLTVWFVGMIIAMAATAIYASYALFLGWAAGNSVIFGEYLLHAFGVQVNRWNQRGIGLVCITVAFIIHATAVKWGLRIQNTLGVLKLVVILIIAVGGLLACAGFVNIDRPRNFEHPWGEGPPTVYGIVMGLYNVIWSYVGYSNANYCLSETRNPVRTLKIAAPIGVAMVGILYFLVNVAYFAAVPKEEMLLSGRILAASFFRNVFGFKAERALSTFVAFCAFGNVLAVLFSQGRIVQALGREGVLPFSRFWASNKPFNSPAAGLFQHYIVSVVVMLAPPPGDAYNFLLNFQSLIGYPLSTVNVLVSGGLLHIYFCPERYPTWSPGIRATLPVTFFFFFSNVYLAVAPFLPPPRRVGNVYERLPYYTHCLAGLTIFALGALYWLFWAKILPWMGEYRLGEESVVGQDGWARKIVQRIPTAPELEEQGRRNGSMWS

SEQ ID NO: 11732 - protein, 476 aa, Streptomyces avermitilis MA-4680
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 11733 - protein, 299 aa, Glycine max
MHASSKMGEKYKPWIIFLHLLVITCSCNRSCRARGLIETEDKFFKATSNDHHETEHAHAHSHVDHIDPSVMVFFTIEDLKVGKTMPIHFPKRDPATSPKLWPREEADSLPFSLNKLPNLLKIFSVSQNSPKAKAMEDTLRECETKPIKGEVKFCATSLESMLDFTQSILGFTSDLKVLSTSHQTKSSVTFQNYTMLENIIEIPASKMVACHTMPYPYTVFYCHSQESENKIYRVPLAGENGDRVDAMVVCHMDTSQWGHGHVSFQVLKVKPGTTSVCHFFPADHLIWVPKLQPQGFATM

SEQ ID NO: 11734 - protein, 377 aa, Bacillus cereus ATCC 14579
MKAVTYQGPNQVQVKQVDDAKLEKKDDIIVKITSTAICGSDLHLYQGNMPLPQGYIIGHEPMGIVEEVGPDVTKVKKGDRVVIPFNVSCGHCFYCQHEMESQCDNSNPHYDSGGYFGYTEKFGNHPGGQAEYLKVPFGNFTPFVIPESCELEDESLLFLSDVLPTAYWSVINAGVRPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 11735 - protein, 484 aa, Pseudomonas putida KT2440
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDEAGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFQRCDESIALAAMYTANHFPGVKAIIALTESGYTPLIMSRLRSHVPIFALSPHRATQARASMFRGVYPIAFDPAALPADKVSQAAVDELLKRGLVEQGDWVILTKGDSYHTIGGTNGMKILHVGDPLVG

SEQ ID NO: 11736 - protein, 699 aa, Oryza sativa
MATSAHRRGSAGGITLVVSGKSTEDQHLLAAAGGALVLGEGDSVEDITVSLDSGAGAGAGAGFDAGAYMAALRASRFGRNFAKLPVGVVCVADVQFKGRGRSKNVWESPPGCLMFSFTSQMEDARKLPLMQYVVCLAMTEAIKELCCAKGLSELDVKIKWPNDLYLKGLKVGGILCTSSYQPKVYNICTGIGLNVDNEEPTTCLNAALKEMNANLPTLKREDILASFFNKFEVLFEIFTNEGFQALEEQYYNSWLHSGQKVVVQDGPEAQHADSVVTIQGLTPAGYLYAIGEDGKSYELHPDGNSVTMIDAIIYHLSLLTYCILQLLMIIKLVFLKDEESGHKHDPRVSCRRTSLNRQQLLHESNSAHPAAPPFSRSPSSRSSSASRQPTGPMAQDDSVVSAQWLHEHLGQPDVKVLDASWYMPVEKRDPWQEYQVAHIPGALFFDIDGIVDLTTDLPHMLPSQEAFAAAVSALDIKNHDKVIVYDGKGFFSAPRVWWMFRVYGHNKIWVLDGGLPQWRTSGFVLESSTPGDAVQKTKAANSVVERIYNGQLASDVTFQTEFQPHIFWTLEKVKHNMDAQSHQVVDARSKGRFDGVAPEPREGVRSGHIPGTKCVPFLEMFDDAPMLLPADEIRKKFEQAGISLDRPIVVTCGSGVTACILALGLYRIGKQDIPVYDGSWTEWEALPDHDYPKVTSNGS

SEQ ID NO: 11737 - protein, 224 aa, Brassica napus
MMEDGSIPAENGTDRDGSALIFLGTGCSSAVPNAMCLIQKSDSPCHVCSQSLSIPPERNPNYRGNTSLLIDYCSSDGNHNYIQIDVGKTFREQVLRWFTLHNIPQVDSIILTHEHADAVLGLDDIRSVQPFSPTNDIDPTPIFVSQYAMDSLAVKFPYLVQKKLKEGQEVRRVAQLDWRVIEEDCEKPFVASGLLFTPLPVMHGEDYVCLGFLFGEKSRVAYIS

SEQ ID NO: 11738 - protein, 551 aa, Enterobacter sakazakii
MKAIDKKWWHNAVVYQIYPRSFMDANGDGVGDLAGIISKLDYLQQLGINLIWLSPVYKSPMDDNGYDISDYDDIAAEFGTMAEMEQLIQEAKARDIYILMDLVVNHTSDEHPWFIEAKKGKDNPYRDFYIWRKPAPDGGPPNDYRSHFGGSGWAYDEASGEYYLHQFSVRQPDLNWENPRVQEEIHAMMNRWLDKGIGGFRMDVIDLIGKEVDRQIMANGKHLHVLLRQMNEATFGPRDSLTVGEAWSATPEDALLYSDPERRELSMVFQFEHIKQTWDEKAGKWRSRPFELPRFKAVIDKWQTALADRGWNSLFWSNHDLPRAVSKFGNDGEFREVSAKMLATALHCLRGTPYIYQGEEIGMTNVRYSTIEEYRDIESLNFYWELIAGGLTHDEMMTGIYANGRDNARTPMQWDDSPNGGFTTGMPWLGVNPNYREINVAQALAEPDSILWHYQKLVALRKQYPILVYGDYQMLFAEHPEVFAWVRRYEGDTLLVINNFFGNAITLPIPEAMQAWHGECLISNYAPRDQLAVSLELQPYESFALLIHQEG

SEQ ID NO: 11739 - protein, 558 aa, Enterobacter sakazakii
MSEAPTQVKGRWWKEATAYQIYPRSFKDSNGDGIGDLNGIIEKLDYLKDLGIDLIWICPMYPSPNDDNGYDISDYQGIMAEFGTMADFDRLLEGVHQRGMRLILDLVVNHTSDEHPWFLESRSSKDNPKRDWYIWRDGKNGAEPNNWESIFSGSAWKRDDVTGQYFMHLFSSRQPDLNWENHEMRAAVYDMMRWWLDKGIDGFRIDAIAHMKKEPTLSDVPNPEKLPYAPSMVSHLNYDGLLDYVDDICRNVFNHYDIVTVGEMNGLDAAHAEEWVGENRGRLNMVFQFEHVRLWEPQAGLRPTPAVLRNIFTAWQQALEGKGWNALYVENHDVTRVVSRWGDTEHHWRESATCIAAMYFLMQGTPFIYQGQEIGMTNTRFASLDDFDDVSAHNKARDLRDQGMREEEIVEFLTRTGRDNSRTPMQWDASPYAGFSTHEPWLKVNPNYEMINVESQQHDPHSVLNFYRRMIHLRKREPALIYGRYETVLHDHEQIYAYRRVLGDEQLVVLCNFSGKAAEWDARALSLNGAFCVLANLDETQEPHRLRAWETRVYKLTS

SEQ ID NO: 11740 - protein, 347 aa, Bacillus cereus ATCC 10987
MKAVVVNKNSKANIEIIEKELRPLHSGEALVDVEYCGVCHTDLHVANHDFGNTDGRILGHEGIGIVTKIADDVTSLKVGDRVSIAWMFQSCGRCEYCITGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIVQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQHVFEEMEQGRIQGRMVIDFKHNNCDCNSL

SEQ ID NO: 11741 - protein, 94 aa, Prunus avium
LWPSNYSNPRMPSNCTGPQFKRILSPQLRSKLQTSWPDVESGNDTKFWESEWNKHGTCSKETLNQMQYFERSYAMWMSYNITEILKNASIVPHP

SEQ ID NO: 11742 - protein, 392 aa, Bacillus sp. YM-2
MKELLANRVKTLTPSTTLAITAKAKEMKAQGIDVIGLGAGEPDFNTPQNIMDAAIDSMQQGYTKYTPSGGLPALKQAIIEKFKRDNQLEYKPNEIIVGVGAKHVLYTLFQVILNEGDEVIIPIPYWVSYPEQVKLAGGVPVYIEATSEQNYKITAEQLKNAITDKTKAVIINSPSNPTGMVYTREELEDIAKIALENNILIVSDEIYEKLLYNGAEHFSIAQISEEVKAQTIVINGVSKSHSMTGWRIGYAAGNADIINAMTDLASHSTSNPTTASQYAAIEAYNGPQDSVEEMRKAFESRLETIYPKLSAIPGFKVVKPQGAFYLLPDVSEAAQKTGFASVDEFASALLTEANVAVIPGSGFGAPSTIRISYATSLNLIEEAIERIDRFVK

SEQ ID NO: 11743 - protein, 3482 aa, Anabaena circinalis 90
MAQNTDYKKLIATTLTKMEAMQARITELETRQSEPIAVVGMGCRFPGGISSPEAYWNFCQAGLDAIVEVPQSRWDISKFYAPEPTPGKMNTRYGGFLQQDITEFDARFFSISSREATSMDPQHRLLLEVAWEALENANLPPTNLAGDRVGVFVGITSVDHAMTVYKSKYDEIDSFFGTGNSLSAAAGRLSYFLNLRGPCMSIDAACASSLVALHQAIRSLRNHECKIALVGGVNLILDPAITINLCQSGMMSPDGRCKTFDAAANGYVRGEGCGVLVLKRLSVAEKNGNRILALLRGSAVNHNGAAAGLTVPSGPAQQDLLRQALADARVKPQEVGYIEAHGTGTSLGDPIEMNAIAAVYGERSQPLYVGSVKTNIGHLEAAAGIAGTIKTILALQHGEIPSHLHFQEPNPLINWQGYPIKIPSQAIPWSNNGQVRIAGVSSFGFSGTNAHIIIEQAPAANIPEIKLQRPSHLLTISAHSETGLKELALRFHTRLESHPEMGDICHSAAIGRSSLPERLAIVADTLTELQQRLAAFAEEKNIDHGIFYRRFTGEKYPKIVFLFTGQGACYAGMGNQLYQTQPTFRQYIDQCADILGNYLEFPLQQILFGDRTDLLNQTAYAQPAIFALEYSLAMLWQSWGIKPSLLIGHSVGEYVAACIAGVFSLEAGLALIVKRGQLMQTAPLGKMASVFADEATVSALIQNYGNTVSIAAINHPQQIVISGESNSIDEIVANCKSQKIAVQLLSVNGAFHSPLMESILDDFEIAAREVSYHPPQILLVSGIDGQPLTTAPDASYWRQQSRQAVQYFQSLITALNKGYNLFLEVGPRPILAEQGRRYNDDAIWLSSLNRGLDNWQTMLSALAQLYINGVNFNAEKFNKDYGYRNIQLPNYPFQRKRFQFKSTVLSQSSLTKEVPLERELMETNMNLAKVANIKKNQQEIGNKLKSILALLLKEDENDIRDDETLLNLGADSIILTDFVRKIEEKFGVKVKIDQLFTDLQTIDEISIYLSDYIKQKPSNTSDETAINDILTKTSVQVSNSESELNNYLWVISQLQPIAVAYILKALEVLGKRLSIADTWTTEDLLQTLPIASKYHILVNRYLKTLEQTGIIQNQGNVWIVKSLPTPFSLPEAIENLQTICPAAKPELDMLQRCGENLAEVLKGNIDPLELIFPAGSVVHAESIYGNSPVSRLMNQRVSQAINSILNNFSSSDRPYQIIEVGGGTGATSEAIVNNLNLNHTTYFFTELSPVLLNKARQKFKNRHKFNFNQLDIEKSPVSQGLTAHSYHIVVAANVLHSTRNITETLNNIRELLIPGGYLVLLETVENNSWLDLTFGLTPGWWRFQDKELRLDTPLLSGESWCAALKRCGFVNADIYSQQNNISIYNGQELIIASTSPESAIDHQSKTVAVSIPTSGKEALMMAQLQSLKELKDIHEKTIIKQLEILQSAPVAPSNTPEVLLIQTETAPTPKISKTETTPPTQKISSPNLNPLALKLTESKSLTEQQQAFIQKLEIVYNQRTAKSKAYSQNSRKTMVDVKPTIDFRMALKEFQYPIVSESAQGAYFRDIDGNDYIDLAMGFGVNFFGHSPDFVLTEIQQQMQHGIGLGMQSNIAAETAALICEITGVERVAFSNTGTEAIMAAVRIARSRTKRQKIVIFAGSYHGTFDGILARAGEEAGTAEPLSLGTPSGMVEDVIVLTYGAEESLEIIAEQADNLAAVLVEPVQSRKPDLQPKEFIQKLRKLTQQKEIALIFDEIITGFRITPGGAQEWFEIEADIVVYGKAIGGGLPISMICGKADFLDTVDGGFWSYGDDSHPQTELTAYGGTFCRHPLALAACRAVLLHLREQGATLQETVNQLTNRLAIEVNQFFQETGIPIRIVHFGSLFRFESSGAYSIFLKPIELPLFYYLLNLKGVYTWEKRVCFLSTRHTNEDINKVVAAVKEAIIELRQAGFFANAKPPQTKKREASDRTEDEDARNNLNQQFPTSEAQRQLWLLAELDTTASASYNVTTSLELRGALDISSLQQAINEVVNRHEALRTKILEQGELQEVISSVTIDLPLINLMDEDNPEATALVLRTELSQKPFDLGVAPLFAAVLMRLAPEHYLLTLKTHHIVADGWSLGLILNELGKLYSAKIGVATESLSPPMQFRKYLALRQQEAQSPQMQAHRDFWLKTYEGEIPIFELPTDFPRPAVKTYTGGRESKIIAPQLWQNLQTVGRKNQATLFMTMFAAYTAFLRRISGHDDLVIGIPISGRQVEGSEKLVGFCSQFLPIRIQTDVTASFVTHLRHTKETLIAAFKHQTHALEELLAALQLQRDFSRSPLISVSFNLDPKLTLPEFEGLNVSLPPEPIGYTPFDLGFNFIEVNDALIIYCNYNTELFKPETIKQFLESFEILMQGVIKDANILLSELHLLTQVQQEELLAKLTGSTIELPQNSTIIDDFIAQVKSTPDAPALIVEEKTLTYRELNEKVNRLTNYLREKYNLGAGKAIALAIGRNQNLIIAILATFKTGAIYVPIDPQYPSSRIDFILKDSGCHLCLTESNFISQLPQEIEAICLDKIDNILTDFDINEPNFQPDTNQIAYILYTSGSTGNPKGVMGRHISILNVIRSLRLTFNLNKHPEWRYIFTAPVTHDPSFRNIFLPLTIGAALYMYEVQHIGHLVSFLQENKINVLHTTPSIYREILAVLAPEETIPTLKYISCGGEKLDRETAIALRKRFPAEIVSNVYGSTETCVGVSQYTIDDNLNTDVPLGQVFHNNRLFVLDEFNHPVPLHVIGEICVEGAALAVGYRNLPEITREKFQPNFLNSEKILFRTGDLGKQIAPGVIEFIGRKDNQVKVNGYRVDPGEIEYQISRYAEIEKAIVLPIEVNNQIQLSAYCQTDKDIKFSEIREFLAKYLPVYMIPSSFIFLKQFPLTKHGKFDLRSLIALKPTDQLTQVSYTAPRNTLESKLVHIWEKILTKHPIGIFDNFFEIGGHSLLLSRVVTHVHKELNVLVKLADFFKVPTILGLAALISKAQSNYQEPIPAITQQESYPMSHGQRRLWALEFLDHNHYAYGMPSAYQFNGDLNIAAFENAFKKLIERHEILRTTFTLINNEPRQIVNEQVDFAVNQIDLVDDENQAAKIAEAIRNNAKTTFDLESGLLLKINVLKLSQQSNIVLFNMHHIISDGWSAGVLIKDFLAHYHAYGKENVELPPPLRIHYKDYTSWQNQQLQTPKLQAQRDYWLPKLIPAPAPLDLPLDYTRPAVQSFSGSVVIWKPNQEFIKDFELLTKTQEASLFMGLLTLVKGFLFRYTEQNEITVGSPIAGRNHPDLEEQIGFYVNTLVLRDQITVDDSFATLLAKVKTTTIEAYDNQEYPFDKLVSDLNFKRDPSRNPLFDVVVVLQNNQNVDLAIDGIAVNTLEQELVTAKFDLEFIFVDEAELYLKLIYNTDIFANERISLMIKLLETLLEEVVKSPDTPLLHLCDHTDKACQEDNSLFATNFNF

SEQ ID NO: 11744 - protein, 398 aa, Ehrlichia chaffeensis str. Arkansas
MSLIAERMGCIKPSPTLEIANQAQKLKMSGVDVISLSAGEPDFDTPQHIKQAAIDAINSGKTKYTAVNGIIELKKVIIDRFKQDHDLIYNVNQISVGNGAKQCIYNLFMATINSGDEVIIPSPYWVSYPDVVKISGGNPVIVDCGETFKLTPDILESVITEKTKWLIMNSPNNPTGLVYTYEELKSIAEVLLKYPNIYVMTDDIYSKIIYDDLEFFTIAQVEPRLYDRVFTINGVSKAYAMTGWRIGYIAGDSRVISAISVIQSQSTTNPNSIAQFASIQALAGDQEFLKERNKIFAARRDMMVDMVNNTSLLSVKKPQGAFYVFISCKKLIGKSTRNGLVINSAMDFTKYLLEDYNVAVVPGEAFGAQGFFRISYATSTEHLSKACDRILDACGKLS

SEQ ID NO: 11745 - protein, 825 aa, Oryza sativa (japonica cultivar-group)
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSYPPHIAAYRSGLEIDPNISKTDAEDGLRKELSGQRPLRITNKNLIDYLFTCSLEIAVSYHLPMQIHTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAESGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 11746 - protein, 611 aa, Oryza sativa (japonica cultivar-group)
MQIHTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAESGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 11747 - protein, 90 aa, Zea mays
GVIAYEPVWAIGTGETATPEQAQAVHRHIRQYLADQDRAAAADCRILYGGSVKADNAEQLFNQPDIDGGLIGGASLDAMSFAAICWAAQT

SEQ ID NO: 11748 - protein, 613 aa, Anabaena variabilis ATCC 29413
MSDLFKGFEQLIELVKTLEEKAEKGEIKTDFQINSRSMSSIPRTGNIPRPNNMANDIGTSRIRTQPSPNSDSGNGDTSDVVVPPDAPSGNSLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEDTVDLDAIAERSVGFVGSDLKALCQKAAYTALRRQMPSVESAVPENMTVSQVDFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILQVHSQGRPLEGVDFNYWAEMTKNWNGADLTLLCNQAAVEAIRRFRSQGLTDPSEIKITTDDFNYAYKVLTEQRPD

SEQ ID NO: 11749 - protein, 490 aa, Neisseria meningitidis Z2491
MNQTSRDLTRISHNTKIVATLGPGSNNVELLEDMIRVGGLNVVRFNFSHGTPEFHQENARIVREAAKRTGQEIAIIADLQGPKIRVGKIAGGGIELNKGETLGLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 11750 - protein, 485 aa, Acidobacteria bacterium Ellin345
MQVRDHKTKIVGTIGPASESPEMLERLIRTGLDVARLNFSHGDFSGHRERIANLRAASDRAGRAVAVLADLPGPKMRLGTIQNEPIHLRAGDPFTLTTDSIVGDNRRCSMSFAALPQVVKPGDRLYLNDGLVHLLVERIEGTDVHCVVAVGGELRSRKGLNLPGINLGISAFTEHDRDCLKFALENGVDAVSQSFVQNAHDIELVRTAAESLGHHPFIFAKIERAEAVQNYDEILRASDGIMVARGDLGIEVPMEEIAVIQKQLISGANAAGKPVITATQMLESMITNRLPTRAECTDVANAIFDGTDCVMLSGECAVGQFPEEAVAMLGKIAAATEPHRHRAHPSNVHGAGWTPSTAAQAMGILVERALETAPSAAVFVPTLSGDTARMISRFKPSVWIVALSANENVCRNLKFSYGVEPVFVGEEADDWRPIIYDWLHQQHIRGKIALLVAAASTKHPDASHRIEFLRIPESVASATSSRTTS

SEQ ID NO: 11751 - protein, 240 aa, Glycine max
MKTPISGFYRNPVKFRMPTAENLVPIRLDIEIEGQRYKDAFTWNPSDPDSEVVVFAKRTVKDLKLPPAFVTQIAQSIQSQLSEFRSYEGQDMYAGEKIVPIKLDLRVNHTLVKDQFLWDLNNFESDPEEFARIFCKDTGIEDPEVGPAIAFAIREQLYEIAIQSVVSARESRMSKKGRRGAEYTPVSKGGAAAVDLVKLFGPKSSVVRKRKEWDVYEPIVDLLSNEEVDALEAKEERNFR

SEQ ID NO: 11752 - protein, 470 aa, Shigella flexneri 2a str. 301
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEKGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 11753 - protein, 69 aa, Zea mays
MESTFIMIKPDGVQRGLIGVIISRFEKKGCYLKALKLDHAQRSVAEKHYADLACKPFFQGLADYMISVP

SEQ ID NO: 11754 - protein, 290 aa, Streptococcus agalactiae A909
MRIADKTVTRAILERHGFTFKKSFGQNFLTDTNILQKIVDTAEIDKGVNVIEIGPGIGALTEFLAENAAEVMAFEIDDRLIPILADTLARFDNVQVVNQDILKADLQTQIQAFKNPDLPIKVVANLPYYITTPILMHLIESKIPFAEFVVMMQKEVADRISAMPNTKAYGSLSIAVQYYMTAKVSFIVPRTVFVPAPNVDSVILKMVRRDQPVVSVQDEDFFFRVSKVAFVHRRKTLWNNLTSHFGKSEDTKAKLEKALEIAKIKPSIRGEALSIPDFASLADALKEVEI

SEQ ID NO: 11755 - protein, 934 aa, Nocardia farcinica IFM 10152
MTRSFADRHIGPDAAELSRILEVVGVDSLDALAAAALPASILDDAGAGPLAALPPAVSEHEALAELAALAQSNTVTTSMIGLGYYDTLTPPVLVRNLLENPAWYTAYTPYQPEISQGRLEALLNFQTMVSDLTGMEVANASMLDEATAAAEAMTLLRRAGRSRSNRLLIDADLFPQTRTVLHTRAEPLGIEIVEADLAAAGLPEGGFFGVIVQVPGASGRVVDWTALIAAAHERGALVAAGADLLAMTLIVPPGEQGADVCFGTTQRFGVPMGFGGPHAGYLAVRSAHARQLPGRLVGVSKDADGNPAYRLALQTREQHIRREKATSNICTAQVLLAIVAAMYACYHGADGLRAIARRVHGHAARIAGALGEALVHDTYFDTVLARVPGHAEAVVAKAAACGITLRLVDPDHVAVACDEATTDAHVEAVLDAFGVAPAEPVDAGIATRTSEFLTHPAFTRYRTETAMLRYLRSLSDKDIALDRSMIPLGSCTMKLNATAEMEPITWPGFAKLHPYAPVEHAPGLLKLIGDLESWLAEITGYDAVSLQPNAGSQGEYAGLLAIRRYHLDRGDTHRDTCLIPSSAHGTNAASAAMAGLRVEVVKCRENGDVDLDDLRAKITDHAERLACIMITYPSTHGVYEHEIAELCALVHDAGGQVYVDGANLNALVGLARPGRFGGDVSHLNLHKTFCIPHGGGGPGVGPVAVRAHLAQYLPGDPLESGSHAVSAARYGSASILPITWAYIRMMGAEGLRKATLTAIASANYLARRLDEYFPVLYTGENGMVAHECILDLRELTKRTGVTVDDVAKRLADYGFHAPTMSFPVAGTLMVEPTESENLAELDEFVAAMIAIRAEIDQVGAGVWPAEDNPLRGAPHTAECLVGEWTHPYSREIAVYPRGLGHARAKVWPAVRRIDGAYGDRNLVCSCPPLEAYAE

SEQ ID NO: 11756 - protein, 358 aa, Glycine max
MSHFKGKYHDELIANAAYIGTPGKGILAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 11757 - protein, 311 aa, Mycobacterium tuberculosis H37Rv
MTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 11758 - protein, 615 aa, Zea mays
MQRSRRALLRRTAAAQEQSAVAEAAANGRRRRLYGFSASLVVASWVAVLLLHSLVGHGDGQRDGGGSTVDLTVVEPAVNVGPINPVVQEEHGEDLEMPGDSCVNSDENAVLSEDTLVQADQLCSSDEVQNENTEAVTIDSQVELSGDQGGYLPQSGVDSGVQPGEKVESKDLPRPPRLSRVAPPDLDEFKTRAIAERGPGISSQPGNIIHRREPSGKLYNYAAASKGAKVLDFNKEAKGASNILDKDKDKYLRNPCSAEGKFVIIELSEETLVDTIAIANFEHYSSNPKEFELLSSLTYPTENWETLGRFTAANAKLAQNFTFLEPKWARYLKLNLVSHYGSEFYCTLSVLEVYGMDAVEKMLENLIPVENKKTEPDGKIKEPIEQIPLKESAGGKESSQEPLDEDEFELEDGKPNGHGDSSKNGANDPVSETRTLQAGRIPGDTVLKVLMQKVQSLDVSFSVLERYLVELNNRYGQIFKDFDSDIDSKDALLEKIKTELKNLESSKDSIMNEIEGIISWKVVASSQLNQLVLDNALLRSEFETFRQKQADMENRSLAVIFLSFVFACLALAKLSIGIMSRFCRFYDFEKFHNVRSGWLVLLLSSCIISTILIIQ

SEQ ID NO: 11759 - protein, 398 aa, Pseudomonas putida KT2440
MPHDGSLLQATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFAFVVFKLALEHQVLTQAVHDLLVLAITLSMAVVPLVMMALARQLHDDSPVQASPETGQ

SEQ ID NO: 11760 - protein, 461 aa, Photorhabdus luminescens subsp. laumondii TTO1
MQNNETQLKRGLTGRHIRFMALGSAIGTGLFYGSAAAIQQAGPAVLLAYLIGGAAVFMVMRALGEMAVHHPVAGSFSHYASHYLGPLAGFLTGWNYIFEMLIVCLADVTAFGFYMKLWFPHVEQWIWVLSIVCFIGAINLCHVKIFGEMEFWLSIVKVTAIIAMIIGGMIIMIYGFGQETDHATGIASLWEYGGFMPNGISGVIASLAIVMFAFGGIEVIGITASETKNPEKTIPKAINAVPFRILLFYVLTLFILMCIYPWNQIGQEGSPFVQIFSSLGINSAANILNIVVITAAISAINSDIFGAGRMMYGMAQEGQAPKSFTKLSRNGVPWMTVIVMSAVLLIGVILNYMIPEEIFVIIASIATFATVWVWLMILLSQVAMRRKMSKEEVKTLKFPVPMWPIAPALTIIFMVFVIVLLGYFEKTRIALIVGITWVILLSITYFFSKKKNISQIHQINK

SEQ ID NO: 11761 - protein, 1102 aa, Rhodobacter sphaeroides f. sp. denitrificans
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLARFRGAVPVELTGRSEFPPVGDLPYMLTLPPYGFYWFILSDQQALPSWHQPMPETLPDFITLTTRDGRAETALTGRETRQFEADVLPNWLPLQRWFGAKEEKISAVKLAVLGSLSADHALVRLDADVGGEAQQYFLPASALWGEEQLRAGAPKLSFTLAKVRRGPQVGALIDGAYDEQMAQAMLEALREGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKEGFSFPLTIPGLLGQRTAELHQAFATETDEAAFRMEPLRAEHLTGWAEGARREAETMLSVLERQRTHLPEEVLPLAEALLARRDDLLARLDRVTGFEPSGALTRIHGDYHLGQVLLAQDDVAIIDFEGEPRRTLEERREKSSPLRDVAGMLRSFDYAAAAALARHEESFGPASERAVERAEAWRQQAVADFLSAYEGASAGTASLPSDPALKEALLDLFLVQKAVYETSYELGSRPAWVGIPLRGLLELLDRTPA

SEQ ID NO: 11762 - protein, 463 aa, Magnetospirillum magnetotacticum MS-1
MLKAIKDNDVKYVDFRFTDPRGKWQHVTFDVSLVDEEIFQDGTMFDGSSIAGWKAINESDMLLMPDPSTACMDPFFSASTMSIVCDVLEPSTGEPYARDPRSTAKLAEAYLRSTGIGDEIFVGPEAEFFVFDDVKFGADPYHTGFQLDSTELPTNGFTDYEGGNLGHRIQTKGGYFPVPPQDSAQDMRGEMLAAMQSMGVKVEKHHHEVASAQHELGMKFDKLTTLADHMQIYKYCIHNVAQSYGKSATFMPKPVYGDNGSGMHVHQSIWKDGKPLFAGDKYADLSQECLWYIGGIIKHAKALNAFTNPSTNSYKRLVPGYEAPVLLAYSARNRSASCRIPWTTNPKAKRVEVRFPDPMANPYLAFSALLMAGLDGIINKIDPGPAMDKDLYDLPPRELKKIPTVCGSLREALQNLDKDRAFLKAGGVFSDDQIDSFIELKMTEVLRYEMTPHPIEFVNYYSL

SEQ ID NO: 11763 - protein, 299 aa, Thermobifida fusca YX
MAKPPSPCGGRRLRRCLNGTMPSSLHSDLSRPPLDQQALHQALVQPGALWTSVHVVPSLGSTNTELLAQARQGAPAGTVLVTEHQTAGRGRLGRSFHTPARAALTFSVLLRPTVPSARYGWLPLLMGAATAAGVRRVAAVDAQVKWPNDVLAQDRKIAGILSEAVFGPSGPAVVIGTGLNVTQTAAELPVPTATSLALAGASCVDRGLLLCAILQAFADRYTRWVEHDGDAERSGLAAEYRSVCSTLGQQVRVHLPGNSVVEGTAMGIDTDGRLQVRSDGGRDHALTVGDVVHVRFAGP

SEQ ID NO: 11764 - protein, 166 aa, Bacillus cereus ATCC 10987
MCVGIYNYIHNSEVERFFMEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 11765 - protein, 99 aa, Brassica napus
RIPGSTHASESEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 11766 - protein, 303 aa, Zea mays
  misc_feature (223)..(223): Xaa can be any naturally occurring amino acid
  unsure (1)..(303): unsure at all Xaa locations
ARGYTLAGDWANLNSDTLLFDVCCGTGTIGLTLAQHVGMVVGIEMNESAVSNACKNGVVNGIKNCRFVCGKAEDVMGPLLTEYLGSPQQQAAASKSNSEIDDASKNEDTIGCASYDGENIDSSKQRNDNAEGQQPMGASVDHPTCASEVDENNVASGEQNCGEASLVNDKPIETASDNSLEQGKACKDGSSSPNNNVLAANACQFKNVVAIVDPPRVGLRPTXYVSCNPDSLVANAIELCTPTSEKQEKNKGNRGWRSMSSAGLARQRTKSMPNFEPFIPKRAMAVDLFPHTPHCEMVMLFER

SEQ ID NO: 11767 - protein, 323 aa, Aspergillus oryzae
MSLSTHFTLNTGAKIPAVGFGTWQAKPLEVENAVEVALKQGYRHIDCAAIYRNESEVGNGIRKSGVPREEIFITGKLWNTKHAPEDVEPALDKTLKDLGVNYLDLYLMHWPCAFKSGDKWFPLNEDGVFELADVDYITTYKAMEKLLSTGKVRAIGVSNFNVRRLEELLSQVSVVPAANQIEAHPYLQQPDLLRFCQGKGIIVEAYSPLGNNQTGEPRTVDDPLVYSIAGELSMDPGPLLASWGVQRGTVVLSKSVTPSRIAANLQVKQLPEDAFARLSSLERHKRFNFPAFWGYDIFEEVGEEAVRKAALEAGPVNKTKFTV

SEQ ID NO: 11768 - protein, 479 aa, Ashbya gossypii ATCC 10895
MSNSALQVYGGDEITAVVIDPGSFTTNIGYSGTDCPQAILPSCYGKYTEGEKDELFSEQSIGLPRKDYEIHNIVQNGEVVDWEKAEKQWDWAIRSELRFETNSGMPALLTEPIWNSEENRKKSLEVLLESMDFSACYLVPTATAVSFAMGRPTCLVVDIGHDVTSVCPVVDGMTLSKSSMRSYIAGSLLNELIRSQLAPRKVIPLFQVAQRRPVFMERKFDYEIHPSLQKFVNERQFFQEFKETMLQVAPTSISKFKSEIETTSKRSIEAPWGEELVYDSLQRLEFAEQLFTPDLSQFPEDWPISKDGVVETWHNDYVPLKRNKPGTNVKDKEGTLDATPVPDENSVTSADQPNDNGKRNLEETTPDQKNEVSGLADLIYSSIMSTDVDLRTTLSHNVVITGGTSSLPGLMDRISAELNRSLPALKFRMLTSGQLRERQYQGWLGGSILASLGTFHQLWVGKQEYAEVGADRLLKDRFR

SEQ ID NO: 11769 - protein, 1110 aa, Candidatus Kuenenia stuttgartiensis
MPPKEMLHAEEPLWYKDAIIYELHVKAFYDSNSDGIGDFKGVTEKLDYLENLGVTALWLLPFYPSPLKDDGYDIADYFGIHPDYGTLRDFKLFIKEAHKRGLKVITELVLNHTSDQHKWFHAARRPKQKSKMKDFYVWSDTSEKYKDARIIFKDFEHSNWTWDPVAKAYYWHRFYSHQPDLNFTNPAVQKEMLRIIDYWIDMGVDGFRLDAVPYLFEKEGTNCENLPETHDFLKKLRAHVESTHNNVMLLAEANQWPEDAVVYFGNQDECHMSFHFPLMPRLFMSIWMEDRFPIIDIFDQTPLLPETCQWALFLRNHDELTLEMVTDEERDYMYQVYASDPVARINLGIRRRLAPLLGNNRRKIELMNALLFSLPGTPIIYYGDEIGMGDNFYLGDRNGVRTPMQWNVDRNAGFSRVNPQKLYLPIVTDPEYHYEAINVENQEKNHASLLWWMKRVIAMRKRYKAFGRGSIEFLFPDNPKVLAFIRHYQDEHILVVMNLSRFSQVVELDLSTFSDCTPEDVFSGNKFPKITKSPYVLTINRHDYFWFLIQKEAEELRLAKDESIPELSINGKWETVFQGKTAVKLEKMILPVYLKKSRWFGGKASDIQEVKIIENISLQKDTHTTQLILIEVKYNGKESDRYVLSFSYLSGSEAETMLHENPQKIVMKLKTDDTEGIVYDGIYDEEFQKFILKMAVNRLSVKGTQGRLVVHTGKMHKQYKLKELLSEKSSVLKAEQSNSSLLYGKELIFKLYRRLCEGINPEWEIGRFLGEYTSFANVPAFIGEIAYVRKGNQPISIGILQRFIPNHGDAWSYTLDSLMTYFDRVFAKKNEILEMPVMSFSLLETTSHEIPLLFKELIGGVYLEMTSLLGKRTAELHIALSKETDNNEFRPEPFSRLYQRSLYQSMQSYLKKVFTLLRKNMKKLPENTKESVDKLLLQENRIIELYKNIFKKKISALKIRIHGDYHLGQVLYTGNDFFIIDFEGEPARSLSERRLKKSVLKDVAGMIRSFHYVSNTALLKHITIRPEDIPVLEPWTNLWYQYVAGIFLKSYIETAKNTHLFPENNEDFTMLLTSFLLEKAVYELGYELNNRPEWTSIPIKGILQLLETNK

SEQ ID NO: 11770 - protein, 483 aa, Campylobacter lari RM2100
MLKKTKIVATIGPASENEATIRQMIINGVNVFRLNFSHGTHEYHSQNLATIRKVAAELNARIGILQDISGPKIRTLKIPETFELKNGDRLDFYKDTFEGEKLSSEHYKVCINHPEILSMLKVGEYIYLCDGSIKTKVVQVEKDFIQTQVENSGVLSSNKGINFPNTKINIDVITQKDKDDLAWGIKNDVDFLAISFVQNAHDIDEVKKILDENDAKIAIFAKIEKFDAVENIDEIINCSDGIMVARGDLGIEVPYYRVPNIQKLIIKKANEANKPVITATQMLFSLAKSKTATRAEISDVANAVLDGTDAVMLSEESAVGIDPANAVDIMTQTIIETEKNYPYEKFETFKCFNETDIIAKSSTQLATDLNANAIFTITSSGASAVKTARYRPKMDIIAITHSKKALNFLSIVWGVQPAILIEKHENLTELLSNSVKLGVEKGLMKKDGVYTLTAGFPVGVAGSTNLIRILQKDQIEYYLSLGK

SEQ ID NO: 11771 - protein, 253 aa, Wolinella succinogenes
MPPTLTLYGYGKMALAIAKGLSGRFPLEITGRNPQKIEELIALHGLNASPLFPHDSPLDITDRHLLLCVKPYALSELSFSGEAKGVYSILAGVSIERLREKIPAQSYIRAMPNMAASLGSSCTALCGDESLKALASEIFAPLGTSLWLDKESKIDAATALAGSGPAYLALMAEALMDAGVREGLSREESKALTQGLFSGFADLLEDRHPALIKEEVTSPGGTTAEALALLESKGLRGILIEAVRAALLKAKKL

SEQ ID NO: 11772 - protein, 522 aa, Kineococcus radiotolerans SRS30216
MTWAPGLGTPGRAGAGRVAVRWTSRSWRAPPAGPGAGPNRLGVMRRAKIVCTLGPAVAGHDGLRSLVDAGMDVARLNLSHGSHDDHRANFEGVRAAAAATGRSVAILADLQGPKIRLGRFADGPHDLAVGDVFTITTEDVVGTREICSTTYAGLPGDVSVGDAILIDDGKVGLVVTAVEGPRVTTLVTVPGPVSNNKGINLPGVAVSVPALSEKDVEDLRFALRLGVDMVALSFVRSAADADDVHKVMDEEGITVPVIAKVEKPQAVQNLREVVAAFDGIMVARGDLGVELPLEEVPLVQKLAIELARRQAKPVIVATQMLESMITAPRPTRAEASDCANAVLDGADALMLSGETSVGAFPYEAVRTMARIIENTETHGAERIAALGTVPHTKGGAITLAAAEVGKQLDAKLLVTFTQSGDSARRLSRLRSGIPLLAFTPDEATRRRLALSWGIEPEFAAFISTTDEMVKEVDRRLQEMGRCAVGDLVVIVAGAPPGIVGSTNALRVHRIGDATSGMSAAYA

SEQ ID NO: 11773 - protein, 350 aa, Nocardia farcinica IFM 10152
MKALTYAGPQAISCTEVDDPALPGPDGAIVRVTAAGICGSDLHIYGGHGFTPGTGYGVGHEAVGQVVELGPQAHGLSVGDRVLVPASAGCDRCGNCRAGVVAACARQPLPVDACYGLGGALAGAQAQLLAVPHAGGNLVRLPDAIGDEAAVVLTDNAPTAWYGARRARIAPGDTVVVIGLGPVGLMAVQAAFVMGAARVLGVDLVADRRARAAALGAEPVEDDDPKQAVREMLGGGGADVAVEAVGADATIALATAVVGHRGRVAVVGVSQNRAFPFHLPLAQVKELEFHIGLCSVQYELPALLSLTAAGRLRPEVVVSHRLPMSAGARAYRMFADRADDVCKVVLDPWR

SEQ ID NO: 11774 - protein, 597 aa, Arabidopsis thaliana
MVEGRRRRRFSLSSQQLALLLLLLSFFLCFSVASPRAISDSDLLDETVANSSSSVASLNASSSSSLVKPKEGSFADIIDRALEKEFNESDQNEVADPGSFNNSVAGQQAVLETVARVKSTKKNETKEEKRFQLHDVFNLNNDNRAEDTPTLIDRKDNVFIISNSKSKYPVLQLDLRLISDLVVVIVSATCGGIAFACAGQPVITGYLLAGSIIGPGGLNFISEMVQVETVAQFGVVFLLFALGLEFSTAKLKVVRSVAVLGGLLQILLFMFLCGITVSLCGGKRSEGVFVGAFLSMSSTAVVLKFLMEKNSTNSLHGQVTIGILILQDCAVGLLFALLPVLEGNSGIVHGMLSIGKVVVLLLSFLAVLSILSRTCIPWLLKLMVSLSSQTNELYQLAAVAFCLLVAWCSDKLGLSLELGSFAAGVMISTTDLAEHTLEQIEPIRNLFAALFLASIGMLVNVHFLWTHVDILLASVILVIIIKTTIVTTVVKGFGYNNKTALLVGISLAQIGEFAFVLLSRASNLHLIEGKLYLLLLGTTALSLVTTPLVFKMIPAVVHLGILLKWFSPDSTIEKGEIVRSESGKQRMILMSRQSHSS

SEQ ID NO: 11775 - protein, 437 aa, Schizosaccharomyces pombe
MSNDFMLEDDENYDFEFEDDDDDMIEPYVDVENCYYNSKSLKEENPESALTSFYSIVEKCEGEQNEWAFKALKQITKINFQLKKYDDMLQSYQRLLGYTNWLSITKNYSEKSIYNIVEYASSCENTEFLEKFYDVTTKALQNLNNERLMLKVLMHVARFLLTQKNYHKFKYLLRQMHELLSDENNSVADQNRGTHLLELYSLEIQMYSDIEDNKRLKELYQSSLRVKTAIPHPRIMGIIRECGGKMHMQENQWSEAQTNFFESFKSYDEAGSSDRIRVLKYLVLANMLSESEINPFDSPETQPYKDNPHIIAMTKLVEAYQIRDITAVERILQTYQHDILDDDFIRQYVDKILYSIRSQVLIELVKPYTSVKLSLLAKKLGVSISIIEQALVGLIIDERVNGKIDMVNEVFTISQPKNTIHNQLVEDVQKLWNTATK

SEQ ID NO: 11776 - protein, 337 aa, Mucor racemosus
MVVQVGINGFGRIGRIVLRATESNKDVQVVAINDPFIPLDYMVYMLKYDTVHGRFDGSVEAKDGKLVVNGHAIAVSAERDPTSIPWGSAGADYVVESTGVFTTTEAASAHLKGGAKKVIISAPSADAPMFVCGVNLEAYKSEYKVISNASCTTNCLAPLAKVINDNFGIADGLMTTVHATTATQKTVDGPSHKDWRGGRAAAANIIPSSTGAAKAVGKVIPALNGKLTGMAFRVPTPDVSVVDLTVNLSKGASYDEIKQAIKKASETTMKGVLGYTSDAVVSSDFVGEVCSSVFDAAAGIQLTPTFVKLIAWYDNEYGYSNRVVDLLVHAAKVDGAL

SEQ ID NO: 11777 - protein, 161 aa, Brassica napus
MRRGKEEDDEVEQLLQAAQDEMILKLSVDSHASRSRPDYLDPDLHSRFLALRSKPSQQKKNKKTTEQKRRPVSPPKSKDVEETPDDLMLRFAALKSTLPSSSVPPSVLRPGEMGDEADELGEDDEVEKLIQWAVDAARLDPSPPSDDDDDDDDRSSDSDDE

SEQ ID NO: 11778 - protein, 307 aa, Oryza sativa (indica cultivar-group)
MAGGFLSMANPAVTLSGVAGNIISFLVFLAPVATFLQVYKKKSTGGYSSVPYVVALFSSVLWIFYALVKTNSRPLLTINAFGCGVEAAYIVLYLVYAPRRARLRTLAFFLLLDVAAFALIVVTTLYLVPKPHQVKFLGSVCLAFSMAVFVAPLSIIFKVIKTKSVEFMPIGLSVCLTLSAVAWFCYGLFTKDPYVMYPNVGGFFFSCVQMGLYFWYRKPRNTAVLPTTSDSMSPISATAAATQRVIELPAGTHAFTILSVSPIPILGVHKVEVVAAEQAADGVAAAAAADKELLQNKPEVIEITAAV

SEQ ID NO: 11779 - protein, 954 aa, Bordetella parapertussis
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARTNLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 11780 - protein, 401 aa, Kineococcus radiotolerans SRS30216
MRALTWQGKRSVSVQDVPDPRIVDPTDAVVRITSTAICGSDLHLYEVLGPYMSKGDVLGHEPMGVVEAVGPAVANLQVGDRVVIPFNISCGHCFMCTRGLQSQCETTQVHEQGSGAALFGFSSLYGSVPGGQAEYLRVPHADYGPVKVGREGDGGLPDDRYLFLSDIVPTAWQGVQYADVPDGGTLAVLGLGPVGQFAARIGRHLGYEVIGVDPVAERRQMAQRHGVTAIDLTDGDADVVTQLRERTDGRGPDAVLDAVGMEAHGGAEGAVAKAAQTAVGLLPDALAQKVTETAGVDRLWAVRSAVEAVRRGGTVSLSGVYGGEADPLPMKTMFDKQLQFRMGQCNVRRWIDDLLPLVEDPADPLGVEDLTTHRVSLEDAPDAYEMFQEKRDGCIKVVITP

SEQ ID NO: 11781 - protein, 175 aa, Zea mays
LSDSRTNPRLPILIASNRARCCPSPSSFPSWCYLPHASADGDICIIGGGISGASTAFFLTSYTSTLGGAQLRVFERRQKVGGRLGTVTLAGDSFEAGGSIIHPRNLHARRFADLLGLAVKTGGDDWLGIWDGKSFVFQTARPPPVGSSWWRRKLHSLVNSLLLLRRYGLSLPQDP

SEQ ID NO: 11782 - protein, 146 aa, Glycine max
MKPIDDKQETVTIRTVSHDEEGKKRVEKTELSTHNIDTIRYVEKKLINKGVQRQDRHPADGIGISRPPPKSGHGGKFTWEGPATVENSELMAAPAAMDEGDPNYVDWEENGEEASELVVGEVEVSKVAQEHDGLARVDVDPRLQVN

SEQ ID NO: 11783 - protein, 258 aa, Burkholderia xenovorans LB400
MSKQRAKLVVGNWKMHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQAVHAFLRARLAAKGAAVADVPLLYGGSVKPENAEELFRQPDIDGGLIGGASLKAQDFLVICKAATTSVAG

SEQ ID NO: 11784 - protein, 809 aa, Corynebacterium diphtheriae
MSKHRSPETGHASASVSHPACADMNIAGYVRAASGTAPADATDRKFWFGLSAAVMQQLADNWDATTKAYSATRQQHYFSAEFLMGRALLNNLTNLGLDESVAEEVRNNGHELADVLEAENDAALGNGGLGRLAACFLDSCATQDFPVTGYGILYRYGLFKQTFDNGFQTEHPDAWREDGYPFTIRRDDQQRTVTFDDMVVRATPYDMPITGYGTDNVGTLRLWKAEPVEEFDYDAFNSQRFTDAIVEREQVMDICRVLYPNDTTYAGKVLRVRQQYFFVSASLQQMIDNYIEHHGTDLRDFHKYNSIQLNDTHPVLAIPELMRLLLDEHNMSWDDAWAVVQGTFAYTNHTVLAEALEQWNVSIFQQLFYRVWEITQEIDRRFREEMQARGVDQGQIDYMAPVQDGNVHMAWIACYAAFSINGVAALHTEIIKAETLRDWHEFWPEKFDNKTNGVTPRRWLKMCNPRLSALLTRLLGSDAWVTDLSELHKLREFVNDDAVMKELLEIKTANKVDFARWIEDRQGIAVDSDSIYDTQIKRLHEYKRQLLNALYIMDLYFRIKEDGETGIAPRTFIFGAKAAPGYIRAKAIIKLINAIAELVNNDPEVSKTLKVVFVENYNVSPAEHIIPASDVSEQISTAGKEASGTSNMKFMMNGALTLGTLDGANVEILDAVGDDNAYIFGAKNEELPELKAHYNPYEKYETVPGLKRVLDALVNGTVNDDNSGWFHDLRGSLLDGNGWETPDVYYVLGDYASYRETRDRMANDYMSDRLAWARKCWINICESGRFSSDRTISDYAREVWKIDATPINH

SEQ ID NO: 11785 - protein, 251 aa, Nicotiana tabacum
MDKEREKQVYLARLAEQAERYDEMVEAMKTVAKMDVELTVEERNLVSVGYKNVIGARRASWRILSSIEQKEESKGHDQNVKRIKTYQQRVEDELTKYALTLSVIDEHVVPSSTSGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNFTLWTSDLEEGGEHSKGDERQGEN

SEQ ID NO: 11786 - protein, 175 aa, Triticum aestivum
MAPTVMASSATSVAPFQGLKSTAGLPVSRRSSSAGLGSVSNGGRIRCMQVWPVEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 11787 - protein, 798 aa, Aspergillus oryzae
MAAAFDDEDLSVPLPSYDHDRRRERASGATSPNSNFAGMTMPPPSRPIGRGGDPSMQSPATTRDMQRLDQYQTVKVLGEGSFGKVKLAIHQPSGRQVALKIISRRKLLSRDMVGRVEREIQYLQLLRHPHIIKLYTVIATKTDIVMVLEYAERELFDYLVKRGRCNDAEARKFFQQIICAVEYCHRHKIVHRDLKPENLLIDSEKNVKIADFGLSNIMTDGNFLKTSCGSPNYAAPEVISGKLYAGPEVDVWSCGVILYVLLVGRLPFDDDYIPALFKKIAAGNFHMPPYISSGAARLIRSMLQVHPVHRLTIPEIRQDPWFQKDLPKYLQPPPEEFIATGVDPNKAIDPRKIAPGKPISVQHKIHQVAIAKLERNMGYGREDIEDALKNPEPSAIKDAFFIIVENEMMQTNSPTDENLMPPTPLPPSDRTSLSSAAAGRTTAAHSQGTRAGPPTRTRSGSQRQPFQLHQPSESDDLETSRVSHVRILPTSLPYVHDQLMEQRERERRARAADRLAEEQARSGSDALEDPHQSGLDGRSLEEQEATAKALKPHSRSIVDLDKLRLEPPEARNAPHQPRKTRKWQFGIRSRNQPYEAMLYLYKAIAAQRGRWEILPAESGTQIGSQSPDEPTPLQSKYPDLPSDYYIPKDPWFIRARLLKEGVKAPGSSGSVHSSRSDISELRRRFNLTGGASSVDEKSHSPSEHWSTSGPSSASQHHSIPRVAYGVWVFVDIQLYQLEENNYMVDFKCDGYQNVIRAESDTEWHPISKRFRNKEKEITSPYPFLDVASDLVAQLAVAS

SEQ ID NO: 11788 - protein, 141 aa, Neisseria meningitidis Z2491
MAIERTISIIKPDAVGKNVIGKIYSRFEENGLKIVAAKMKQLTLKEAQEFYAVHKDRPFYAGLVEFMTGGPVMIQVLEGENAVLKNRELMGATNPSEAAEGTIRADFATSVSINAVHGSDSVENAALEIAYFFSQTEICPR

SEQ ID NO: 11789 - protein, 285 aa, Zea mays
AEIIRDYKTGDSLCYAFIEFDTKEACERAYFKMDNCLIDDRRIHVDFSQSVSKLWGQFRQSKRNAKKDGCFKCGAPDHLARDCDQDGEQKNKGPSYVLKDENTQRGGNHRRSYDLVFDEDEADCSEERDHENGHRRKNRRIDDRKSELPPRGGRDRNSHERTHSDEKGSKHGKDDRNRGDRKHDDYHSYSRSGDRSSGRNDDRDYSKRHDRSRSGEEEKGYRRRDKSDGERHHRDDGYDRRRRDEDSHRKRSPDSKHRREDGGHHVRNQQSDDRSYKERRHRDGR

SEQ ID NO: 11790 - protein, 306 aa, Pisum sativum
MISIIPIILIHTLFYVGFSDDMPLTTTLPQSPTSPLPHFHLYNQNSNSYPSSTPLEESKRRSPPPRRRSPPPPPRRSPPPPPRRSSPPPPPPRIRSPPPPRPPPPPPPPLLFDHFKLSQTWPPTYCKLKNNDCVSPLPQKFTIHGLWPSKEGVEIRDCNKEGINVNDFVPIKTRLNENWPALFKKDHQEDANIQLWVNQWYAHGTCSDQLFKFISYFEETLNVYDRHIILDILEKNGTKPGGTYPKQNILNANQTHTLFRPQIRCERIDNLDYLYEIRLCLTPTLKLEYKDCEIPYSGCRDTEVYF

SEQ ID NO: 11791 - protein, 338 aa, Nocardioides sp. JS614
MRATTIHGLRDIRVSEVPDPAITAPTDAIVKVVAGCICGSDLWPYRGENDIRPGATIGHECVGVVEEVGAEVRSVRPGDFVIVPFDHCDNTCPHCLAGAQSACVNLGFTVSGQAEYARVTQADGSLVATQGTPDAGLVPSLLTLSDVLPTGWHAAVSAGVREGGTAVVVGDGAVGLCGVLAASVLGAETIVAMSRHEPRQELARRFGATHIVAERGDEGTAAIMEITGGVGADAVLECVGTDQAMRTAFSTARPGSTVGFVGVPHGVELPVREMFQRNIGLAGGMAPTRRYIPELLELVLADRIEPGLVFDSTLPLDQVAEGYRAMDERQAIKVLIEP

SEQ ID NO: 11792 - protein, 480 aa, Shigella flexneri 2a str. 301
MSKRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPTDVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVPFDSANDGVAAASEAVNLLRDKGYLMSGDLVIVTQGDVMSTVGSTNTTRILTVE

SEQ ID NO: 11793 - protein, 404 aa, Oryza sativa (japonica cultivar-group)
MAIGGWQDERYAIQGEKYQGQQYSHIYFTRLHHMRNLLHALVPSWKPHLPVTTVLGLEEGKDCIIVGTLYKHMKLKPSILDEYSKERSAIPLVKPHNFMHPDDHLILEDESGRVTLAGAIPPAAYVTDEDKYVVFVSGLSIGSEKFNPLQFQLLIDHITGHLGDENEQSIASNIVRVVVAGNSVHISPRFFNGQAVASKDQSRIAEPIKELDIMLTQLVASLPVDMMPGSNDPANFSLPQQPLHRCLFAGAATYNTFSSCSNPHQFELDSVRFIGTSGQNIDDLYKYSDAKDKLEFVERTLRWRHLAPTAPNSLGCYPYTDKDPFLVESCPHVYFVGNQDKYETQLLQGLEKQKVRLICIPRFCDSGVAVMVNTSSCMLTIGKAALFYLCNLESYKEAKSSSGD

SEQ ID NO: 11794 - protein, 135 aa, Nocardioides sp. JS614
MSLRTLVLLKPDAVRRGLVGAILSRYEAKGLTIVAMEQRTIDAAVADQHYAEHVAKEFYPPLRDFVTGGPLVALVLEGDNSVDVVRLLNGATDGSKAAPGTIRGDFSLSNRENLVHGSDSPESAEREIGIWFPGL

SEQ ID NO: 11795 - protein, 137 aa, Wolinella succinogenes
MEQTLSIIKPDAVAKNVVGKIIDRFESNGLKVAAAKRLQLSRADAEQFYAVHKERPFFKDLVDFMVSGPVVAMVLEGENAVLKNRDLMGATDPKKAAPGTIRADFADSIDANAVHGSDSLENAKIEIAFFFSGREIN

SEQ ID NO: 11796 - protein, 552 aa, Schizosaccharomyces pombe
MDEKKALQYEESKRAEEITDIELVSVGGIDVEKKYGETKRALKSRHVQLIAIGGCIGTGLFVGSGSALSESGPASLFLSYVIMSFVIWTVMNALGEMCTYLPLSGASPITYIERYVDASLAFAAGWNYWYAYVFLVASEVTAASIVIEYWTYAVPTAGWIAILLFLVAVLNSFFVKWFGETEFWFAIIKVIAIVGLIILGVVIFFGGTPKHDRLGFRYWKHGLAFREYIVKGASGRFVGFWSAVIKSGFAFILAPELVIFSAGETEAPRRNIPKATSRFIYRLIFFYIFGSLTIGVITSSKDPRLLNAISSGASGAAASPFVIGIQNAEIPVLNHIINAVILTSACSSGNSFLFAGSRSIYSLAKEHQAPKIFKYCNRWGVPVISVAVTVLFACLAFLNASASAAVVFNWFCNLSTISGFLAWICVLVAYLQFRKAMILNNLWETRPYKTPFQPYATYLTLFLLALITLTNGFTVFVGHTFTAGNFIAAYITLPIFLVLYVAHKLWSRNWSFGKRIEEIDVTTGVAEAEALEQMYPAPVPRNIIEKIWFWIA

SEQ ID NO: 11797 - protein, 272 aa, Staphylococcus aureus subsp. aureus MSSA476
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 11798 - protein, 473 aa, Corynebacterium diphtheriae
MERRTKIVCTLGPAVASREGILGLVKAGMNVARMNMSHGDHADHEKNYQWVREATDETGRAVGILADLQGPKIRLGRFIDGATVWENGEIVRITVDDIEGTHDRVSTTYKNLAKDAKPGDRLLVDDGKVALRCVEVDGNDVVCEVVEGGPVSNNKGVSLPGMDISVPALSEKDIADLRFALNLGVDIIALSFVRSPADVELVHAIMDEEGRRCPVIAKLEKPEAMDALESIVLAFDGIMIARGDLGVECPLEQVPLFQKRAIQIARENAKPVIVATQMLDSMIENLRPTRAEASDVANAVLDGADAVMLSGETSVGIDPANVVRTMSRIVSYAEIDGRVPNLAHIPRTKRGVISYSARDIAERLNAKALVAFTSSGDTAKRVARLHSQLPLLVFTPHQEVRSQLALTWGVETFLTDEVKDTDEMMRTIDEQLLALDTYSEDDMIVLVAGTPPGVQGNTNMIHVHHLGEDLNGL

SEQ ID NO: 11799 - protein, 152 aa, Kluyveromyces lactis NRRL Y-1140
MSNTERTFIAIKPDGVQRGLISKILARFEDRGYKLVGIKLVTPTEALLKEHYADLVSKPFFPSLLSYMTSGPVLATVWEGKDVVKQGRAILGATNPLQSAPGTIRGDFAIEVGRNVCHGSDSVESAEKEIGLWFKKEELIDYKLNQLSWIYE

SEQ ID NO: 11800 - protein, 175 aa, Triticum aestivum
MAPTVMASSATSVYPFQGLKSTAGLPVSRRSNGASLGSVSNGGRIRCMQVWPIEGIKKFETLSYLPPVSTEALLKQVDYLIRSKWVPCLEYSKVGFISREHNASPGYYDGRYWTMWKLPMSGCTDATQVINDVEEVNKEYPDAFVRIIGYHNMRQVQCVSFIAFKPPGCEESGKA

SEQ ID NO: 11801 - protein, 379 aa, Arabidopsis thaliana
MKVLRCLLLISNQTHLVSSRQYSWKCAQRTTGEVVAKNANGPSNNMGARIFTFRELATATKNFRQECLIGEGGFGRVYKGKLENPAQVVAVKQLDRNGLQGQREFLVEVLMLSLLHHRNLVNLIGYCADGDQRLLVYEYMPLGSLEDHLLDLEPGQKPLDWNTRIKIALGAAKGIEYLHDEADPPVIYRDLKSSNILLDPEYVAKLSDFGLAKLGPVGDTLHVSSRVMGTYGYCAPEYQRTGYLTNKSDVYSFGVVLLELISGRRVIDTMRPSHEQNLVTWALPIFRDPTRYWQLADPLLRGDYPEKSLNQAIAVAAMCLHEEPTVRPLMSDVITALSFLGASSNSSNTGSNHLQQNRSNKYQDAVQWDSSPRYANSQM

SEQ ID NO: 11802 - protein, 552 aa, Oceanobacillus iheyensis HTE831
MNKIWWKEAVTYQIYPRSFMDSNGDGIGDIQGIISKLDYIKGLGIDVIWVSPIYESPNDDNGYDISDYQDIMDEFGTMEDFDELLEQVHHRGMRLIMDLVINHTSDEHPWFIESRSSKDNPYRDYYIWRSSENNLEPNNWASIFGGSAWKYDKKTDEYFMHIFSKKQPDLNWENPKVREELYDMVNWWLDKGIDGFRVDAISHIKKTADFPNLPNPENKKYVPSFEGHMNRDGIQIFLQEFKEKTLDNYDIMTVGEANGVSISQADEWVGEDNGVFNMIFQFEHLDLWGKNTDNGLDLKALKETLTKWQKGLESVGWNALFLENHDQPRSISSWGDPKTYHIESAKALATLYFLMQGTPFIYQGQEIGMTNVHYPSIEDYDDIDAKNLYEEMMQEGASSKEVLEIIWKTGRDNSRTPMQWNNSKNAGFTSGNPWLKVNDNYTSINVEQQLNDLDSIYHYYRKLIELRKQHETLIYGGYDLILENHSQIYAYTRTLDEKQFVVFINLFPEKCSFELPSSLAKMERSLLLSNYEAAVNGELQPYEARVYQITKK

SEQ ID NO: 11803 - protein, 109 aa, Glycine max
  misc_feature (13)..(13): Xaa can be any naturally occurring amino acid
  misc_feature (60)..(60): Xaa can be any naturally occurring amino acid
  unsure (1)..(109): unsure at all Xaa locations
PVPAVVLLSGGQXEEEASVSLYAINQVNGEKPWSFSFSFGRALQQSPLKAWGGKEEHVQXAQEALLVRSKAHSEASLGPPKGQSQLDDGASQSLHVWNYRCWSMGVGVV

SEQ ID NO: 11804 - protein, 429 aa, Methylobacillus flagellatus KT
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLCANVPGQLAIQTALGGYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEGKASKEAQTTSQSASA

SEQ ID NO: 11805 - protein, 427 aa, Zea mays
  misc_feature (279)..(279): Xaa can be any naturally occurring amino acid
  unsure (1)..(427): unsure at all Xaa locations
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTWAEKRTFLRQRVEARLAALLLENQEYTEALTLLTSLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAXGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDPKTEEIFPATLETISNVGKVVDSLYVRSAKIMA

SEQ ID NO: 11806 - protein, 583 aa, Oceanobacillus iheyensis HTE831
MLKEAVFHRPKNNYAYLYKENTLHIRLQTKKDDVVKATLIYADPYNWDDSGWIYNKADMRLIASDQLFDYWQIEIYCKTRRIRYGFQLSDTKETLIYTEKGFYKEIPNDDTAYYFCFPFLNPIDQFQAPEWVKETVWYQIFPERFANGNETINPPGTLPWGSTTPTPTDFFGGDFQGIINHLDYLVDLGISGIYFTPIFKAFSNHKYDTIDYMEIDPQFGDKQTFRKLVKACHQRGIRIMLDAVFNHSGYFFEPFQDVLKNQEKSIYKEWFHIESFPLRTDPAPNYDTFAYVGSMPKLNTEHPEVKSYLLKVASYWIEEFDIDGWRLDVANEVDHQFWRDFRRQVKSIKPDVYILGEIWHDSMPWLQGDQFDAVMNYPLTSAALDFIAKEKIDVKEFVQQISNVLLSYPQNVNEVAFNLLGSHDTPRVLTHCNNQVEKAKLLYILLLTMPGSPCIYYGDEIGMTGEGDPGCRECMVWDENEQNVELKSFLKKLIHVRKTEKAVANQGEFSFVKTSDNYFIYKLFQQHMEIYIIINPSNQALEVSLPVTKWNSAFDLWEEDDFNINTPIKCEENSFKIIKVNYS

SEQ ID NO: 11807 - protein, 343 aa, Thermus thermophilus HB8
MRALAKLAPEEGLTLVDRPVPEPGPGEILVRVEAASICGTDLHIWKWDAWARGRIRPPLVTGHEFSGVVEAVGPGVRRPQVGDHVSLESHIVCHACPACRTGNYHVCLNTQILGVDRDGGFAEYVVVPAENAWVNPKDLPFEVAAILEPFGNAVHTVYAGSGVSGKSVLITGAGPIGLMAAMVVRASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLLTHRLPLSRYREAFGLLASGQAVKVILDPKA

SEQ ID NO: 11808 - protein, 231 aa, Burkholderia xenovorans LB400
MTQDELKQLVGQAAADYVNANVPEGSVIGVGTGSTANCFIDALAAGKTRYRGAVSSSLATTARLQSHGFKVLDLNEIDSLPVYVDGADEIDHSGAMIKGGGGALTREKIVASVSDVFVCIADASKLVETLGSFPLPIEVVPMARTSIGRRVTALGGVPVVRVTKEGVPFITDNGNEIIDVKGLRISDPRTLETHVNAWPGVVTVGLFASRGADLCLLGTDTGVDTIRFSKG

SEQ ID NO: 11809 - protein, 836 aa, Candida glabrata CBS 138
MTANASLGKLNDLLEGIRQEFAQLSHEANSYRLHQKDYDYKIKQQLAEMQQIRNTVYELEMSHRKMKDAYDEEIERLKIELDTRDRQLATLSAQQQQQQQQQQQQQQQQQQQQQQQQQQQQQQQQQQQQQQQQQQQLHQQQLQASPTGQGHVQVDQNGAYQLYRPVQAATIETNGGLPAGGQSTLPQPYNAIAASQADHVQQRHRMAPAVGNLTSTPTVNSQHSTHPPTPALASSSKMQPTALATQPVTMPATQLPTFQQPQVETPQIKHEAPQSATQITQTPTLQSATVAANTPKVQTPSVATPGIQATPSSANQVEVATAPTIAKSPANKQPAILNQTSPVNTAANAAPILSEKIKSPLQESQAPGTTVSEVTTSNADATQSPGQTSSALDSNRPEINEKVDEKATQTVQETAGKKQDTADKSDESNNYLVPLEQRADHVKPIPPFLLDLDASSVPENMKKQTNDYYVLFNPALPRSIDLDLHKTLEHTSVVCCVKFSNDGEFLATGCNKTTQIYRVSDGELVARFSDENAHTDKADGNDNAEAETSAGATTDLYIRSVCFSPDGKFLATGAEDKLIRIWDIEQKKIVMVLKGHEQDIYSLDYFPSGDKLVSGSGDRTVRIWDLKTGQCTLTLSIEDGVTTVAVSPGDGKFIAAGSLDRAVRVWDSDTGFLVERLDSENELGTGHKDSVYSVVFTRDGNGVVSGSLDRSVKLWNLRNVNHNNADGKPTSGTCEVTYTGHKDFVLSVATTEDDEYILSGSKDRGVLFWDKVSGNPLLMLQGHRNSVISVAVNHGHPLGPNYHIFATGSGDCKARIWKYIKTTTEVNSNGKIQPIS

SEQ ID NO: 11810 - protein, 526 aa, Zea mays
  misc_feature (402)..(402): Xaa can be any naturally occurring amino acid
  unsure (1)..(526): unsure at all Xaa locations
MTRTTTSSTLLTAALLCLALPLLPGATANKAARRRQGDNLARLRGSPWPAESSVSLAVAATDDRASRHAASPPAGRSKEDDRVDKLPGQPSGVDFEQYAGYVTVDAAAGRALFYYLTEAVGGGAAAKPLLLWLNGGPGCSSLGYGAMEELGPFRVKSDGKTLYRNPYAWNNAANVLFLESPAGVGFSYSNRTEDYSRSGDNKTAEDALLFLLNWMEKFPEYKGRDLYLAGESYAGHYVPQLAHAILRHAAAAASKPSSSPINLRGIMIGNAVINDWTDTKGMYDFFWTHALISDATADAIGRHCNFSAAAAAAAAGSNDKCDEATSEADEALEDIDIYNIYAPNCQSADLVSPPITPSMDNFDPCSDYYVEAYLNGPDVQRALHANVTRLDHPWSACSDVLXAWADSAATVLPILAELLKNDLRVWVYSGDTDGRVPVTSSRYSVNQLQLPVAAKWRAWFSSTQGAGEVGGYVVQYKGKEKGSLSLVTVRGAGHEVPSYQPKRALVLVQGFLAGKALPDCETCESG

SEQ ID NO: 11811 - protein, 393 aa, Listeria monocytogenes str. 4b F2365
MDLPLSKRVKGVAPSPTLAITAKAKQMKQEGIDVIGLGAGEPDFNTPQNIIDAAIESMNKGFTKYTPSSGIIELKQAIVDKLQKDQFLNYETNQIFVGTGAKHVLYSAFQTILDPGDEVIIPVPYWVTYPEQVKLAGGIPVFVETGFDADFKISAANFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELSSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 11812 - protein, 495 aa, Medicago truncatula
MKKVSLYACLLLNLSLLVIFPYSKASQADKFNEFILSRKSQNPPKTLSWEEGDALKTHSFSAAYVAPPQEELRLADKIVTLPGQPYGVNFDQYSGYVTVDPEAGRELFYYFVESPHNSYTKPLILWLNGGPGCSSLGYGAFEELGPFRVNSDGKTLYRNPYAWNEVANVLFLESPAGVGFSYSNTSSDYDNSGDKSTAKDAYVFLINWLERFPQYKTRDFYITGESYAGHYVPQLASTILYNNKLYNNTIINLKGISIGNAWIDDATNLKGIYDNLWTHALNSDQTHELIEKYCDFTKENVSAICNNATDKAFVETGKIDIYNIHAPLCHDSSLKNGSSTGYVSNDFDPCSDYYVTAYLNRPEVQKALHAKPTNWTHCTHLLTTWKDSPATVLPTVKYLIDSGIKLWIYSGDTDVVVPTTSSRYLINTLKLPINSAWRPWYSGKEIGGYVVGYKGLTFVTVRGAGHLVPSWQPERALTLISSFLYGILPSGSPSN

SEQ ID NO: 11813 - protein, 438 aa, Streptococcus agalactiae NEM316
MNEKVFRDPVHTYIHVNNQVIYDLINTKEFQRLRRIKQTSTTSFTFHGAEHSRFSHCLGVYELARKVTEIFDEHYSDLWNKNESLLTMAAALLHDIGHGAYSHTFERLFNTDHEAYTQEIITNPTTEINAILRKVAPDFPDKVASVINHSYPNKQVVQLISSQIDCDRMDYLLRDSYYTAASYGQFDLTRILRVIRPTDSGIAFARNGMHAVEDYIVSRFQMYMQVYFHPASRAMELLLQNLLKRARFLFDTHRDFFEQTSPNLIPFFTDQYDLQDYLALDDGVMNTYFQSWMQADDNILADLANRFINRKVFKSITFEESDKENLVKMKELVSQVGFDPDYYTGVHANFDLPYDVYRPEHSNPRTEIQIIQKNGQLAELSSLSPIVKALTGSNYGDQRFYFPKEMLTLDSLFSSTKEEFQSYITNEHLTLTKDNSHS

SEQ ID NO: 11814 - protein, 277 aa, Listeria monocytogenes str. 4b F2365
MKRPVDFFAMKENGEKITMITAYDYPSAKNVEQAEADMILVGDSLGMVVLGYDSTVPVTMDDMIHHTKAVKRGAPDTFVVTDMPFMTYHGSVDETIQNARKIIQESGAHAVKLEGAGEVVNKIARLTEAGAPVVAHLGLTPQSVGLTGSYKVRAKSAQEAQELMDNALAVEAAGAIALVLEAIPRQLAEKVSKALSIPTIGIGAGVETDGQVLVYHDIIGYGISRRAKFVKAYADIDERIEPALASYVKEVKAATFPEVKHSFTMAEEDLKGLYGRE

SEQ ID NO: 11815 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 11816 - protein, 475 aa, Bacillus halodurans C-125
MFRGKLYIDGTWTGDLLDTFDVKNPATGEVVGVMPNGGKAEAAAAIEAAQRAFLKWRKYTAAERANFLMTWHDLLLQQKEEIAEMLTMEMGKPLAEARGEIEYSASFIRWFAEEGKRVYGRTVPASAENKRIHVQKQPVGVVAAITPWNFPAAMIVRKMAPALAAGCTFVGKPAELTPLTAVKIVELCEEAGFPKGVVNLVCGDAKEIGEEMTSHEHVRKLTFTGSTAVGKLLMKQSAGRMLNLSLELGGQAPMIICDDADLDKAVAGVVASKYRNAGQTCVCGNRIYVQETIVDEFVKRLTGKVVQLKVGNGLEEGVHIGPLIEKKGYEKVKAHVDDAVAKGARVVIGGKGQEGNDSYFYDPTILTDVHDEMLVMQEETFGPVAPIQTFATDEDVIEKANGTRYGLAAYFFTENYARGIRLSEALDFGIVGWNDGAPSIAQAPFGGMKESGLGREGGQEGIEAFLETKFVSIGL

SEQ ID NO: 11817 - protein, 325 aa, Listeria monocytogenes str. 4b F2365
MKNNREKLLALFTESDGTYLSGQEIADSLGCSRTAVWKQMEALRKEGFEIEAVRNRGYRLSATAEQYTKDALLLGLETKFIGQHLEIHESVSSTQIIAHQQIESSPEGTVIVADEQTAGKGRLLRPWSSKKGEGIWMSVILKPQIPIQKVPQFTFIASLAITEAIENSTKLEPKIKWPNDIYIGKRKICGVLTEMQAEAETIHAVIIGMGINVNQQEFPEEIKDKASSLKLELGESVSRKALLQEILTSLEKYYELFLDKGFAPIKLLWETKAIPFGEKLTASTTKGKIHGQVKGISDEGVLLLQDALGEVHSIYSADILLDNEK

SEQ ID NO: 11818 - protein, 531 aa, Archaeoglobus fulgidus DSM 4304
MREKIGFWEAVSIGIGGMIGGGIFAVLGLSVQLAKGSAPIAFLIAGIVALFTAYSYAKLSLRFPSEGGTIEFLIKAYGTGLLAGGLNILLLVSYVVMIALYSYAFGSYAANALGTPILKSFLIAFVVIFFTVLNSLGAVVSGRAEDLLVAFKLAVLVIVAAAGLAFVNPERLMPSNWADAVSIIAGGMIIFLAYEGFELIANAGGDVEHPKVLEKAFYVSVVVVIAVYVLIAIITVGTLPYEKIMEARDYALAIAAEPALGQLGFWFVTFAALASTSSAINATLYGTARASYMVAKFGELPEFVGKKLWRQAYEGLVVIPILSIILSITTNLETIATAGSGGFLLIFAAVNLAAVKLRRKVKVNPLISSAGAIMALAAFTILALRMAEENLYALAVMLSLIAASFLFEWTYRWYTGREIGRYVDRKLIEREKNLRNWEEWIPAVVDELRRRYSDSEVYLVGSLARGEAEKAGDVDLLVLTDAVENGEKEGITRDIKKKLELGPQHCLDLHFEKKSLRDEALKRAVSYRRLK

SEQ ID NO: 11819 - protein, 207 aa, Brassica napus
STHASGNLPGVQKLLLDGNKFEGPIPSEVGKLQQLSKIDFSHNLFSGGIAPEISRCKLLTFVDLSRNELSGEIPKEITGMRILNYLNLSRNHLIGSIPGSISSMQSLTSLDFSYNNLSGLVPGTGQFSYFNYTSFLGNPDLCGPYLGPCKDGGAHQSHSKRPLSASMKLLLVLGLLVCSIAFAVAAIIKARSLKKASESRAWKLTAF

SEQ ID NO: 11820 - protein, 323 aa, Archaeoglobus fulgidus DSM 4304
MVKVVSFSPIAEPLLKGLIGSVYSGEVEVVVIGEYDERRILEAVRDADIVIGDYTFKIPITEEMMRAMEKVKLIQQPSTGYNNIDVEAAKKLSITVANVGGVNALSVAEHTVMFALALLRRLIYAHNSVLSGRWEQDEMANLGVYELHGKTWGIIGMGAQGREVTKRLQGWGVKIIYHDVRRAEDIEEYGVEFRDFDALLREADIVSLHVPLTEETRGMIGERELKMMKNSAILINVARGEVVDENALVRAIKERWIAGAALDVFAKEPPEGSELLELKSHNVIFTPHIAGATNEARLRIIREAMENIGRALRGEEVKHVVSR

SEQ ID NO: 11821 - protein, 291 aa, Streptomyces coelicolor A3(2)
MTPRDSSDSPDSPRNRWSDLDRPPLSSTALRRGLVRDGGLWRQVDVVQRTGSTNSDLVARAAEGDLAEGVVLVAEEQSAARGRLDRQWTAPARSGLFFSVLLRPAEIPVARWGWLPLLTGVAVATGLSRVAGVDTALKWPNDLLVTVGDEERKAGGILAERAGDDGVVIGVGINVSLRADELPVPRAGSLALAGAVNTDRDPLMRGVLRSLEDWYGRWRGAGGDPAASGLQETYAAGCATLGRMVRAELPGDRSLVGEAVAVDGDGRLVLATGAGVQEPVGAGDIVHLRLA

SEQ ID NO: 11822 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQKVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 11823 - protein, 220 aa, Triticum aestivum
MFNRLFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRTGAKAMKAMQKATNIDDVDKTMDEINEQTENMKQIQDALSAPLGASADFDEDELEAELEELEGAELESQLLEPVVTIPIHTTPVPGKAQPTRPAPQKASAEEDELAALQAEMAL

SEQ ID NO: 11824 - protein, 573 aa, Pimelobacter sp.
MSIAESTVLGEEPEWFRTAVFYEVLVRSFRDPNAGGTGDFRGLAEKLDYLQWLGVDCLWVPPFFSSPLRDGGYDVADYTGILPEIGTVEDFHAFLDGAHERGIRVIIDFVMNHTSDAHPWFQASRSDPDGPYGDFYVWSDTDELYQDARVIFVDTEPSNWTWDQTRGQYYWHRFFHHQPDLNFDNPKVQDAMLEAMAFWLDMGLDGFRLDAVPYLYERPGTNGENLPETHEMLKRVRRFVDDNYPDRVLLYEANQWPTDVVEYFGPEEREDGTVVGPESHMAFHFPVMPRIFMAVRRESRFPISEIMEQTPAIPEGCQWGIFLRNHDELTLEMVTDEDRDYMWGEYAKDPRMKANIGIRRRLAPLLDNDTNQIELFTALLLSLPGSPVLYYGDEIGMGDNIWLGDRDGVRTPMQRTPDRNVGFSAATPGKLHLPTIQDPVYGYQSVNVEAQLENPSSLLHWTRRMIHIRRQRDAFGLGTFEDLGGSNPAVLSYVRELPGDGGDDVILCVNNLSRFPQPVELDLRKYEGRVPVELIGGVPFPAVGELPYLLTLSGHGFYWFRLTDPDTTGRPVL

SEQ ID NO: 11825 - protein, 473 aa, Vibrio angustum S14
MATVITEERSNGTLSLEKSDLNKNVFIACIIAALAGLLFGLDIGVISGALPFIAKEFGLATHTQEWVVSSMMFGAAFGAIGSGPLSNKFGRKYSLVVASILFTVGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQIMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNAQTFWLYAVLNIIFLFVTLILIPETKGISLEKIEQNLMAGIPLSKLGKK

SEQ ID NO: 11826 - protein, 326 aa, Bacillus cereus ATCC 10987
MQSTIRKQLLQVFSEADGEFVSGQTISDKLGCSRTAVWKHMEDLRNEGYELEAVRRLGYRIASKPDKVTANEIQLGLQTKHIGRTVYFEESVESTQYIAAKLAYEGAEEGTIVVAEEQTAGKGRLSRKWHSPKGTGIWMSIILRPSIPVHHAPQLTLLAAVSVAQAIEKCTGVNVGIKWPNDILIQGKKAVGILTEMQADPDKINAVIMGIGINANQKQEHFDEEIQHIATSLAIESGKPIVRAELMQQIFLQLEKLYEEYLQNGFSVIKILWESYAVSIGKEINARTMRETITGIAKGITEDGVLLLEDHEGKVHHIHSADIEIK

SEQ ID NO: 11827 - protein, 88 aa, Glycine max
  misc_feature (27)..(27): Xaa can be any naturally occurring amino acid
  unsure (1)..(88): unsure at all Xaa locations
MAEQTFIMMEPDGVQRGLIGEIISRLXKKGFYLKGLKLDTVYRPFAEKHYADLSAKPFFSGLDDYIIFGPVVAIIWEGMNFFQLTKIL

SEQ ID NO: 11828 - protein, 488 aa, Vibrio cholerae O1 biovar eltor str. N16961
MRSLAMLPTDFPFFHQSAFINGQWILGEPQARQTVTNPFDGSLIGSVPLLSAAQVQEAIAGAQAAQILWCQQPAENKAKILRRWYELIEQHHESLAKLLTIEQGKPLAEARGEIHYAASFVEWYAEEAKRAYGELIPSHKPDARIMVSRQPVGVVAAITPWNFPAAMITRKCAPAFAAGCAVVLKPAPDTPFTALALADLAQQAGIPDGLLQVVTGDAIEIGRVLTESKTVRKLSFTGSTGVGKLLMAQSANNVKKLSLELGGNAPFIVFEDADINAAIDGVMVAKFRNAGQTCVCANRIYVHDAVYDQFAAKLVDRVSRLNVGYGLDAGVNIGPLINDAAVAKVTSHIVDAQSKGAKVMFGALPEAGSRLFQPHVLTEVTDEMRVADEETFGPLAALFRFSSEQEVIERANATDSGLAAYCYTQSLRRAWHMSEALEAGIVGINEGLISTTLAPFGGIKESGLGREGAKHGLEEYLEVKYTLMGGLA

SEQ ID NO: 11829 - protein, 522 aa, Triticum aestivum
  misc_feature (144)..(144): Xaa can be any naturally occurring amino acid
  misc_feature (211)..(211): Xaa can be any naturally occurring amino acid
  unsure (1)..(522): unsure at all Xaa locations
MRRAAALGARHILAASVSASSRVASRRHMGSVDAGAAMEKIRAAGLLRTRGLIGGKWVDAYDGKTIEVQNPATGEVLANVACMGNRETADAITSANTTFYTWSKLTASERSKALRKWHDLLMSHKEELALLMTLEQGKPMKEAXGEVNYGASFIEFFAEEAKRVYGDIIPPTLADRRLLVLKQPIGVVGAITPWNFPLAMITRKVGPALGXGCTVVVKPSEFTPLTALAAADLALQAGIPAGALNVVMGNAPEIGDELMQSMQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVQKVEKFVGDATSKGANIMLGGKRHSLGMSFYEPTVVGNVSNDMLLFSEEVFGPVAPLIPFKTEEEAIHLANDTNAGLAAYMFTKNIARSWRVSEALEYGLVGVNEGLISTEVAPFGGVKQSGLGREGSKYGMDDYLEIKYVCMGNLG

SEQ ID NO: 11830 - protein, 588 aa, Aspergillus oryzae
MYNTHRGMVPAPNSRLTELLDQLRQEFENQSRSTGEFEHQLTGQLQEMEMIRQKVYQLEQAQIKMKQDYEAEIRVLRHELESRGVQPVSSHIAGPAQHAGPSQAPPPALGHGPSNLFGGIMANQGGSGPGLAPPPPQDQQPPQHTLQQPAPAAQQGAPQPPQSSFGGYQPGAAVNGYAPPPPPTASPGPGKRPRAPPGPATPQQTHQLAYPDPRVSPQLARPTPPSQALVRDRPGNMLANWNPDDLPASQKREGADWYAVFNPEVQRVLDVELVHHLVHDSVVCCVRFSRDGKYLATGCNRSAQIFDVTTGQNVATLQDENVDKNGDLYIRSVCFSPDGKFLATGAEDKQIRVWDIAARTIKHIFTGHEQDIYSLDFAGNGRYIASGSGDKTVRLWDILDGKLVYTLSIEDGVTTVAMSPDGHYVAAGSLDKSVRVWDTTTGYLVERLESPDGHKDSVYSVAFAPNGRDLVSGSLDKTIKLWELNVPRGAFPGTGVKGGKCIRTFEGHKDFVLSVCLTPDGHWVMSGSKDRGVQFWDPITGNAQMMLQGHKNSVISVAPSPTNNLFATGSGDMRARIWRYVLLFNSQP

SEQ ID NO: 11831 - protein, 395 aa, Bacillus cereus ATCC 10987
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGAEYTSVAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDDWAKALLEEEKVALVPGTGFGAPNNVRLSYATSLEQVEKALERIHTFMKSKVQA

SEQ ID NO: 11832 - protein, 263 aa, Neisseria meningitidis Z2491
MNVYFLGGGNMAAAVAGGLVKQGGYRIHIANRGAEKRERLGKELGVETSATLPELHSDDVLILAVKPQDMEAACKNIRTNGALVLSVAAGLSVDTLSRYLGGTRRIVRVMPNTPGKIGLGVSGMFAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 11833 - protein, 297 aa, Acinetobacter sp. ADP1
MIEPKLKIETAQTNPMSIEKNIPDLILHDGHSIPALGFGTYTLKGQQGVDTMLRALGHGYRMLDSAFNYENEGAVGAAVRQSGLLRDEIFITSKLPGRHHAYDKAMETIEESLYRMQFDYLDLYLIHWPNPQQGLYIEAWQALIDAQKKGYIRSIGVSNFLPKHIETLRRETGVIPVINQVELHPYFNQAEQRAYDESQQIITMAWSPLGRAKAILDDAVLKQIAQETSRTVVQVVLRWQVQMGVIPIPKAASDQNQMANQAIFDFSLSDDQVQRINALTCADGRIRNQDPAVYEEF

SEQ ID NO: 11834 - protein, 295 aa, Listeria monocytogenes str. 1/2a F6854
MSKDIATPGRTTEILKKYGFLFKKSLGQNFLIDSNILTRITDTAEITKETNVIEIGPGIGALTEQLAKTANEVVAFEIDQRLLPILDDTLSAYNNVKVVHGDVLKADVEEVIAEQFAKPELPLKIVANLPYYVTTPIILKLLHDNIPADSMTFMLQKEVADRISAVPSTKSYGSLTIAIQFYMEAELAFIVPKTVFMPQPNVDSAVIHLKRRKEPLAEVNDEEFFFEVTRASFAQRRKTLWNNLASKFPALKPRKDELVEGLNAIGIDLIRRGETLDIPEFAKLSNFLGDFLKEK

SEQ ID NO: 11835 - protein, 433 aa, Synechocystis sp. PCC 6803
MVNATPFITTKSEEIFAAAQHLMPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 11836 - protein, 426 aa, Methanocaldococcus jannaschii
MALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 11837 - protein, 260 aa, Buchnera aphidicola str. Bp (Baizongia pistaciae)
MVKKNTFFANKNLGQNFLVDSEVINRIINVINPKSHDFMIEIGPGLGALTYPICKILHKLFVIEHDNNLGTRLLKDISNIEVFVEDVLKFNFLNLINNSFKSVRIIGNLPYNISIPILFYLFKFHNNIIDMNFMFQKEVASKLLAIPGTKSYSRLSIIAQYYCDIDFLFDVVAQSFYPIPKVTSSFVRLVPRKVFNLYVRDINQLSNVTALAFQQRRKIVKNSLSSLFNDDALRKLGIDPLLRAENLSVKQYCLLSNHVC

SEQ ID NO: 11838 - protein, 264 aa, Photobacterium profundum SS9
MKKITINDLMTWKHEGRKFASITAYDASFAQLFEQQEVPVLLVGDSLGMVLQGKPDTLPVSVSDIAYHTRCVRAGSPNTLLMADMPFMSYSTPEQACESAAELMRAGANMVKLEGGAWLAETITKLTERAVPVCAHLGLTPQSVNIFGGYKVQGRDSDHAAQMVKDAILLKNAGAQIILLECVPASLAERITKAVEVPVIGIGAGNVTDGQILVMHDMFGISANYMPRFSKNYLAETGDMRTAVSKYLEEVEAGTFPGPQHTFE

SEQ ID NO: 11839 - protein, 190 aa, Wolbachia endosymbiont of Drosophila simulans
MVQATYASMSLPGISSVEDVLEDARSGKLFILVDDENRENEGDLIVLAEKIKPEHMAFMVRYGTGVVCLAMTKFHMKRLGLNFMEKKNIGENHTAFTTSIDARYGITTGVSAEDRTKTIHAAINKDGTQDDIITPGHVFPVIAHKGGVAQRAGHTEASVEMAKLVGFDHSAVICELVNDDGSMMRLLSVT

SEQ ID NO: 11840 - protein, 397 aa, Streptococcus agalactiae NEM316
MTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 11841 - protein, 177 aa, Zea mays
MVLTSNISVQKTLYEVLSVSEDATYDEIRAAYRSAALNTHPDKAQTTLESSSVPSTEQQEFSSVQKAWEVLRHPTSRADYDKQLQSSRQSIEIIASEIQVGDMIVESAAGALELLYPCRCGDYFSITSGELSGMGIVVTGDGEEVEGLQASDSGSASVVLGCGSCSLKIRLVIDGTS

SEQ ID NO: 11842 - protein, 532 aa, Crocosphaera watsonii WH 8501
MAQAPVSPVVLVILDGWGYRPTEEDNAVVMANTPVMDCLWTTYPRTLIKTSGKEVGLPQGQMGNSEVGHLNLGAGRIVPQELVRISDAVEEGAIYENKALVSLCEEVASRKGKLHLIGLCSEGGVHSHLDHLFGLLNLAQKQNLQDVCVHAITDGRDTNTTDGVKAIARIEDHIEKLGIGRIATVSGRYYAMDRDRRWDRVKLAYDVITQDGDGDGRSALELLKDFYSQDKTDEFIPPTRIAPGAIEAGDGVIFFNFRPDRARQLCSALTVPNFDGFERELITPLSFVTFTQYDPKLPVKVAFEPQNLNNILGEVVAREGLKQFRVAETEKYPHVTYFFNGGLEEPLEGEDRELIQSPMVATYDLSPAMSAEAVTKAACNAVDKAVYSLVVINYANPDMVGHTGNTEAAIEAIETVDNCLGKLLSSVSKLGGTVIITADHGNAETMKDENGNPWTAHTTNPVPLIFVEGEQRKIPGHGGLVELRDDGKLADIAPTILQILQLDKPSEMTGESLIKPAEIEIRANRTPVRIGR

SEQ ID NO: 11843 - protein, 467 aa, Xanthobacter autotrophicus Py2
MAKRSKGAQKIPVTAPRGVNSLAEAKAWMASRGITEIECTVPDLAGVARGKIMPASKFFSSPVMNLPLSVFFQTISGEYPDYEGLVDSVVADSDLVMEPDLATLCSVPWAQDPTAQVIHDAFHRDGRPVELAPRQVLRHVISLYEKKGWKPVVAPEIEFYLVEPNTDPDYPLKPPVGRSGRPEIGRQSYSIQAVNEFDALFEDIYDYSEAQGLEIDTLIHEDGAAQMEINLRHGDPLTLADQVFLFKRTIREAALAHKIYATFMAKPIANEPGSAMHIHQSVISAQTGKNIFSDEDGDPTPEFFSFIAGHQKYLPSVMCIMAPYVNSYRRLTRDSMAPINLQWGYDNRTAGLRVPPSTPEARRLENRVPSSDANPYLVIAASLACGYLGLTENLRATDPLEGDAKNLDFDLPRGLLEAVAAFSDSEPLAEVLGHRFVAAYAAVKQAEFETFMRVISPWEREYLLLNV

SEQ ID NO: 11844 - protein, 445 aa, Bordetella parapertussis
MTRAAESGMAQARGLSVLDAVAVLVGVVIGIGIFGFPPLVAQHAQSESVYLALWLGGAAVMLMGALCYAELGSAYPGAGGEYLYLRHAWGPRVALLFAWARCTVIQTGAIAVVAFIYGEYAQELAPLGTHGVALHAAIAVIALTLLNIMGTQPSKRIQLVFTVLTLAALAAVVATGLSAPPAPPAPVEPLAGSTLGLLGMGLVFVLLTYGGWNEAAYLSGELREARRNMAKVLLIGTAVVAGAYLLTNLALLQIFGLQGLRETRAVAATLMALAAGPYAAIVLSLLVCVTALSTINGTILTGARVYSALGQDVPRLRPLAGWSMRGQTPTSALLAQGAITLVLLGYGAYAHDGVQTLVAYTAPVFWLFMLLVAASVWRLRRLDPHRPRPFRVPLYPLPPLLLGLTCAGLVWSSARYAGVGALLGLAVLAAGLPALRLLRAAPRSA

SEQ ID NO: 11845 - protein, 380 aa, Coccidioides immitis RS
MADTVGKTITCKAAVAWEAAKPLSIEDIEVAPPKAHEVRIQIYYTGVCHTDAYTLSGKDPEGAFPVVLGHEGAGIVESVGEGVTSVKPGDHVVALYTPECRECKFCKSGKTNLCGKIRATQGKGVMPDGTSRFKCRGKDLLHFMGTSTFSQYTVVADISVVAVTDKAPMDRTCLLGCGITTGYGAAVVTAKVEEGSTVAVFGAGCVGLSVIQGAVKNKAGKIIVVDVNDSKESWSRKFGATDFVNPTKLGNKSIQEHLIEMTDGGCDYTFDCTGNVGVMRAALEACHKGWGQSIVIGVAAAGQEISTRPFQLVTGRVWKGCAFGGIKGRSQLPDLVDDYLKGDLKVDEFITHREPLANINAAFEQMKAGDCIRCVVDTRT

SEQ ID NO: 11846 - protein, 472 aa, Shewanella sp. MR-4
MKNILPVIMAGGSGTRLWPLSRGNFPKQFLSLSGNATMLQNTISRLNGIEHAPAMLICNEEHRFIAAEQVRLLGVKHNGILLEPVGRNTAPAIALAAFKAVELGQDPLLLVLAADHVIEDVAAFQQSVSKAAELAATGKLVTFGIVGDKPETGYGYIKRGDACQHGYVVDCFVEKPNLATAEVYVSSGDYYWNSGMFLFKASRYLDELRVYRPDIYAACELAMQVQNNDSDFIRIDKAAFEACPDDSIDYAVMEQTKDAVVVPMDAGWSDVGGFAALWEVSGKDADGNVFNGDVKAVDTKNTLVFGGNKLITTVGVEDLVIVNTKDAVLVAHKDQSQHVKAIVGQLKAEQRSEVTFHREVYRPWGKYDSIDNGDRFQVKRITVKPGAKLSVQMHHHRAEHWIVVSGTAKVTNGDKDILLTENQSTYIPVGVIHALENPGKVDLELIEVQSGSYLGEDDIVRFEDRYGRVEGK

SEQ ID NO: 11847 - protein, 205 aa, Glycine max
MTYLQHKGPPHPPPPLLPLHLLQIPVLKMTAKWYLIVCVVAIWAVDLGSSSHHARAPAPAPSVECSNLVLTLSDCLTFVSNGSTVTKPQGTCCSSLKTVLNTAPKCLCEAFNSSAQLGLAINVTKAVTLPAACKLSTPSAANCGLSATPAAAPGPSPTSATATIGTPGGAPSSTPGNAASALIPISAGSSIVCLLVALSLISLSE

SEQ ID NO: 11848 - protein, 272 aa, Debaryomyces hansenii CBS767
MSNVEASKLYEAIIEEVISDSRQDFEDSGIDESTLQDLRKIWCEKLSQSGVSRFTWDDEQTNAYEIDNNQLPQHSEEPTGSVLGDNSLPLGAGSVLELPNMQSDSQLSYNTTGLSSNNNSDIQIPNIDPTPKQEYDDNGTGLMLPRINQADGTFEFTMHTDQATNIMKKLKNNRQGSANKNISQADGNDDDDNDDDDDIFNDSDDINSDLDEGLESEKSDEEDGDQEGQIMLCLYDKVQRVKNKWKSNLKEGVANINGRDYVFQKATGESEW

SEQ ID NO: 11849 - protein, 279 aa, Cryptococcus neoformans var. neoformans JEC21
MASIVSPLSTKDSLLVTQFRAITGTSSAEAAKYIKRYKHIEAAVDAFYNNEPAPRADPAQERKLGEIWEKFKDPSDPKLIKIDGTMELCEELDIDPGTDAVLFCLAADLGSKATGEWEKAPFVAGIASYPGNIDSLPKLKAYLPTLRKKLVSDPEYFKKVYNHAFQLARGGPQSLTRSLPLDTAIDLWTLFFPPAFNHSPSALSHLPDNSPPQFTQPEFDLWIEFMQQKNKAVSKDTWALLVDFARGIDKDFKEYDEDGAWPSMIDDFVEYVREQKRGQ

SEQ ID NO: 11850 - protein, 390 aa, Burkholderia xenovorans LB400
MNAPHDTPTSPTFPSRLPNVGTTIFTVMSALAAEKGAVNLGQGFPDFNCDPRIVDAVANAMREGHNQYPPMAGAAPLRQAISDKIANLYGRRYDATTEITVTAGATQALLTAILCSVHPGDEVVVVEPTYDSYLPSIELAGGKPVFVTLEAPDYAIPFDRLAAAITPKTRLLLINTPHNPTGTVWREQDMRKLEEIVRGTNVLILSDEVYEHMVYDGAPHESVARYPELAQRSFVVSSFGKTYHVTGWKVGYVAAPAALTVEFRKVHQFNVFTVNTPMQIGLADYMKDPAPYLDLPAFYQKKRDFFRAGLANSRFRLLPCTGTYFQCVDYSAISDLPEAEFAQWLTGEIGVAAIPVSAFYHEAHESGVVRFCFAKQESTLATALERLARL

SEQ ID NO: 11851 - protein, 147 aa, Arabidopsis thaliana
MGLQGQLSDVSSDSIPLMLLALLATFFRHVRSLLLFPSSAPVVVVTSNLSVLADQLNLNRLFSYRYSDNAASDCIVCLSKLKTGEEVRKLDCRHVFHKQCLEGWLQHLNFNCPLCRSPLLPHHHQGHGSDASISAFPLRSTSTASSH

SEQ ID NO: 11852 - protein, 438 aa, Cryptococcus neoformans var. neoformans JEC21
MSTRQDKSTTERHAKILRELVKQPGNKNCADCKRNDTRWASWNLGVFLCIRCSGIHRSMGTHISKVKSIDLDIWTPEQMESIQKWGNKRANMYWERHLKAGHIPSDHKIESFIRSKYETRRWAMDGPPPPDPSVLENESTGGVVSPPPHQTKSPAPIPSSTSSSAAPPVPAHLPKTHPLLSRSIASSKATPSKPTSAVQAPIIDLFADDPAPAPAAVPAASSRAPAPIATAPAPAQPAPSSASNIFDLDFRTPSAPPLSNSPPASGPISNKSQSAKADIMSLFSSPSPSAIQSQQPNLTGGFFNATPSGVQATSPYASWQGGITSAVPSDGTQLGIPVGNKWSGLQMDQNAWGAPQHAQATQKTQPTQAYAQPQQQQSVNNIVSDPWTQAKTSMASPSDPWASTSSGDAGMGGGFFGMNQAQPKKEKDERDPFANIWA

SEQ ID NO: 11853 - protein, 89 aa, Synechococcus sp. WH 7805
MIRVTSPCPDSVIVALGVHDWPVWASEVSEFPWHYDQRETCLLLEGDVTVTPDSGESVHIKAGDLVEFPAGLRCTWTVHQPVRKHYQFG

SEQ ID NO: 11854 - protein, 377 aa, Bacillus cereus G9241
MKAVTYQGPNKVQVKQVDDAKLEKKDDIIIKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEIFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 11855 - protein, 671 aa, Methanosarcina mazei Go1
MDLSVLAHVDVILGFAILILTIFSKFEVPPVLGFLVTGVLIGPHGLGIMDSGQNMEINAELGVIFLLFTIGVDLSLKDLWNMKKAVLVGGALQILFTTGIVLAVCTNLGFSHSASLFTGLLISLSSTAIVLKVLQDRNEVYTPHGKTSLAILIFQDLAIVPLILITPILAGSSVSFEGALPNIFFKGSLIILTFILSAKFVVPAIFYHVGKTGSKQLFFVSVVFICLSAAVFTYSIGLSLALGAFLAGIVISGSQYSQQAIGNIMPLKDMFMSFFFVSVGMLLDLHYLLDNLSVIILATISLIIIKLIAGSLVTFLLGCPLRTTILTGLALSQVGEFSFVLSRLGLEYSLLEEETYQTFLAVSILTMGVTPFLINASYRPADFIVKKVSDTTHGMKLINGIYSEPLYNEEMTEPQIKDHLIIVGFGFSGKTISKAAKAAGIPYLIIEMNPEIVQHEKAKGEKIQYGDATFGAVLEHAGIKNARVLVTGIADSSSTGKIVEKAKELNPNICVIVKVHDLQEMKRLNSMGADEIIPEEYETSVEIFVRLLEKYLVPRENIEKMVNDLRANGYRRLRKLVVEPGIDSGFSIKDGLPGIDIQVLKVGEGSSFQEKTLSELDFRRRHGVTIISVRRGTDMFHTPAGDFLLHAKDACVLLGKTEDLYNVRKFFESIQ

SEQ ID NO: 11856 - protein, 525 aa, Bacillus licheniformis ATCC 14580
MFRVLVSDKMSSDGLKPLMEADFIEIVEKNVAEAEDELHTFDALLVRSATKVTEELFKKMTSLKIVARAGVGVDNIDIDEATKHGVIVVNAPNGNTISTAEHTFAMFSALMRHIPQANISVKSREWNRSAYVGSELYGKTLGIIGMGRIGSEIASRAKAFGMTVHVFDPFLTQERASKLGVNANSFEEVLACADIITVHTPLTKETKGLLNKETIAKTKKGVRLVNCARGGIIDEAALLEALESGHVAGAALDVFEVEPPVDSKLIDHPLVVATPHLGASTKEAQLNVAAQVSEEVLQYAQGNPVMSAINLPAMTKDSFEKIQPYHQFANTIGNLVSQCMNEPVQDVAIQYEGSIAKLETSFITKSLLAGFLKPRVAATVNEVNAGTVAKERGISFSEKISSNESGYENCISVTVTGDVTTFSLRATYIPHFGGRIVALNGFDIDFYPAGHLVYIHHQDKPGAIGHVGRILGDHDINIATMQVGRKEKGGEAIMMLSFDRHLEDDILAELKNIPDIVSVKAIDLP

SEQ ID NO: 11857 - protein, 150 aa, Pisum sativum
MDASTKTKKGAGGRKGGGPRKKSVTRSVRAGLQFPVGRVGRFLKKGRYAQRVGTGAPVYLAAVLEYLAAEVLELAGNAARDNKKNRISPRHLLLAVRNDEELGKLLAGVTIAYGGVLPNINPVLLPKRKENAAASTPKSPSKAKKSPKKA

SEQ ID NO: 11858 - protein, 138 aa, Microbacterium arborescens
MPTEETLVLVKPDGVARGLTGAILARIEAKGYALVDIRLVEADRELLERHYAEHAGKPFYEPLLEFMQSGPSVAIRLAGNRVIEGFRSLAGTTDPTTAAPGTIRGDFGRDWGLAVQQNLVHGSDSPESAARELQIWFG

SEQ ID NO: 11859 - protein, 482 aa, Bacteroides fragilis YCH46
MNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICMIAALFVWRWVPETKGKTLEDMSKLWKKR

SEQ ID NO: 11860 - protein, 182 aa, Triticum aestivum
  misc_feature (21)..(21): Xaa can be any naturally occurring amino acid
  misc_feature (27)..(27): Xaa can be any naturally occurring amino acid
  misc_feature (141)..(141): Xaa can be any naturally occurring amino acid
  misc_feature (163)..(163): Xaa can be any naturally occurring amino acid
  unsure (1)..(182): unsure at all Xaa locations
MSISQGFDDLSKQSAKCYEPXALMVKXRAVLKMEAADTLQLSIAQIGQDVTQYIIMCHENVVVHIVESEIIVYVHHGMDHCAFVHEIVMARCYKVLIDQHVVVEGSLLKYTMVTVCFDSMKVVSEVIVESVERILQWWVLXSVFVMIFLYGGQSEEEEILSLXAMNKLQDKKPWNLSFSIGC

SEQ ID NO: 11861 - protein, 577 aa, Bartonella henselae str. Houston-1
MLHDTPLITTIVAGLCLAFLLGMIASRLRISPLVGYLLAGVIVGPNTGGFRIDSGIINQLAEIGVILLMFGVGLHFSLKDLLSVKAIAIPAAIAQMAFSTFLGSCLGLIMGWGLSSSVVFGLALSTASTVILLRALQERHLIETEKGRIAVGWLIIEDLAMVLILVLIPSLANILGNTKKEAIDPLIQWLDLSIWGIFGLTILKVILFIILMLVIGRRVIPWLLKVSAHSGSRELFRLSVFATALGVAFGAAHLFGVSLSLGAFFAGMVMSESELSHRAAEESLPLRDAFSVLFFVSVGMLFDPGKILSHFFPLLATLFIIIIGKSAGAFFILKAFRYSNATACTISASLAQIGEFSFILAGLSLSLGLLNNDAHDFILGGAILSILVNPLIFIAFDKIKKHLENLPKNSQDTQKIIDIDPKDPDQEFLPMTSKTNHIVIIGYSRIGKCVALSLINRGDPVVIVEESKRLTDKAIADGFEVICGNIIKQDVMNAANMSNAYKVVITMCNTIEVGECIVNIRDMNKDIQIITHTLSDVDTAYLIDLGADIVVTDEEEIANGVIEHITGQRFIKNIAQS

SEQ ID NO: 11862 - protein, 461 aa, Kluyveromyces lactis NRRL Y-1140
MSAAQSGATVEHQQAQTVPVAQPTDMYIQPYLKKLIPELDGLSKLQEAEKRIDIYLSRKKIDLHQNITQWTHSKYTDPANNQFVRVFISNISENQPWQTNDETMELDQASWTLRIEGRLLDNGKADDPNRPKFSSFIESVAIDFKPVEEDQDDETDQEMGDPLLEGTQEPSAKKPKNEQTVFEWHVDPNTPVEFDGVDVSRKGTENVNCTITIQPKGYTGEFLQYSPELSCIVGFSKGTFHEAIYSLYKYILLNSLLTNNDEAGPKDSTNGEKVLVKMDASLAKLVSPERLAAGIVSLKLADLPSLVKDHVKPIPPIRLDYTIRVDQSSTFGDLVFDMEVPKSTSVKGDQKLSKDELLLLNEYNTLSTAIEPQIQELNQKTQLLQLQLNSSAKKYQFFDKLAKDPVPMLQDYMESSSQALKVLSGDAGFNEDTVRRSQFYQDNDSILFENIGVLLSSGRMK

SEQ ID NO: 11863 - protein, 373 aa, Oryza sativa
  misc_feature (157)..(157): Xaa can be any naturally occurring amino acid
  unsure (1)..(373): unsure at all Xaa locations
MEAAALGVPLVQVGAAVAAYGRGAGKGKGKRRVVGAFHAPPGRRRTALVAALPEPLQPLSPAQDGAVAPASTEADGGEEVHGDVASAEISSPSGVLGKTVRVRFVLKRECTFGQSFHLVGDDPALGLWDPSTGLQEFGTRGHDWTVEKDLPANKLIXYKFVLQDLSGKLHWQNGRNTSVQTGETANILVVYEDWGNANSQTVEEEGKVSIGMEEGKLSVGMEEAVVPDDSESRDDIIVADELQVDDNLAVMQNESSFREDDKKSTVGTVTSVQAELMKLHEANQPELIVDEPQIQEALPETADTEPENGGVATCADDRYAESTDDDGVPVGGTDDDGVPVENRWTGAFEHELLWGWKALQQLLMSLGFKMDTS

SEQ ID NO: 11864 - protein, 169 aa, Coccidioides immitis RS
MASASTTKRLLRELAEYRANPNQALLHLGPVTDDDLLRWEAVLKGVPGTPYENGLWSLSIAIPPTYPLSPPKISFTTRICHPNISFSTGEICLSLLTSEHWAPTYTLSSTLAAIHQLLSDPRPESPLNVDVAALLREGDLLGWESLVRYWTGQERWEGHEKGRSGVRVR

SEQ ID NO: 11865 - protein, 210 aa, Chromobacterium violaceum ATCC 12472
MNANTDILSLRVHAALDALRRGLPVIVADDADRENEADLILAADTLTVPEMARMIRDGSGIVCLCLTPERAERLQLPPMAAENGSRYGTAFTVAIEAAQGVTTGVSAADRTTTIRAAIHPDAKPGDLVRPGHVYPIVARAGGVRERRGHTEASVELARLAGFSPAGVLCELMNPDGTMMRGQQVQDYAERHDLPQLSVAELAEWLQREPA

SEQ ID NO: 11866 - protein, 371 aa, Triticum aestivum
  misc_feature (192)..(192): Xaa can be any naturally occurring amino acid
  misc_feature (201)..(201): Xaa can be any naturally occurring amino acid
  misc_feature (214)..(214): Xaa can be any naturally occurring amino acid
  unsure (1)..(371): unsure at all Xaa locations
MPPKKAAASKADVAKKQKVVEDKTFGLKNKNKSKNVQKYVQSLHQSVQPKPDPTKTAAKKKKEEEKAREKELNDLFKVAVSQPKVPVGVDPKSILCEFFKVGQCQKGFKCKFSHDLNVQRKGEKIDIYSDKRDGEEEDTMDDWDQETLEKVIASKNAEYQQNKPTDIVCKHFLDAVEKKQYGWVWVCPNGGXGCPFRHALXPPGFVLKSQMKAXLEEDCKKPPVRGRVGDQRRKVQTTTPMTTELFMEWKRRKAEEKEAGLAALRADRAKNDRMSGRELFMADASVFIDDAEAYEVYERREEPQANQEQGKKSQDEGPSSSTSNGKEADEELDDEDLDDDDDLDLDELNELEASLSRTSIQIREPGEGTSS

SEQ ID NO: 11867 - protein, 131 aa, Glycine max
  misc_feature (102)..(102): Xaa can be any naturally occurring amino acid
  misc_feature (125)..(125): Xaa can be any naturally occurring amino acid
  unsure (1)..(131): unsure at all Xaa locations
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 11868 - protein, 467 aa, Oryza sativa (japonica cultivar-group)
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVMHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQEPKRESMSQCENIIGDGMSSYCFMGLISD

SEQ ID NO: 11869 - protein, 143 aa, Psychrobacter arcticus 273-4
MANERTLSIIKPDAVAGNNIGAIYDRFEKSGLKIVAAKMMQLDDEKAGGFYAEHAERPFYNDLKSFMMSGPVLVSVLEGENAIAKHREIMGATNPKDAAEGTIRADFASSIDENAVHGSDSAESAAREISYFFNEEEVCARTR

SEQ ID NO: 11870 - protein, 177 aa, Haemophilus influenzae
IAAGISTERLNALIPSANAVVRVMPNTPVLVGEGMAGLFAPKNTSENHRTFAQDLLGAVGRTVWVDDETQMHAVTAASGSSPAYFFLMLEAMQQALIKMNIEEKTARELVQQSMLGAAKMVTENPQIALSTLRENVTSKGGTTASALAVFDAQHFNQIIEQAMQACLSRSQEMETLF

SEQ ID NO: 11871 - protein, 450 aa, Oceanicola granulosus HTCC2516
MIPPKPASRPERVSLWRYLRLFRRDILSAQPEKLYRAWMAEFRTPFFRSYLVNDPSLVKRVLQERPDDFPKSDRIGAGLRPLLGQSVFLTNGAQWKRQRRIIDPAFEGGRLRDTYPAMWAAGQAAVARLGPLADGRPVEIEAETSHAAADVIFRTLFSIPIEHALAREVFAEFRTYQRSQPILNLAAFIPARWLPRFFRRETRASAHRIRALIARLTTERGAEIRAGRAPDDLATKIMTTRDPETGETFSDAEMVDQVAIFFLAGHETSASALAWALYLLALYPDWQDKVAAEAAGASDDFASVSRLRITRDVFREALRLYPPVPMMVREARCPETFRDRAVSPGAQVVLSPWHLHRQSRLWERPDEFDPARWASDNGRACAREAYIPFSAGPRVCTGAGFAMIEGVLLLALILRAYRVTPVEDRTPVPVAHLTVRSADGIWLRLAPRQP

SEQ ID NO: 11872 - protein, 440 aa, Anabaena sp.
MSNQGAFDGAANVESGSRVFVYEVVGMRQNEETDQTNYPIRKSGSVFIRVPYNRMNQEMQRITRLGGKIVTIQTVSALQQLNGRTTIATVTDASSEIAKSEGNGKATPVKTDSGAKAFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 11873 - protein, 410 aa, Acinetobacter sp. ADP1
MSQHLSLPKDKIRFLLLEGVHQNAVDTLNAAGYTNIDYRKTALDGDALKEAVKDAHFIGIRSRTQLTEDVFAAANKLIAVGCFCIGTNQVDLKAAMARGIPVFNAPYSNTRSVAELVLAELILLLRRVPEKSAVCHRGGWDKSAVGSYETRGKTLGIVGYGSIGSQLSVLAESLGMHVIYYDTVTKLPMGNARQVGSLDELLATADVVTLHVPDVPSTRNFFKKEQFAKMKEGAIFLNAARGTCVIIEDLADALKSGHLAGAAVDVFPKEPKANGEEFISPLRGLDNVILTPHVGGSTMEAQANIGLEVSEKFVAYSDKGMTLSAVNFPEIALPLTEGKHRLLHIHKNIPGVLSKINNLFAEQNINISGQSLMTKGDIGYLIMDVDASASQEALDMLNQVEGTIRVRVLF

SEQ ID NO: 11874 - protein, 537 aa, Streptococcus pyogenes MGAS8232
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENSNSPERDFYIWRDEPNDLTSIFSGSAWEYDNASGQYYLHLFSKRQPDLNWENEALRHKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAEELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDQEQVFAKDLAGAEVVITNTDVDKVLETKHLQPWDAFCLKLKA

SEQ ID NO: 11875 - protein, 484 aa, Sinorhizobium meliloti 1021
MRLKDRELFRQLGLIGGEWIAGASGVVVDVIDPANQAVLGTVPDMGTAETRAAIEAANAAFGPWKKKTHAERAAVLERWHALMIENLEDLAVLVTMEQGKPLEEARGEIRYGAAFVKWFAEESRRIGGHTIPSPTSDRRIVVLKEAVGVCAIVTPWNFPNAMITRKVAPALAAGCTVVIKPSEFTPFSALALGVLAERAGIPAGVVNIVTGMPTAIGNEFMTNETVRKISFTGSTRVGSLLMRGAADSVKRLSLELGGNAPFIVFDDANLDLAVEGAIASKFRNGGQTCVCANRILVQAGVYDAFAEKLGARVNAMKVGPGTEPGIAIGPMINEAAIDKIDRHVEDAIAKGAKLAARGRSVPEGRQYTAPIVLTGATTDMLLASEETFGPVAPLFRFETEDEAIAIANGTPFGLAAYFYTEGLKRSWRVAEALEFGMIGLNTGAISTEVAPFGGVKQSGLGREGAQVGIEEYLEMKSFHIGGLD

SEQ ID NO: 11876 - protein, 558 aa, Ashbya gossypii ATCC 10895
MADRASSASIEKADNGGYMHKVKTPHSRTSLEELETQSAGSEYNTLHKGLQSRHIQLIALGGCIGTGLFVGTSWTLHNCGAAPLLLSFILISTIVYPIMCSLAEMICYLPQQGSVPELVSRYVDPSLGFATGWNYAYAYAILVAAELSAAASVVSYWDNPVPMAAWITIFLVVVVGLNFTAVKYYGEAEFWFASIKLICILGLLVVSVVIFFGGAPNHDRTGFRYWKNPGPFAMSLAPGSTGRFLDVWRAVIKSAFAFILSPELIGIACVEAQDTRRNTEKASRRFIYRIIFFYVSCALMIGVILSRTDPKLIEALETGAPGAASSPFVQGIANAGIPVLDHVINVAILSSAWSAGNSFMYASTRMVLALAREGNAPKFLTKINRYGVPYNAVIVCTLVACLAYLNVKTTSANVFQWLSNICTISGFIGWFAMGIAFIRFRRGIVFNNLQSRIPYQGPLQPYIAYYFTFMTVVVCLTNGFHVFLKGRWNVVDFVAAYVTLPIYLVLYLGHKLWFRTRWYIPVEQIDVITGLVEAEEESKMTPPRIPKNLWEKFLYWLL

SEQ ID NO: 11877 - protein, 429 aa, Wolbachia endosymbiont of Drosophila simulans
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFKAKRYIDEIKKSAPNLYNLCFKYFTPQERFLYLKQRDFAGIEGISIDYLVMEKAKNVAMIEANFDWLDVGTWNSVLELSEKFSKEPVSFQHVIREKEPVSTTKSNKNLLGGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 11878 - protein, 147 aa, Listeria monocytogenes str. 4b F2365
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAKREIQLFFAPQEILSYQKAIDTWI

SEQ ID NO: 11879 - protein, 565 aa, Schizosaccharomyces pombe
MTVSLNTMMGVDGLEDQEQLREIRNCLLKCISECSERGLVYAVRWAAEMLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 11880 - protein, 288 aa, Ustilago maydis 521
MSSYDTPPKDGREAVERLRATAKSGKPIIGSGAGIGLTAKFVEKGGADLIILYNSGRYRMAGRGSLAGLMPYGDANAIVVEMAAEVLPVISHTPVLAGVCASDPFRSIPKFLQQLKEIGFVGVQNFPTVGLIDGNFRQNLEETGMGYDQEVELMKHAKQLGLLTTPYVFNTEEAVKMANVGVDVIVAHMGLTTSGSIGAQTAMSLDNAVELTCKITAKVHSIAPDTLVLVHGGPVASASDAQYVLDRVPGLAGFYGASSMERLPVEIALQESMNDFKNLQISSSKVIC

SEQ ID NO: 11881 - protein, 466 aa, Bartonella henselae str. Houston-1
MDYKQNSENNPKKKLQRGLHNRHVQLIALGGAIGTGLFMGSGKTISVAGPSIILVYAIIGCALYFVMRAMGELLLSNSRYRSLIDFSTDMLGPGIAFFVGWSYWLSWVVTGAADIIAIITYMHFWWPTLNSWIIVFSCVIFFLTLNLLAVKMFGELEFWFGLIKVLAILALIVVGFYMICTGFTSPNGTVASLSHVWNDGNIFPRGIPGFFAGFQIAIFSFGGIEIAGTTAAEVKEPKKVLPKAINAIPLRIVLFYIFSLVVIMSVTPWDQVVPEKSPFVSMFWLAGIPIAAGLINFVVLTSAASSANSGIFSTSRMIYGLATQKGAPRFFGKLSKYHVPANALFFSCLCILLGYTIASSSPSIISAFTIVSSIPAIAFLFVWSVILVSYIVYRHNHPHLHTESVYKMPGGVITCGIILAFFAFMLYLLTLESDTLTALKYSIFWFIFLGITYFMFIRKKTAQDNK

SEQ ID NO: 11882 - protein, 832 aa, Ashbya gossypii ATCC 10895
MVKDEHKRLLDASGTEPRDEDATATAILKRKKKDNYLLVDDAVKDDNSVIVVNSNTMDLLQLFRGDTVLVKGKMRKDTVLIVLLDDELADGVCRINRVVRNNLRVRLGDLVSIHPCPDIKYAERISVLPIADTIEGLTGNLFDVYLKPYFVEAYRPVRKGDHFIVRGSMRQVEFKVVNVEPEDYAVVAQDTIIHSDGEPINREDEVCNINEVGYDDIGGCRKQMAQIREMVELPLRHPQLFKAIGIKPPKGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKSRSNVVVIAATNRPNSIDPALRRFGRFDREVDIGIPDATGRLEILNIHTKNMRLADDVDLEVLAAETHGYVGADIASLCSEAAMQQIREKMSLIDLDEDEIDAEVLDSLGVTMDNFRFALGNSNPSALRETVVESVNVTWDDVGGLDDIKRELKETVEYPVLHPDQYIKFGLSPSKGVLFYGPPGTGKTLLAKAVATEVSANFISVKGPELLSMWYGESESNIRDIFDKARAAAPTVVFLDELDSIAKARGGSMGDAGGASDRVVNQLLTEMDGMNAKKNVFVIGATNRPDQIDPAILRPGRLDQLIYVPLPDEAGRMSILKAQLRKAPLEPGLDLGAIAKATQGFSGADLSYIVQRAAKFAIRDSIEAQKRAEAERADKPKTEDVEMSDANVASEEEVDAVPFITREHFADAMKTAKRSVSDAELRRYEAYAQQMKASRGQFGNFSFGSEARSDSGAGAAPAGTESSGAAAFNNAADEDDDLYS

SEQ ID NO: 11883 - protein, 271 aa, Azoarcus sp. EbN1
MSYLQDDKPVTLFEIGKMRAEGRKISMLTCYDASFASLLERAGVDILLVGDSLGNVVQGQKSTLPVTLEHMIYHTECVVRGSTRPFIVTDMPFGAYHESPSQAMHNAASLLAAGAQMVKLEGGTFMAETVRFLVERGIPVCAHIGLTPQSVHQLGGYRVQGRSEAAAAQLKGDALALEQAGAALMVMEMVPAALAREVTASLASMATIGIGAGPDCDGQVLVLHDMIGVYPGKKARFVRNFMTGKTDIDEAVASYVQAVRDGSFPAAEHCY

SEQ ID NO: 11884 - protein, 117 aa, Flaveria trinervia
DESWCQGLDGLASRSAAYYQQGARFAKWRTVVSIPNGPSALAVKEAAWGLARYAAISQDNGLVPIVEPEILLDGEHGIDRTFEVAKKVWAEVFFYLAENNVMFEGILLKPSMVTPGA

SEQ ID NO: 11885 - protein, 272 aa, Bacillus anthracis str. 'Ames Ancestor'
MDKQIGFIGCGNMGMAIIGGMLNKKIVSSNKIMCSDLNTTNLENASEKYGISITTDNNEVAKNADILILSIKPDLYASVINEIKEEIKSDVIVVTIAAGKSVKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 11886 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 11887 - protein, 130 aa, Pimpinella brachycarpa
GTRESKVFYLKMKGDYHRYMAEFKVGDERKNAAEDTMNSYKAAQDIALADLAPTHPIRLGLALNFSVFYYEILNSSDKACSMAKQAFEEAIAELDTLGEESYKDSTLIMQLLRDNLTLWTSDSQDQLDEP

SEQ ID NO: 11888 - protein, 272 aa, Bacillus cereus G9241
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNMFNIFGQTEVVNEKLMDVVTSISGSSPAYVYMFIEAMADAAVLGGMPRKQAYKFAAQAVLGSAKMVLETGIHPGELKDMVCSPGGTTIEAVVTLEEKGLRTAIISAMKRCMQKSMEMSSLTSK

SEQ ID NO: 11889 - protein, 426 aa, Magnetospirillum magnetotacticum MS-1
MILLMFGVGLHFSIGDLLTVRAIALPGAIVQIGVATAMGAGLAWAFGWGAGAGLVFGLALSVASTVVLLRALEGQGLLDTDKGRIAVGWLIVEDLAMVVALVLLPALAPSLGGEAMSGSAQHGASAGLWVTLGLTLAKVSVFVAVMLVGGRRLVPYLLGLAARTGSRELFTLAVLASAVGIAFASSELFGVSFALGAFFAGMVLAESDLSHQAAADSLPLQDAFAVLFFVSVGMLFDPGIVLRAPLSILGVVGVIVLGKSLAAVAIVLAFGHPVGTALTIAASLAQIGEFSFILAGLGIALKLLPEEGRDLILGGALLSITLNPLFFVLSDRVSRWLGERPELRRRLERRSPAPPPLNNAAQGLRDHTVIIGYGRVGSAIGQALQDWNLPFVVVERDRRRVEDLRAQGVPAVFGDATAPGILDADD

SEQ ID NO: 11890 - protein, 833 aa, Thiomicrospira crunogena XCL-2
MAQNKKPVSDTKQEKHIAELLKKMGMSVTDIEQDFVNYLYNMLGRDIHSDSYDQFKAMSYTIRDRLMTHWKETWNAYNEDKTKKAYYLSMEFLIGRSLSNNLLNLGIETETEKAMYRLGASLEAIEEAERDAGLGNGGLGRLAACFMDSCATLQLPVIGYGLRYEYGMFKQLIQNGFQIEEPDHWLGFGYYPWEIQRSEYTRTVYFGGRSRHYKDPHTGELTVHWEDAEEVLAVPFDVPIPGFENKTVNTLRLWSAEAAEGFNLSEFNQGSYFEAVASKSEAENITMVLYPNDSSENGKELRLRQQYFLVSASLQDVVSQWSEKYGNDFTDFAEYNVFQLNDTHPSLAVAELMRILIDDKKLSWDDAWSIVSQSMAYTNHTLLPEALERWSVSLFKKLLPRVLEIIYEINARFLKLVAMKWPGDQARQARMSIIDPDDNVCMAYLAIVGSFSVNGVAALHSQLLKEGLFHDFYELWPDRFNNKTNGVTQRRWMASSNPGLKALLNEKIGRHWITDLTQLSKIESFVNDKPFRQEWMRVKRENKQRLADMVEKDTGVKFDVTSLFDVQVKRIHEYKRQLLNVLHVIHLYARIKRGDTDNWTNRCVIIGGKAAPGYVMAKKIIKLINNVAEVVNSDPDVGDKLKLAFIPNYRVSAMEIISPGADLSEQISTAGKEASGTGNMKFMMNGAITIGTLDGANVEILDAVGEENFFLFGLKTPEVAKLRDHYYPENFIEEDSDLQAVFSLLESGHFNQFEPGLFDDIISSVKSPKDPWMTLADFRSYVNAQHEVALAFQNHSRWNTMSIINSARSGIFSTDRTMQEYNDDIWKLTPINK

SEQ ID NO: 11891 - protein, 238 aa, Streptococcus pyogenes
  misc_feature (228)..(228): Xaa can be any naturally occurring amino acid
  unsure (1)..(238): unsure at all Xaa locations
MKQKNPKNTQNFITSKKHVKEILKYTNINKQDKIIEIGSGKGHFTKELVEMSQRVNAIEIDEGLCHATKKAVESFQNIKVIHEDILKFSFPKNTDYKIFGNIPYNISTDIVKKIAFDSQAKYSYLIVERGFAKRLQNTQRALGLLLMVEMDIKILKKVPRAYFHPKPNVDSVLIVLERHKPFILKKDYKKYRFFVYKWVNREYHVLFTKNQLRQVLKHANVTDLDKLXNEQFLSVFNS

SEQ ID NO: 11892 - protein, 470 aa, Kluyveromyces lactis NRRL Y-1140
MAFGQQINNLQDSFEAALNLSSSPGAVSTSPTQSFMNTLPHRINAAKQQKALKPFSTGDIKILLLENVNQTAIEIFNKQGYQVEFHKSSLPEAELIEKIKDVHAIGIRSKTKLTPEILKHAKNLVVIGCFCIGTNQVDLDFAAKHGIAVFNSPFSNSRSVAELVIAEIITLARQLGDRSIELHTGTWNKVSAACWEVRGKTLGIIGYGHIGSQLSVLAEALGMNVLYYDIVTIMSLGTAKQVSTLNELLNNSDFVTCHVPATPETKNLLSGPQFAAMKDGSYVINASRGTVVDIPALIQAMRAGKIAGAALDVYPNEPAKNGAGAFSDNLNTWTTDLVSLPNVILTPHIGGSTEEAQSSIGIEVATALTKYINEGNTVGAVNFPEVSLRALDLDQENTVRVLYIHQNVPGVLKTVNNILSNHNIEKQFSDSNGDIAYLMADISNVNQSDIKQIYDELNETDYKISIRLLY

SEQ ID NO: 11893 - protein, 695 aa, Coccidioides immitis RS
MAQVDSLDLVVLTVLLVGSVAYFTKGTYWGVPKAAAAASYGSANGMPKEGKTRNIIEKMDETGKNCVVFFGSQTGTAEDYASRLAKEGAQRFGLKTMVADLEDYDFENLDQFPEDKVAFFVLATYGEGEPTDNAVDFYQFMTGEDVSFEGGASAEEKPLSSLRYVTFGLGNNTYEHYNAMVRQVDAALTKLGAKRIGTAGEGDDGSGTMEEDYLAWKEPMWKALSEEMGLEEREAVYEPTFCITEEPTMSPTSENVYVGEPNQNHLEGNLGGSHNAHNPFIAPITESRELFTVKDRNCLHLDIGIQGSTLNYQTGDHLAVWPTNAGKEVDRFLQVFGLEDKRHTVVKIKPIDVTAKVPFPTPTTYDAAVRYYMEICGPVSRQFIATLAQFAPDEDTKSKMKRLGEDKDHFHSQISTQFYNIAQALQSITSKPFTSVPFSLLIEGISKLQPRYYSISSSSMVQKDRISITTVVESIRVPGAGHVMKGVTTNYLLALKQKQHGDTNPDPHGLTYEITGPRNKYDGIHVPVHVRHSNFKLPSDPSKPIIMVGPGTGVAPFRGFIQERVAQAERGDKVGPTVLFFGCRNRDEDFLYKDEWEAVSEKLGDNFKLFTAFSRESEKKVYVQHRLRENAVLVNELLKNKATFYVCGDAANMAREVNTILGQIISEQRGLPLEKGEEFVKNMRNMGMYQEDVWS

SEQ ID NO: 11894 - protein, 461 aa, Rhodopseudomonas palustris CGA009
MLKTIDTPQVRDATPKLKLYSREEADAFVAKVKAAGYDYVRFEFPDMAGLSRGKTIPIGHVSSYMRSGLNLYGGTVALDSYSIPVRDSGYNEEMNYTDCVMVVDTDTLTPVPWLEKTGRVICDTMWYDGTPQMATPRLLLKKMLNVAASMGYTVKSGHEYEFYVVDHATRAPLFGGQPIFVTSRTHQTPAIDDLIRVLEAQGIDIITWNVEHGPGQIEINYSALDDIAAADRAFVFKGTVKEYLAKHGLLATFMTKPYKGLSGSCSHFHISLLDSKTGENAFLDKEAENGLSRLMRSFIQGILDHTRACMALWSPTPNCYRRIRPRTYAPSNISWGIQDRSASIRVKASYDQATHLEVRVPSALSNPYLVSASVIASGLLGVMQNRELSPAAAGPKEDDARFEKLPTAIEDALEAFEADVALREMLGDEFAKVYLAMKWQEAARLRDEIPAAETNEYFELY

SEQ ID NO: 11895 - protein, 276 aa, Melanelia hepatizon
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDAT

SEQ ID NO: 11896 - protein, 378 aa, Zea mays
SESEAASGRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADAAVRVSPRAEDLADEVERIRAAMGSDIDVSLDCAGFSKTMSTALEATRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 11897 - protein, 275 aa, Nephromopsis pallescens
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPDLNGKLTGMSMRVPTSNVSVVDLTCRVEKSVTYDEIKATMKKASEGELKGIMSYSEDALVSTDLNGDNHSCIFDA

SEQ ID NO: 11898 - protein, 429 aa, Chromobacterium violaceum ATCC 12472
MKKTLLALLIASVMQSALAAPATPVREVDRIVAVVNKNVITWQELQARVNEAIKQLEAQKVAPPPREVLERQVLEQMITEEVQLQYAASGGLRIEDAAVDQAVANLAKQNKLSEAGLKAQLAKDGITLDRLRADIRRELTISRLRDSEVASRVNVSDSEVDQAMKSAQSANRTEYHLASILVAVPERADAKQIDQLSQKVHKAQADLAAGQPFAKVSAAYSDAPNALKGGDMGWRSATSLPQEFVQLLEQMKVGADTDVIRTQQGFFIFKLVDKRSGGAPMMVEQYHPRHILIRTNEAVSEADAKARIDQVRDRIMRGAKFADMAKLYSEDGSNAKGGDLGWVNMGDLVPEFEKAMVSLPIGQVSQPVRTPFGWHLILVEGKRNQDVSSDHEKMAVKQQIRARKMEQAYTDWVRQLRDSAFVEEHLDEK

SEQ ID NO: 11899 - protein, 278 aa, Nephromopsis laureri
VEHGAVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 11900 - protein, 587 aa, Pediococcus pentosaceus ATCC 25745
MKKTKIVSTLGPASTSVDTIVKLIEAGANVFRFNFSHGDHEEHLGRYNMVKEAEKITGKSVGILLDTKGAEIRTTPQKDGNQEYHTNDKVRISMDDTLETTKEKIAVTYDGLFDDVHVGGHVLFDDGLLDFKIDEKDEENRELVAHATNNGVLGSRKGTNAPGVSINLPGITEKDADDIRFGLESMNINFIAASFVRKPQDVLEIRELLEEKNMEDVQIFPKIESQEGIDNTDEILKVSDGIMIARGDMGVEIPAENVPLVQKTLIKKCNAVGLPVITATQMLDSMIENPRPTRAEASDVANAVWDGTDATMLSGESANGDYPVEAVATMAKIDEKAENAMAEDGNLQINTFDQSDVTETISAAVARAAKNLGVKTIVAATQSGYTARMISKYRPDADILAITFDERVRRGLMVNWGVHPIIADRPSTTDEMFELAANKAVDLGLAKEGDLILVVAGVPVGESGTTNIMKLQLIGSKLASGQGVGDETVIGKAVVATSADEANKKAVEGGVLVTKTTDKDYLPAIEKSSALVVENGGLTSHAAVVGISMGIPVIVGVQNATSILSDDELITVDSRRGIIYHGASNSL

SEQ ID NO: 11901 - protein, 313 aa, Zea mays
MDVPARPGPLGARASPQSRPSKAFCTCAQTAAAVDTRAATPRSKPPLLPPPPLTMGSAAASPQPSGNLTQDELKRVAAHRAVEFVESGMTLGLGTGSTAAHALDRLGDLLRAGALPGVAGVPTSLKTEAHAARVGIPLLPLDAASGASIRLSIDGADEVDPDLNLVKGRGGSLLREKMIEGAGDRFVVIVDESKLVPRLGCTGAVPVEVIPFGAPHTLGLIRKVFDGVPGFHARLRTVPAANGEDSDAPFLTDNGNYIVEMFFEDGIRGDLLDISDRLLRITGVIEHGMFLGMATTVIVANKDGTVTVINKKK

SEQ ID NO: 11902 - protein, 439 aa, Medicago truncatula
MASDADMEDYGFEYSDEEQEEQDVDIENQYYNSKGLVETDPEGALSGFAEVVRMEQDKAEWGFKALKQTVKLYYRLGRYKEMMEAYREMLTYIKSAVTRNYSEKCINSIMDYVSGSASQNFGLLQEFYQTTLRALEEAKNERLWFKTNLKLCKIFFDIGEYGRMSKILKELHRSCQREDGTDDHKKGTQLLEVYAIEIQMYTETKNNKKLKQLYQKALTIKSAIPHPRIMGIIHECGGKMHMAERQWADAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTINNRVG

SEQ ID NO: 11903 - protein, 463 aa, Ustilago maydis 521
MTTRNESKPLVALIGTLDTKKAEYQFATSWLEQRGCIVTVLDVSTQGPLEGPSSFELGADSGLYTPKRLLELRSGGHGTEVPTERSAVRDALREACLRELSQLQDDGALDAIASFGGSQNTAFATSIMRDARFPIGLPKIMLTTMASGDVSEYVGESDICIMPSIGDISGSLNAITLTTLQSALAAISGMAHAQHCSKQTQSTVRSLSNDHKPMIAISMFGVTTVAVNQISERLKQKGFEPVAFHATGSGGRSMERLIREGYFSGVIDLTTTEICDHLYHGVLSAGPDRLTAAAEKGVPQIVSVGALDMINFGSLTSLPSRFELKHGSEEGPMHHTTNGTPVYEHNSQVTLVRTSVEQNRELGKYLVRNLFKGLERGSQGRKEARMRILLPKGGISGMDGAQGVWDDPEARAALFHSIEESLEHHRDQGGQHSITLEAYDHHINSSEFAEIVANQAAGLVSKQ

SEQ ID NO: 11904 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 11905 - protein, 393 aa, Bacillus halodurans C-125
MTSSTSQRTRLSTRVQSIQPSGIRRFFDLASKMENIISLGVGEPDFVTPWNVREASISSMERGFTAYSANAGIIELREAISRYLYERFHIGYDPESEILVTVGASEAIDIGMRAIIDEGDEVIVVEPSFVSYAPLVTMAGGVPVPVGTHIDTDFQVTPAQIEAAITPRTKAIILCFPNNPTGSIMGKEELEAVAKVISGNDLIVFSDEIYAELTYDGTHVSLASMDGMRERTVLISGFSKAFAMTGWRLGYVCAPDDILSAMLKIHQYSLMCAPTMAQHGALEALETGMDDVHRMVQSYRQRRNFVVKTFTEIGLTCPMPGGAFYAFPSVKETGLTSEEFAERLLMEEHVAVVPGNVFGEGGEGHIRCSYATSMEHLETALERIGRFVQKCKQ

SEQ ID NO: 11906 - protein, 135 aa, Vitis vinifera
ELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 11907 - protein, 314 aa, Ashbya gossypii ATCC 10895
MSMETPPVDIDNIIDRLLEVRGSKPGQQVDLEEHEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNTMEQIRRVMRPTDIPDVGLLCDLLWSDPDKDIVGWSENDRGVSFTFGPDVVSRFLQKLDMELICRAHQVVEDGYEFFSKRQLVTLFSAPNYCGEFDNAGAMMSVDESLLCSFQILKPAVKPSAGRGQPKKKK

SEQ ID NO: 11908 - protein, 336 aa, Candida albicans SC5314
MPSFELDSLPYLNPNVDRRIAFITGGSSGLGFYSVLQLYLHGYTVYIAGRSKSRCLKSIKELKNKAIDIRSEYTSSQLNERFLGDLRFLEVDLSNLNSVISAVENFKKLEDHLHILINNAGAMALPYTLTIDKFEIQLQTNFVSPLVLTTKLLPILQKTADKFPKLPTPRIIYLGSFGHQFALPYFNLSNNLNHYPNFIFTWIRYGMAKVAGIHFMKMLTLRNPKVLFLTVHPGLVMNTNLFSYWTRLPIVGIIFWFAFYLFGYFFGVTSKEGADVVIKCALDENLTVENDNGKYFGPDGKESQPSSIATNMDYAARTWIWTIKELSQRGIDIPNP

SEQ ID NO: 11909 - protein, 482 aa, Mycobacterium sp. JLS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADIDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGVKESGFGREGGTEGIEEYLDTKYIALTK

SEQ ID NO: 11910 - protein, 266 aa, Bifidobacterium longum DJO10A
MSNPTIGFIGYGNMAQAIAEGLVAAGAVDGADIVACAAHYDKLEKTTMKVGAKPLHNAAEVVAASDMVVIAIKPYQIESVIKPVIGAIADEDKFVVSIAAGWDLDKYRDLFGADFNAAHIQCTIPNTPMAVGKGVLVTEADNTLTDTQAEVFERLFSSISLIERVDSAHMGIGMCIAGCAPAFTDMYIEALGDAGVKYGLQRATAYRLAAKMVEGVGALYLKNETHPGVMKDAVCSPGGTTIKGVTSLEESAFRGAVIKAVDAIEA

SEQ ID NO: 11911 - protein, 349 aa, Bacteroides fragilis YCH46
MNNHVVIMAGGIGSRFWPMSTPECPKQFIDILGCGKTLIQLTVERFGNVCPQENMWVVTSEKYIDTIREQLPGIPESNILAEPCPRNTAPCIAYACWKIKKKYPEANIVVTPSDQVVIDTTEFRRVIEKALLFTDKSSAIITLGIKPARPETGYGYIAAGEPITRDKEIFHVEAFKEKPDKETAEKYLAAGNYFWNAGIFVWNVRTITAVMRVYAPGIAQIFDRIYPDFYTEREEESVKKLFPTAESISIDYAVMEKAEEIYVLPAQMGWSDLGTWGALHTLLPKDKEGNATVGPDIRMYESQNCMVHASQEKRVVIQGLNDYIIAEKDNILLICQLSEEQRIKDFSKE

SEQ ID NO: 11912 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 11913 - protein, 635 aa, Brucella melitensis 16M
MPKSGVFKATSSTIFKYQEHSMVANGGSLYLQSLMILGGAIIAAPLFKRLGLGTVLGYLAAGITIGPVARLIADGEEFLHFSELGVVFLLFIIGLELNPSRLWSLRHSIFGLGTAQVLLCGAALAALGVYLAGLDTEAAIIIGFGLALSSTAFAMQVLEDRAETNQKHGQRAFAILLFQDLAIVPILAIIPALSPNEPSQASAGFHLATAIASIAALVIAGRYLINPMFRIIANTGAREVMIAAALFVVLGSASLLQYAGLSMAMGAFIAGVLLAESSYRHELEADIEPFRGIFLGLFFVAVGLSLNLSVILEYWAVILAAVPIFMATKIVIIYLLCRIFRSSHNDAVRIAFLLPQGGEFAFVLFSAASAAAIISCALGSELVAAVTVSMALTPLSVAIGSRLLIKDKADDIIEENFDGAGSDVLMIGFSRYGQIAAQILLAGGIDVTVIDSSSNRVRAAGKFGFRIYFGDGTRKDVLEAAGIRKAKIVAICTHKKSTTNHIVNLIQSEYPDVRLFVRSYDREHTLQLRAQGVEYELRETFESGLLFGQRTLEGLGLSEANAYAIREDVRQRDEDRLHVQASEGIMAGRHLLFNKPVTPEPLVKPTREGQRIDKSDDGQRAPSPQETAAAPVAAE

SEQ ID NO: 11914 - protein, 606 aa, Capsella rubella
MEEVTRSVLAEEILKRLDLENLCSVACVSTTLRSAVVSGVLPSLTSLDLSVFSPDEETLNHVLRGCIGLSSLTLNCLRLDANSVRGVLGPHLRELHLLRCSLLSSTVLTSIGTLCPNLRVLTLEMSDLDSPAVFQSNLTQMLNGCPYLESLQLNIRGILVDATAFQSVRFSLPETLKALRLQPLLESEAILLMNRFKVTGTCLSQADYSALLSLSPSFTLQSLSLVLDLISDRLIIAITGSLPQLVQLDLEDRPEKEPFPDSDLTYTGLQALGYCQQLTSLSLVRTCYNRKISFKRINDMGIFLLSEACKGLESVRLGGFQKVSDAGFASLLHSCRNLKKFEVRGAFLLSDLAFHDVTGSSCFLQEVRLSTCPLITSEAVKKLGLCGNLEVLDLGSCKSISDSCLNSVSVLRRLTSLNLAGADVTDSGMLALGKSDVPITQLSLRGCKRVSDRGISHLLINEGTISKTLSTLDLGHMPGMSDRAIHTITRYCKALTELSIRSCFYVTDSSIESLATRERQVEGGSKQLRKLNIHNCVSLTTGALRWLSKPSFAGLHWLGLGQTRIAGRKETVTATICGQRPWLTLCFDGCELGCYDGWEFHTPQRH

SEQ ID NO: 11915 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 11916 - protein, 220 aa, Triticum aestivum
MDAMAALARTGPSLAAAGHRSSATFRPSASLSFASASSRNRGRVGLSTAGCNRWATRVARATPNRIVASSEVEQTYIMIKPDGVQRGLVGEIISRFEKKGFLLKGLKLFQCPKDLAQEHYKDLKERPFFPNLIDYITSGPVVCMAWEGDGVVASARKLIGATNPLQAEPGTIRGDLAVQTGRNVVHGSDSPDNGKREIGLWFKEGELAQWESVQTPWLIE

SEQ ID NO: 11917 - protein, 275 aa, Cetraria leucostigma
  misc_feature (261)..(261): Xaa can be any naturally occurring amino acid
  unsure (1)..(275): unsure at all Xaa locations
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVXTDLNGDNHSCIFDA

SEQ ID NO: 11918 - protein, 519 aa, Aspergillus nidulans FGSC A4
MSLDYGKKELQMGGSMNGGIASGEVFEHGTTKRGLKPRHSQMIALGGCVGTGLFVGTGASLALGGPAFLLGSFVLMSIVVYMIVTAIVEIAAYLPVAGASMSYYGTRYVSRSLGFAMGWLYVYSLGILVPYEVTAGALVIDYWDSPVNVGVWITVFIVVIVALNLLPVEYYGEAEFWFASIKVFTIIGLLILSFILFWGGGPNQSGILGFHYWEDPGATKTWLAEGATGRFIAFVGTLVLCAFPFTFSPELLISTSGEMQNPRKDLKKAANRFLLRLVVFYVGAALAMSVISPSNDEALSNGGNNAKSSPFVVGIRHAGIRGLSSVVNASILTMAWSAGNAYLYMSSRALYALAISGQAPKVFLRCTKGGVPYAAVLACGLFGFLAYLNCGNSSSTVFTWFVTITNTSGFVSWICCCIVYLRFRAACKRQGVHELPYRSWLQPYGAWFGLVFFIVLALINGFNVFFPGQLTASSFLTAYIGLPAFAIIYAGHKLLLGRSDPWYLNAGEIDISDGLDIEY

SEQ ID NO: 11919 - protein, 224 aa, Oceanobacillus iheyensis HTE831
MNEQDKLKKAVGEKAATMVKDGMKVGLGSGSTVYWMIRSLGERIQQDGLKIEGIPSSNQTATWAEEAGIPLTDFSNVKELDITIDGADEVDANNHLIKGGGAALFREKIIAQAAKEFVIIVDQSKVVETLGEFSLPVEVLPFSWQRTANEISKLGCVPTVRVHEEEPLVTDNGNYILDCPFKVIPHPDKLNKEIKSIVGVIETGLFIDMATTVIVGEKDNIYIK

SEQ ID NO: 11920 - protein, 291 aa, Triticum aestivum
  misc_feature (259)..(259): Xaa can be any naturally occurring amino acid
  unsure (1)..(291): unsure at all Xaa locations
WTVLRSQAQYRYFGDVISLDVMYLQHSRASLPLATLLGVNNHGHLVLLGCGLLSKDSKENYVWLLKRWLGCMNGKPPEAITTCYSDVVAEAVSEVLPDARHRFCFWHILKKLQENVGRTHEKEAISLRFKEVVYDTVTLTDFEKEWEAMVEHYKLKDNEWFSALYSCRKQWAPGYVNHSFWAGTSAIRKVEKPDPYFDGVVTSKTTLPVFLEQYETTLRGKLEREAYDDLRSYYSRLTLLSGLPFEEQLLELYTVPMFXAFQDEIKQLMHVICKEVDRSGNSITYMVSELI

SEQ ID NO: 11921 - protein, 410 aa, Acinetobacter sp. ADP1
MDVRLSDRVNAIKPSPTLAVTNKAAELKAAGKNVIGLGAGEPDFDTPQHIKDAAIEAINNGFTKYTAVDGTPGLKKAIIAKFKRDNNLDYQANQILVSCGGKQSFFNLALALLNKGDEVIIPAPYWVSYPDMVIIAEGTPVIVKCGEDQRFKITPEQLEAAITPNTRLLVLNSPSNPTGMIYTKAELEALADVLRKHPQVYIASDDMYEPIRWEDEFYNIATVAPDLYDRTLVLNGVSKAYAMTGWRIGYAAGPAKIIGAMKKIQSQSTSNPTSISQVAAEAALNGPQDVLEPMIEAFKRRHDLVVNGLNEIHGISCLPADGAFYAYANIRPLIRAKGLKSCTEFSEWLLEETGVAVVPGDAFGLGGFMRISYATADDVLVDALARIKKAADSIEGIDAAIASIEAEKNA

SEQ ID NO: 11922 - protein, 145 aa, Antirrhinum molle
PKSFCSLKTSTCLRSPLPKIFTIHGLWPDNYSWPLRDCKYKVYQLPKLQDGVLLEDLDKKWPDLTKRRRKGEPPDKDFWISQWKKHGSCALSVYKFRDYFDEALNLKNKYNFLTILRENGVIPGDVYDTKRVAGIIHAATKHDPA

SEQ ID NO: 11923 - protein, 531 aa, Agrobacterium tumefaciens str. C58
MAPRVLVSDELSETAVQIFRDRGVEVDFQPKLGKDKDKLAEIIGNYDGLAIRSATKATEKLIEAATNLKVIGRAGIGVDNVDIPAASRRGIIVMNTPFGNSITTAEHAIALMFAVARQLPAADSSTQAGKWEKSKFMGVEITGKTLGVIGAGNIGGIVCSRALGLKMHVLAYDPFLSPERAQEMGVTKVELDELLAQADFITLHVPMTDKTRGILNAENLAKTKKGVRIVNCARGGLVDEAALAEAIKSGHVAGAGFDVFEVEPATESPLFGLPNVVCTPHLGASTTEAQENVALQVAEQMSDYLVKGAVSNAINMPSITAEEAPRLKPFIRLADVLGSFVGQVQESATKEIEILYDGATANMNTKALTSALLAGLIRSQVADVNMVSAPVMIKEKGIILSEVKRDKTGVYDGYIKLTVKTENQIRSVAGTVFSDGKPRFIQIKNINMDADVGSHMIYITNTDVPGMIGFMGTTLGEAGVNIANFQLGREKEAGDAIALLYVDGPVSEEVLDKLRANSAIRQVKPLTFNVD

SEQ ID NO: 11924 - protein, 230 aa, Methylobacillus flagellatus KT
MNDKQLVAIQAAQHVQDGMVVGLGTGSTANYFIEELARRHRDEGLHITAAASSVASTIQAQTHGLPLVALEHLGRLDLYVDGADEVTTNLALLKGRGYDLVREKLLARASERFIVLVDKSKLVGHLGEKFPIPLEVIPFAWQLVQASLQQLGIASSLRQNAAKDGWAITSHGSLVLELTLPKTFKSDELNRLLNDIPGIVEHGVFDELADAVFVADNGQVEEIWKRPGNI

SEQ ID NO: 11925 - protein, 368 aa, Malus x domestica
MGKGGQSCNGMVRQAKPVEQENMAAWLVDVNTIKILPFKLPSIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVGPETTVLIIGAGPIGLVSVLTARAFGAPRIVIVDMDDKRLAMAKSLGADEAVKVSTKMEDLDDEVAEIKKAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 11926 - protein, 629 aa, Oceanicola granulosus HTCC2516
MQGFLIQATIYLGAAAIAVPLAARLGLGSVLGYLLAGVAIGFIPGIGSETEELQHFAEFGVVVMLFLIGLELEPRALWDMRDRLIGLGGLQITLTTGLIALGAAALGIAWPTALAVGMIFALSSTAIVLQTLSEKGLMQTPGGRSTFSVLLTQDIAVIPMLALLPLLVVGTGSATALHGEAAHGPEVHAMSLVEGLPGWGVTLVTLGAVAAIVLAGTYLTRPVFRYIQHARLREMYTVLALLMVVAIAVLMQSVGLSPALGTFLAGVVLANSEFRHELESDLEPFKGLLLGLFFITVGAGIDFELLLAHPLTLFGLTLGVIVIKGVVLYLLALLFKLRGRDRWLFTLGLAQAGEFGFVLISFSLQQAVLTQEAGAMLLMVVALSMMITPLLFILNERLSRRMVEAADAPADEIDETGPVIIAGIGRFGQVVNRLVRSAGYSTVVLDANLATVQTMRTFGFRAFFGDPTRPDLLHSAGFDDASVLVVALDDPAAATRLVRYARTARPDIHIVARARDRIHVYQLYQAGADDIVRETFDSSLRAGRYVLENLGLSEYEANEAEVYFYHHDRSAMRTLAQLYKPGVPVSQNPEYVAKARELERDLETALASNLDVEAMGLQRKGAAGGRAKE

SEQ ID NO: 11927 - protein, 441 aa, Streptomyces netropsis
MSHSVTLPSTKDIIELERRHRLPGGQSMTDLAGIVVDRAVNAEVWDRDGKRYIDFFTGVGVSNIGHSHPAFLEELTTQLSRCAVGTFYTDVRSRYFALLAAQLPEQLGEIHMFSTGSEAVEAAVKLARAATGKHEIVSFWGGFHGKTQGALSLHGGPRKHRSGPFPPGSHQVPYADCHHCPLQLEHPECGQRCVDLAEQSIENGSVGDLAAVIVEPVQGTNGNIIPPEGYLRTLRQLADRHGALLILDEVITGFGRTGALFAFEHDPGIAPDVVVLGKAMASGVPASAIVSRSGLVEGTSFAVPSAAASTFGGNPLASAASLATLRVLLDERLPERSHELGKSVSDRLSAWREEFPFVGNADNIGLMIGVELVDPATRLPLPKGITRRLFQELMARGVLAMAYDSRIRLYPPLSIPTHHLEEGLAAFEGAFRAMAPAISRL

SEQ ID NO: 11928 - protein, 398 aa, Bacillus licheniformis ATCC 14580
MFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 11929 - protein, 188 aa, Arabidopsis thaliana
  misc_feature (153)..(153): Xaa can be any naturally occurring amino acid
  misc_feature (164)..(164): Xaa can be any naturally occurring amino acid
  unsure (1)..(188): unsure at all Xaa locations
MASSMLSSATMVASPAQATMVAPFNGLKSSAAFPATRKANNDITSITSNGGRVNCMQVWPPIGKKKLETLSYLPDLTDSELAKEVDYLIRNKWIPCVESELEHGFAYREHGNSPGYYDGRHWTMRKLPLFGCTDSAQVPKEVEECKKEYPNAXFRTIGFDNTRXVQCISFIVYKPPSFHRSIPFLLLV

SEQ ID NO: 11930 - protein, 444 aa, Listeria monocytogenes str. 4b F2365
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAVTACDSIQTFKLVVKTIARKHGLHATFMPKPLFGVNGSGMHFNMSLFNEKGNAFFDESGELELSQTAYHFLAGMLKHARGYTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIKAGLGEHIFEHFIEAKTIECDMFRTAVHPWEREQYLEIY

SEQ ID NO: 11931 - protein, 586 aa, Bacillus anthracis str. A2012
MKTVANYSYFVMIVLRKRLHKISDGMQKERMTMNKTWWKEAVAYQIYPRSFMDSNGDGIGDLQGIIAKLDYLKDLGIDVIWICPMYKSPNDDNGYDISDYQDIMDEFGTMEDFDALLDEVHKRDMKLIIDLVINHTSDEHPWFIESRSSKDNPKRDWYIWHDGKDGAEPNNWESIFNGSAWEYDEVTGQYYLHLFSRKQPDLNWENKEVREVLYDTVNWWLDKGIDGFRVDAISHIKKEDGFKDMPNPKGLKYVPSFDKHMNVDGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQFPNIEDYDDVAIKNLYREKIAEGVSHQDMMEIIWASCRDNSRTPMHWDDEINAGFTTGTPWFGMNQNYKEINVAKQKNEENSIFNFYKKMIALKKEHDVLNYGTYDLLLEDDPQIYAYTRTLNDEKIVVISNISKEEAVYNEDLFALERKRLLLNNYEVAEHEQLTTITLKPYETRVYRIS

SEQ ID NO: 11932 - protein, 536 aa, Medicago truncatula
MNNNQAKNFGASASSSSLFGPFGISPQSQQQQWNHLVSRSHPQTQFHGQFQFSEPQLHPQGFAQAHYAQLQSQAALASLQSSQTQPVTPLHNANTNTNVVSTPATGGSKRAGTQRNLLRTPGSSGANQNVPDKTMELTPASRRRMRELPEKQMLEKVATILPESALYTQLLDFEAQMDAALAKRKLGMQEAIRSPPHVQKTLRVYVFNTFSKHTKTDSEEDKTVEESSWSLKIIGRVLEDGNDLLSGILQRSSPSDTKFSDFFKKITICLDQNLYPENHIIVWDSAHSPKQQDGFEVKRKGDKEFTAVIKLDLKYSPEKFMVSAPLSRLLGVEVETRPRIIAALWHYVKSRKLQCADEPSFFICDPYLQRVFGEEKMGFTTAAQKLLEHLSQPKPIYLEHNIKLSGDCPSGTACYDVQVDMPIPMQKEMSAFLASNSIESNKEIETQDEMISANLKKIQEHRRRRAFFLSFSQSPAEFINATIASQSKGPKLVAGDAGRNSEKEQCPEFYNQPWVEDAVIRYLNRKGAGRDAREGN

SEQ ID NO: 11933 - protein, 290 aa, Wolbachia endosymbiont of Drosophila simulans
MIPEGFHIHHYKEVSSTNKEALDLIDKGISNETAIIADKQTEGRGRTGKSWISPEGNFYASLVINLFNDYLNESQLSVSFQRVTLESRKKEEWIPVSSTGMTSEGIGMTEKGLVNKIADVSKLTELTFVTALTVGNTILSFINGLNLQYKWPNDVLIDGKKISGILLEKRSNSNWLIVGIGINVSHAPLPGTTCISNYGESVSNIDLLKELIINFNKLKKQWLFDGFYAIREMWLKKAFKMNEQISVKLADKLYEGIFADIDKSGKLVLQQKDESLIYFDAGELFINDIL

SEQ ID NO: 11934 - protein, 427 aa, Corynebacterium glutamicum
MRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 11935 - protein, 269 aa, Methanosarcina acetivorans C2A
MVRSILNKYNIKGGTFDQHFLIDIGYLDRIVVAAELSPQDTILEIGAGIGNLTERLARRAKKVIAVELDPALVSVLHDRFDKVENIEVIAGDALKVDFPEFDKVVSNLPYSISSEITFKLLRYKFKLGILMYQYEFAARMVSPPGRKDYSRLTVDTYYFADASILMKVPKGAFQPAPEVDSAVVKLVPRPSPFEVRDEAFFLEFVAAVFSQRRKKLRNSILNTNSMLKIPDIKEVVNQLPDDFVNKRAENLTPEELASVANMLFDLKSR

SEQ ID NO: 11936 - protein, 552 aa, Psychrobacter arcticus 273-4
MTNTQQQSESIDDNQAQLSKQQNSDNNKKVPRVLMILDGFGHREDDKDNAIAAADMPNLDKIYEQYPHGLISASGEDVGLPDGQFGNSEVGHMNLGAGRVLYQDSTRISSEVASRDFYKNEALVNAVKAANTLGGNVHIMGLLSDGGVHSNQDHIEAMCHSALVHGAKNVFVHCFLDGRDTPPKSADKYINRLRDHIIKLNAHYESGRVQIASIIGRYYAMDRDNRWDRVQKAYELITEGKADRLSTRADGAVQAAYKARETDEFINPTVVIGRDEVPYTVDDNDALIFMNFRADRARELAQAFVLPDHEFSGFARNKQPKLAAFVMLTKYSDVLADNPKTSIAYYPTSLTNTLGEYLQSKGKTQLRIAETEKYAHVTFFFSGGREDEYKGETRILVPSPDVATYDLQPEMSAPEVTDKLVEAIESGQYDVLVVNYANGDMVGHTGIFDAAVQAVEALDVCVGRVAAAVHAAGGDMLITADHGNCEQMQDYESGQVHTQHTTEHVPLIYVGEKKVQVRSGGKLSDVAPTILALMDIEAPKEMTGENLLVAAE

SEQ ID NO: 11937 - protein, 468 aa, Thiomicrospira crunogena XCL-2
MSQEIFDLIKDNDVKWVDLRFTDTHGKEQHVTIPADSVDEDFFADGETFDGSSIQGWKGIHNSDMLLMPQTDGFYLDPFTNDPTMIIRCMIVEPSTMEAYEKDPRGIAKNAEAYLASTGIADSAFFGPEPEFFIFDDVRWGADMSGCFVKIDGNEAAWNSEKVFEGGNIGHRPKVKGGYFPVPPVDQLHEVRADICAMAEAMGLKLEAHHHEVASGGQCELAVAGNTLTAKADEVQILKYAVHNTCQALGKTATFMPKPIVGDNGSGMHINQSLSKNGKNIFAGDVYAGLSQEALWYIGGLMKHARALNAFTNPGTNSYKRLVPGFEAPILLAYSGSNRSASIRIPYAPSERSRRVELRFPDPTANPYLAFAASLMAGLDGIINKIDPGEPAEKDLYDLPPEEEATYKTVCASLEEALASLDADRDFLKAGGVFTDEAIDSYINLKMEEVTRMRATTHPIEFDMYYSS

SEQ ID NO: 11938 - protein, 502 aa, Aspergillus nidulans FGSC A4
MKPPYYMETGCKRNPGSDSTLKVRWTLYTRLLQSANQGLGIDPGSGQVFASCPTNTVADVDAYVSSAHRSFLSYRETNPRARAKMLLNWHNLIAQSKNDIAKLVVYETGKPMAEAVGEVDYALGFAWWFAGEAERVRGSIAQPSISERRTFVIKQPIGVCIALVPWNFPVAMIIRKAAAALAAGCTVVIKPSPETPLSVLALADLALQAGFGPGVINVLTTDNLNTPDVSEALCKHPLVRKVTFTGSTAVGQLIARHCSEGLKKVTLELGGNCPFIIFDDGDLEQALAALMILKWRTAGQACTHANRVYVQSGVYDTFLRMIVNATKQLKVGHGASPGTTMGPLTTSRGIEKLERHVADALAKGARLELGGHRLQLEGNYFQPTIISGMSAYMLTTQEEIFGPLLGLYRFETEEEAVRMANDTSMGLASYFFTRDVSRTWRLLENLEAGMIGMNTGNSSAAESPFGGIKASGYGKEAGKDVAIEEYLIAKTGTLTVGAVSKL

SEQ ID NO: 11939 - protein, 145 aa, Antirrhinum meonanthum
PKSFCSLKTSTCVRTPLPAKFTIHGLWPDNYSWPLRDCKYTIQLPKLEDIDLLKTLDKEWPDLMKRRPRLNEIPKKKFWISQWEKHGSCALSVYSFEEYFQETLKLKRRSNILKILRKNSMRPGDDVDPKKVVSSIAEVTQHDPA

SEQ ID NO: 11940 - protein, 336 aa, Arabidopsis thaliana
MDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSVVTGLNNNEYQITRGKELNRLAGVDKTCNFVKADFMKMPFPENSFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRREIFTPMYFFLARKPE

SEQ ID NO: 11941 - protein, 465 aa, Streptococcus mutans UA159
MSHQNAKNTTQNPKELENGMVRGLQNRHVQLIAIAGTIGTGLFLGAGRSISLTGPSIIIVYLLTGLFMFWMMRAMGEMLYHDPDQHTFINFITKYIGKEWGYFAGWSYWVSVIFLGMAEITAIAKYVQYWFPSWPAWIIQIVFLLILGSVNLIAVRVFGEAEFWFAMIKIIAILALIATAIFMLLTGFKTSQGPVSFANISKGFEMFPNGWMKFLMSFQMVFFAYQAIEFVGITVSETQNPRKVLPKAIQEIPMRIVIFYVGALIAIMTIFPWRALPSDTSPFVMVFKLAGIKWAAALINFVVLTSAASALNSTLYSTGRHLYQLANEAPNQFMKRFKIGTLSKTGVPSKAIIFSAIVIAISAFINVLPGIKDAFALITASSSGVYIAIYVLTMLAHLKYRKSNDFMADGYLMPHYKILNPITIIFMVFVFITLFLQDSTYIGAIGATIWIAAFGFYSKFKFKKQ

SEQ ID NO: 11942 - protein, 490 aa, Sinorhizobium meliloti 1021
MTISETLLVKLKDPSLAVDKGLIGAEWLDRSDSGKTFDVSNPATGEVIAILPDMSRSETARAIDAAHAAQRAWAEKTGKERAAVLRNLYDLVVANADDLATILTMEMGKPLTEAKGEILYGASYVEWFGEEAKRVYGDTIPGHQPDKRIIVLKQPIGVVAAITPWNFPNAMLARKLAPAAAAGCAVVSKPAAETPLSALALALLAERAGLPAGVFNVILSTDSAEVGKEMCANDKVRKLTFTGSTNVGKILMRQGADQIMKLGLELGGNAPFIVFDDADLDAAVEGAMVAKYRNNGQTCVCANRIFVQAGIYDAFAARLTAKVSEMTIGDGFEPDVDAGPLISEKALAKVEEHIRDAVTKGADLVLGGNARGGLFFEPTVLTGATMDMKIAGEETFGPVAPLFKFETENEVVSMANKTEFGLASYFYSKDVSKVFRVAEALEYGMVGINTGLISTEVAPFGGVKQSGQGREGSKYGIDDYVETKYLCLSI

SEQ ID NO: 11943 - protein, 209 aa, Bacillus cereus ATCC 10987
  misc_feature (25)..(25): Xaa can be any naturally occurring amino acid
  unsure (1)..(209): unsure at all Xaa locations
MKRVGKEFFLQHDIVIMYSILFVFXIILKMQFFTWIGLLACLFGIIFYTLNEYMTHRFLFHLKPPKNVFLLKMLRRLHYDHHVYPDDLKLLFLPVWFSIPSFTIYLLISYVITKSVTITLSFGIGMIIMLLVYEWKHYIAHKPIRPVTKFGRWLKKQHILHHYKNEKFWFGVSNPVFDFIFGTLKDGKDVELSETARNLEKEKKTEVVR

SEQ ID NO: 11944 - protein, 282 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAAKSGVQVRLRR

SEQ ID NO: 11945 - protein, 395 aa, Streptococcus pneumoniae TIGR4
MKLSNRVLEMEESVTLAAGARAKALKAEGRDILSLTLGEPDFTTPKNIQDAAIASIRDGRASFYTVTSGLPELKAAVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTVILEEAEVALVTGAGFGAPENVRLSYATDLDTLKEAVERLKAFMGSEND

SEQ ID NO: 11946 - protein, 225 aa, Ustilago maydis 521
MSSWSSWFGKKDNKNSARDAIVGLRQQLLMLEKKEEHLNKKIEDELKKAKANVTTNKRAAQAALRQKKAYENELDRIAGTRMTLETQVNAIESANMNLETMTAMRKGADALKTIHGSLNIDKVDSTMDSIREQMDLTNEISDAISNPVGMGHDIDEDELKNELEELEQDELNERLVGADSVPLHTPAVATSAGISRISNGPERKQAVVEDDDDAELRALQAELAM

SEQ ID NO: 11947 - protein, 130 aa, Arabidopsis thaliana
  misc_feature (91)..(91): Xaa can be any naturally occurring amino acid
  misc_feature (103)..(103): Xaa can be any naturally occurring amino acid
  unsure (1)..(130): unsure at all Xaa locations
CWSQTPRVPDLEEFYAVFRSMVVSPAQATMVCPFNGLKNSDDLPATQQANNDITSISCNGGRVNCMQVCAPHVKKKCETLYYLPDLTEYEXAKEVDYLIHNKXIPYVEFELEHGFVNREHVNSPGYYDGR

SEQ ID NO: 11948 - protein, 365 aa, Oryza sativa
MATGGGGGGGGMGGGGVGGGAGAAGVGVGGRMPTWRERENNKRRERRRRAIAAKIFAGLRAHGGYKLPKHCDNNEVLKALCNEAGWVVEPDGTTYRKGYKPPERMEVIGCSVSPSPCSSYQPSPRASYNASPTSSSFPSGASSPFLPHPNNMANGVDGNPILPWLKTLSNSPSSKKHPQLPPLLIHGGSISAPVTPPLSSPTARTPRMKTDWDESNVQPTWTGSNSPCVVNSTPPSPGRTMLPDPAWLAGIQISSTSPSSPTFSLVSSNPFSVFKDAIPVGNNSSRMCTPGQSGTCSPAIPGMAPHPDIHMMDAVSDEFAFGSSTNGGHQAAGLVRAWEGERIHEDSGSDDLELTLGSSRTRAAA

SEQ ID NO: 11949 - protein, 288 aa, Bordetella parapertussis
MGAITIAPMSAEVRSLSLPEPAALARAIAARLPAFRDISWVGSTGSTNADLLARARAGGGARPCLLGAHLQESGRGRAGRPWQNRVGAALMFSCAFDVDLPPSQLPALSPLAGMAACEALRQLVGQPAGLLVKWPNDVQWHDAKLAGVLVESVRNPAGTGHAVVIGMGLNLHGGDALSQALQRSVADWNDVAGPGEKGPDAAADLVATVARAWQGAAHTLQQEGFGAFGARFARVDALAGRPVNVIDRGEILYTGAASGVDDHGRLLVQAADGMRPVSVGEISIRPQA

SEQ ID NO: 11950 - protein, 338 aa, Gloeobacter violaceus PCC 7421
MTIKVAINGFGRIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVISWYDNEWGYSQRVVDLAELVARKWAA

SEQ ID NO: 11951 - protein, 150 aa, Brassica napus
MAEQTFIMIKPDGVQRGLIGEVISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 11952 - protein, 300 aa, Symbiodinium sp. P083-2
RIGRQVARIAMKDPETDLKLINASYDADYLAYMMKYDTIHGKYDGTVEVDGDSLVIDGQTVALSHTRDPAEIPFKEHGAEYVCESTGVFLTTDKVQPHLKAGAKKVIFSAPAKDDSHTIVMGVNEDTYDPSMECVSCASCTTNGLAPAVRVLQEKFGIKRGLMTTCHAMTASQPTVDGTSKKDWRGGRAGPGNIIPSSTGAAKAVAKVLPAVKGKLTGMALRVPTIDVSVVDLTCELEKETTYEEICAEMKKRSEGDMKGYLGYTDEALVSTDFETNPISCTFDSKAGIMLDPTFVKEVC

SEQ ID NO: 11953 - protein, 774 aa, Arabidopsis thaliana
MKFFGWMQNKLHGKQEITHRPSISSASSHHPREEFNDWPHGLLAIGTFGNKKQTPQTLDQEVIQEETVSNLHVEGRQAQDTDQELSSSDDLEEDFTPEEVGKLQKELTKLLTRRSKKRKSDVNRELANLPLDRFLNCPSSLEVDRRISNALCDEKEEDIERTISVILGRCKAISTESKNKTKKNKRDLSKTSVSHLLKKMFVCTEGFSPVPRPILRDTFQETRMEKLLRMMLHKKVNTQASSKQTSTKKYLQDKQQLSLKNEEEEGRSSNDGGKWVKTDSDFQASVHEYRSERFVSKGNAFVFHGGSEGIYSSSPSDNFTSDSDSVSFIRFEKIKFQRPEEVSNRSSLSIHAVVFEVEDRENIGGSAYGGQRAVCCTSDLAKLGVCSHGDVIYRPSAKDSGWPQVFGVSLAENEFSVILPTRSIQVTRTGMYNLYFIHCDSDLKDLVVEGKTIWKNPTGYLPGRMAPLMYFYGFMSLAFVLLGIFWFSQCARFWREVLPLQNCLTLVITLGMCEMALWYFDYAEFNETGIRPTVITIWAVTFGSIKRTSARIIILMVSMGYGVVRPTLGGFTSKVIMLGVTFFIASEILELMENVGAVSDLSGKARLFFVLPVAILDAFFIIWIFKSLSATFKKLQTRRLLVKLDIYRKFTNALAVDILVSLGWICYELYFKSKDVYNEHWQNAWIIPAFWQLLSFSLLIVICSLWAPSQNSTRYAFSGSSGDTSAEFEKDDYTLTLIKPSPIPSHEVKNLSETRLLPADEGEPEKDLEEDKRE

SEQ ID NO: 11954 - protein, 459 aa, Methylobacillus flagellatus KT
MKIVDGRFTCQPGTPAEQLAAAKKFLADNHVKYVLAQFVDIHGVAKVKSVPAAHLESILKDGAGFAGGAIWGMGILPNGPDYMAVGDLSTLSLLPWQPGYARIICDGHVDQKPYEYDSRVVLKKQVERLSAQGWTLYTGLEPEFSLLRRDEKGALHPCDETDTLQKPCYDYKGMTRQAVFLERLTEALIAAGLDVYQIDHEDANGQFEINYTYADCLKSADDYILFKMAASHIANELGMTCSFMPKPFGNRPGNGMHMHMSIGDGNKSLFHDDSDSTGHGLSPLAYHFLGGILHHAPALTALAAPTVNSYKRLVVSQSLTGSTWAPAYISYGNNNRSTMVRIPYGRLELRLPDGSCNPYLTTAAVIAAGLDGVKRELHPGPGHSTNLFDLSLAEMKEQGIGILPQNLNESLDQLEANQVLRDALGNALTEEFIKLKRAEWVDYQRHVSDWEINRYIEFF

SEQ ID NO: 11955 - protein, 223 aa, Cryptococcus neoformans var. neoformans B-3501A
MFANSLRQGLRTASRSSARAFSTIPARAPRTNVVGALALGTAVAGYALYETTRSPVMLEGARTIAGEKGTVTERSFVMIKPDGVSRQLVGKIVSRFEERGYKLVAIKSLTPSDALAKEHYADLSARPFYPSLVKYITSGTPVVAMVWEGKDVIRQGRRIVGATNPLDADAGSVRGQYAVSVGRNLIHASDAFESATKEIGLWFAPEELSEYEPIAWPWVMADN

SEQ ID NO: 11956 - protein, 546 aa, Psychrobacter arcticus 273-4
MMADDKTKSTQAERLVQLRRDKGMTAEQLAQAMTAAGAKVSRGAISNWERGTNGIVSSKLPTLARILGCSEGYLLRGELESDSKSDVDLKNIASDNTNVYVESDEQAHSASQITHTTTIPSTPRKISPNNLMSGPFMNTIKKSDKLQNVCYDIRGPLLQTANKMEAEGKRILKLNIGNPAPFGLEAPHEILRDVAMNLPEATGYSDSQGIFSARKAVLQYYQSKGLLSAVDVRDVYLGNGVSELIVMTLQALMNDGDEVLIPMPDYPLWTAATNLAGGTAVHYRCNEEDNWHPDIEDIKSKITSKTKGIVVINPNNPTGALYSDEVLLQIIEVAKEHDLIIMADEIYDRILYDDMEHTPMSTLTDEVLVLSYNGLSKSHRIAGFRAGWMMISGRKEHAADFIEGLDMLASMRLCSNVQGQYAIQTAMGGYQSMKDLTSKKGRLYKQRELAVTRLNAIKGISCTMPQGAFYCFPKMDPEIYPIKDDMQFMMDLLLEENVLMVQGTGFNWDKHDHFRLVFLPNLHDLEDAMDRLDRFFAKKRKQFGTD

SEQ ID NO: 11957 - protein, 194 aa, Glycine max
  misc_feature (148)..(148): Xaa can be any naturally occurring amino acid
  misc_feature (185)..(185): Xaa can be any naturally occurring amino acid
  unsure (1)..(194): unsure at all Xaa locations
MASIFLSSPPSFSSAHHNASTHLILHTPNSLNLRTMSHSLPIRAITLTWDYLKRLAANKAVEFVKRGMVLDPGTGTGSTATFVIAKLGTLLASGQLIDIVGVPTSKRTEDKVLFLGIPLFVLGLTIDDADEVDPNLNLIKGCGGALFXKKMVEAASNKFVTDKDDTKLVDGLGGSGLAMPVEVVXFCWKYNLDQ

SEQ ID NO: 11958 - protein, 145 aa, Antirrhinum molle
PKSFCSLKTSTCVRTPLPAKFTIHGLWPDNYSWPLRDCKYTIQLPKLEDIDLLKTLDKEWPDLMKRRPRLNEIPKKKFWISQWEKHGSCALSVYSFEEYFQETLKLKRRFNILKILRKNSMRPGDDVDPKKVVSSIAEVTQHDPA

SEQ ID NO: 11959 - protein, 403 aa, Debaryomyces hansenii CBS767
MLALILTISICIFLKGSTCSYINLGSEGIVFGAPNCPVDIPLTCTNSTPIDNSCCFESPGGILLLTQFWDYYPPIGGNESFTLHGLWPDNCDGTYEQFCDDSLNIRSATDIVLNQFGDKVLYGKMSEFWKNFNGNDESLWIHEFNKHATCVKTIRPTCYDNQRYVKNKNVYDFYNITMNLYEKLPTFQFLAAEGIVPSLTQKYSKKQINDALTKYFGKAVYFKCNKYKALQEVWYYHYLQGSLKEENFSPIDTIINSNCPEENIQFIPKNGFNPGPQPPKSPRKGYLESPGKKGCLISNGLWYEAGTCATYAISQQEFGGYKIRSSKGYCGMNSQGQFTCNKQVDPTKNQFQYNKDTRKIGYGGNFAWCLDTEHKHGDGKTAQTPIKISDGQCDSFPVQYGGK

SEQ ID NO: 11960 - protein, 491 aa, Listeria monocytogenes str. 1/2a F6854
MVFLSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDNVNVGPLIREDAIDKIDKQLKNATDKGAKVLTGGGRLTGSDYDNGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 11961 - protein, 146 aa, Antirrhinum majus subsp. cirrhigerum
PKSYCSLETSRCLRKPLPSKFTIHGLWPDNYSWPLRDCKYTIQLPKLEDTAGLLDELDKDWPDLTKRRPRPNETPNKKFWISQWEKHGSCALSVYTFEEYFTETLKMKRRFNILGILGKNSMRPGDNVDPKKVVRSISKYTKHDAA

SEQ ID NO: 11962 - protein, 341 aa, Magnolia quinquepeta
MGGKKIKIGINGFGRIGRLVARVALQRDDVELVAVNDPFITTDYMTYMFKYDSVHGQWKHHELKVKDSKTLLFGEKPVTVFGVRNPEEIPWGETGAEFVVESTGVFTDKDKAAAHLKGGAKKVIISAPSKDAPMFVVGVNEHEYKSNIDIVSNASCTTNCLAPLAKVINDKFGIVEGLMTTVHSITATQKTVDGPSSKDWRGGRAAGFNIIPSSTGAAKAVGKVLPALNGKLTGMAFRVPTVDVSVVDLTVRLEKAASYEEIKAVIKAESEGKLKGILGYTEEDVVSTDFIGDNRSSIFDAKAGIALNEHFVKLVSWYDNEWGYSSRVIDLILIVHMASCQ

SEQ ID NO: 11963 - protein, 498 aa, Aspergillus oryzae
MSPRPFTLNDPSLLHEASLLNGEWVAAQSNKRLSLTDPGSRHVFATCPTNGPEDVDKYVETSHAAFERYRHVNPRERAKFLLKWHELITKAREDIATIVVYETGKPMAEALGEVDYALGFAWWFAGEAERVRGSIALPSVSNRRTFVIKQPIGVSAALVPWNFPVAMIVRKVAAALAAGCTMIVKPSPETPLSVMALADLALRAGLAPGVLNVITTDNEYTPSVSERLCKHPLVRKVTFTGSTRVGSIIAKHCSEGLKKVTMELGGNCPFIVFDDGNLEQAVAALMILKWRTAGQACTHANRVYVQAGVYDKFAQMMLEATQKLKVGHGTDSGTTMGPLTTERGVEKLKKLVSDAISKGGKVLCGGKQPNGPQGYFFEPTIISGMTSEMLASQEEIFGPLLGLHRFETEEEAVKMANDTSMGLASYFFTKDIDRTWRLLESLAAGMIGMNTGNSSCAESPFGGIKESGYGKEAGKDVAIEEYLISKTGTLTVEGAPGP

SEQ ID NO: 11964 - protein, 342 aa, Zea mays
MASSEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFYDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 11965 - protein, 390 aa, Wolbachia endosymbiont of Drosophila simulans
MFLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 11966 - protein, 253 aa, Oryza sativa
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 11967 - protein, 283 aa, Bacillus licheniformis ATCC 14580
MVIQWFPGHMAKARREVTEKLKLIDIVYELVDARIPMSSRNPMIEDILKNKPRIMLLNKADKADSSVTKAWKQHFEKDGIPTLAINSVNGQGLNQILPASKELLKEKFDKMKAKGVKPRAIRALIVGIPNVGKSTLINRLAKKNIAKTGDRPGVTTAQQWVKVGKELELLDTPGILWPKFEDELVGLRLAATGAIKDSIINLQDVAVYGLRFLEENYPERLKKRYDLEEIPEEIAALFDEIGKKRGCLMAGGEINYDKTTEVIIRDIRTEKFGPLSFEKPEDM

SEQ ID NO: 11968 - protein, 127 aa, Candida albicans SC5314
MISMTNIFTPIEEALEAYKNGEFLIVMDDEDRENEGDLIMAAELITQEKMAFLVRYSSGYVCVPLSEERANQLELPPMLANRSDRHGTAYTITCDFAEGTTTGISAHDRALTTRSLANPIFKTTRFH

SEQ ID NO: 11969 - protein, 107 aa, Glycine max
  misc_feature (28)..(28): Xaa can be any naturally occurring amino acid
  misc_feature (51)..(51): Xaa can be any naturally occurring amino acid
  misc_feature (90)..(90): Xaa can be any naturally occurring amino acid
  unsure (1)..(107): unsure at all Xaa locations
GLEDTEANRQVYRTLLETTPGLGQDIYXAILFEETLYQITTDGGTIDGVLXEQNIDAGIKVDKGLGPLSRCNHKSWSQGLDGLASRSAAXYYQQGARFAKLRTAVSI

SEQ ID NO: 11970 - protein, 294 aa, Brucella melitensis 16M
MWWPAPRKTAQKISGKGYIMTVPTVKLNDGNHIPQLGYGVWQISNDEAVSAVSEALKAGYRHIDTATIYGNEEGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 11971 - protein, 300 aa, Symbiodinium sp. JCUCS-1
RIGRQVARIAMKDPETELKLINASYDSDYLAYMMKYDTIHGKYDGTVEADGDSLVVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVC

SEQ ID NO: 11972 - protein, 347 aa, Symbiodinium sp. JCUCS-1
MATKIGINGFGRIGRMVFQAICDQNLLGTKLDVVGVVDMSTDAEYFAYQMKYDTVHGRFKHDVKIGEKDELIVNGNKIKCIQASREGPKALPWKEMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSYTATQKTVDGVSAKDWRGGRAASCNIIPSATGAAKAVGEVLPTTKGKLTGMAFRVPTPDVSVVDLTFTAEKDTSIEEIDALFKKASETYMKGVLSFTDEELVSADFIHNVNSSIYDSKATLQNNLKGEKRFFKIVSWYDNEWGYSNRVVDLLMHMISA

SEQ ID NO: 11973 - protein, 459 aa, Rhodopseudomonas palustris CGA009
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 11974 - protein, 557 aa, Xanthophyllomyces dendrorhous
MFILVLLTGALGLAAFSWASIAFFSLYLAPRRSSLYNLQGPNHTNYFTGNFLDILSARTGEEHAKYREKYGSTLRFAGIAGAPVLNSTDPKVFNHVMKEAYDYPKPGMAARVLRIATGDGVVTAEGEAHKRHRRIMIPSLSAQAVKSMVPIFLEKGMELVDKMMEDAAEKDMAVGESAGEKKATRLETEGVDVKDWVGRATLDVMALAGFDYKSDSLQNKTNELYVAFVGLTDGFAPTLDSFKAIMWDFVPYFRTMKRRHEIPLTQGLAVSRRVGIELMEQKKQAVLGSASDQAVDKKDVQGRDILSLLVRANIAANLPESQKLSDEEVLAQISNLLFAGYETSSTVLTWMFHRLSEDKAVQDKLREEICQIDTDMPTLDELNALPYLEAFVKESLRLDPPSPYANRECLKDEDFIPLAEPVIGRDGSVINEVRITKGTMVMLPLFNINRSKFIYGEDAEEFRPERWLEDVTDSLNSIEAPYGHQASFISGPRACFGWRFAVAEMKAFLFVTLRRVQFEPIISHPEYEHITLIISRPRIVGREKEGYQMRLQVKPVE

SEQ ID NO: 11975 - protein, 350 aa, Listeria monocytogenes
MRAAVLYENNVIKAEQIDEATCGKDQVRVEVKAVGICGSDIHKMQTRWKYPLPAVMGHEFAGVITEIGSEVTNVAMGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 11976 - protein, 146 aa, Antirrhinum meonanthum
PKSYCSLETSRCLRKPLPSKFTIHGLWPDNYSWPLRDCKYTIQLPKLEDTAGLLDELDKDWPDLTKRRPRPNETPNKKFWISQWEKHGSCALSVYTFEEYFTETLKMKRRFNILGILGKNSMRPGDNVDPKKVVRSISKYTKHDVA

SEQ ID NO: 11977 - protein, 586 aa, Methylobacillus flagellatus KT
MHAAAFIQDLAVIMLVAGMVTIIFHRMKQPVVLGYILAGLILGPHTPPFAMVHDNHTIEILAELGIVFLMFSLGLEFSLRKLRAVGATAVVAALVEIIVMIWLGYEIGSYFGWSSMDSIFLGAMLAISSTTIIVKALDELNMKHERFAQMIFGVLIVEDILGIGIIALLSGIAATGQVSTLDAAITISNLTLFMVVALVLGIIFVPKLLEYVAGFKRDEMLLITILGLCFGFCLLVMKLDYSVALGAFMIGAIMAESRRIRVIERLIMPIRDMFSAIFFVAIGLMLDPAIIIEYAKPVIVVTLVIIFGKIFACTLGAMAAGNDGRTSLRVGMGLSQIGEFSFIIAALGLTLGVTSSFLYPIAVAASVITTLTTPYLIKAADPLSSALARNMPARISQFFRLYSDWLDSNNHLPGSDGAILAGIYRKLLLQVFVNLCMVSALFLGAVWLVNGYLISLPSPTRDIMWQQAVTWGGALLLAAPFLIAAFRKLQSLGLLIADHTTQGMMGNDCGRVQRFIAKAVNVLAVIGMTLLILALSHRIMPPLDVWIVVLLIVAGLVALLWRWFVLLHYRMQIALLETLSQEKEEH

SEQ ID NO: 11978 - protein, 479 aa, Candida glabrata CBS 138
MDSLLEKFNSKRTSTHEKPLQRARINEDFEQDNAFALDFDKRDYSPQYHFLYQYRLTVLKNRIREQCYKKWDAGFQLNGKEVVEKKNVLDIQGKEPCWCIGTIYREMKYKPNVLEEVMNDTYGTVDINPESYTDPDGTDEIMLEDESGRLILVGDMIAETPFITGTVIGVLGMEADAGTFQVLDLCYPKALPQEPMPAATSKGKIALVSGINISTTAQERVIKLQLLQEYLMGRLGNEEAVAQIGRLLICGDSIDFNPSSEDPGALVNKLDEFGKFLGNTLQSISIDIMPGANDPSDRTLPQQPLHKALFRENLGQYFDKVNANLLNLVTNPYVFSINGLELLTTAGQNITDICKYVIPAKSDTESTTNVSTDDTDAKCAKTTEHILDLMECTLKWQNIAPTAPDTLWCYPYKDRDPFILNKWPHVYIVGNQPYFGTRKVSLDGVEVVMISVPTFSETGQIVLLDLEDLSTEVVTIGSI

SEQ ID NO: 11979 - protein, 143 aa, Antirrhinum majus subsp. linkianum
PNSYCSLKTSTCRRNPLPLKFTIHGLWPDNYSWPLSDCGYDFTLPDITDKSLLKRLDRNWPDLTKRKNIRKPDKTFWLTQWEKHGTCALSVYTFDDYFRETLNMKRRFNILDMLQRKSMRPGDRVDPQEVARAISKVTKHEPE

SEQ ID NO: 11980 - protein, 393 aa, Atropa belladonna
MTTPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGIAEYQKLITRNPIFLERVEGVGIIGGDEALNWGLSGPMLRASGIEWDLRKVDHYESYDEFDWQVQWQREGDSLARYLVRIGEMTESIKIIQQALEGIPGGPYENLEIRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 11981 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 11982 - protein, 345 aa, Rhizobium sp. NGR234
MKKIAIIGDRFMLPDVFRDKIVAACGDGHDIRTLEQPWPDVPMEHGYAVEGMDGLKEYLGKPKEIVDFIGDAEILVTQLAPLSRAMFSELPRLKLVAVSRGGPVNIDMDAARDAGVRVVNTPGRNASAVAEFTIGAILAETRLIRVGHEALRKGEWRGDLYRADRTGRELSELTIGVIGYGNIGTKVVRLLRAFGTEVLVHDPYVQLSAEDRNAGVEHVSRDDLLARSDVVTLHPRVTAETRNMMNAETFAKMKPGAVFVNTARGPLCDYEALYESLVSGHLSSAMLETFAVEPVPEDWPLLKLPNVTLTPHIAGASVRTVTHAAEMAAEEVRRYIAGLPPVNPC

SEQ ID NO: 11983 - protein, 141 aa, Pediococcus pentosaceus ATCC 25745
MEQERILILIKPDGVSLGHIGEVITRLELKGYSIDALKVTQATEAQLQQHYEKLVNKPFFKEIETYMLEGKIVAMIASGTHVIDVFHRMAGATDPSEAAFGTIRGDLGREWPDGLLRNVVHSSDSIENAEKEIKIWFPELN

SEQ ID NO: 11984 - protein, 487 aa, Debaryomyces hansenii CBS767
MSFQKYINSDIDVSGHIVDRAHVELLEEFDKQNDYDLKAKERKYDKQFYSMYQYRLSILKQSVDNNALNKWGDGTKKVNGQTVTKRDKILDISSGQLCWVSGTIFSDMKNKLNILQDVENGVDDVLPKVPETYTLSEVKEMPVVMLEDESGRAILNNDDFLKKNILVTGCIVAILGIEIQAGIFEIMDVVYPSVSPQKPLVAPKKENSKIAFVSGLKLCDEANHDIKIELLKQYLTGELGCNTDTQAASYISRLVIAGDSIAPIEETVDDDFFTTNNYGSKNISKFNTDSLKSLDKFITDLLPSVPISIMPGNNDPAEICLPQQPLHKSIFLSNKRYVGGSTLQTLTNPTWMEVQESGLRLLGTSGQNISDILKYLTAETLTDPQVVLTIMESNIKWQNIIPTAPDTLYCYPFDNADPFTLADETPHVYFVGNQKLYHTKTINLQKDHDNHETAQITLISIPDFSQTGQIVLLDLTTLECELVSFNI

SEQ ID NO: 11985 - protein, 232 aa, Bifidobacterium longum DJO10A
MDKAQQDALKKAAGIEAAKLVENGMIAGLGTGSTVKFLVDELGRRHQEEGLEFTGVTTSRRTQVQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 11986 - protein, 251 aa, Fucus vesiculosus
MASRDDLVYMAKLAEQAERFDEMVDHMKAVAQQPKELSVEERNLLSVAYKNVIGSRRASWRVISSIEGKDTVSDQLPLIRDYKSKIETELTDICADILKIIEAELIPNSTSEEGKVFYYKMKGDYHRYLAEFQSADERKTSASDALDAYQLASDHANQDLPPTHPIRLGLALNFSVFYYEILNSPDRACGLAKAAFDDAIAELDTLSEESYKDSTLIIMQLLRDNLTLWTSDQGEAEEAPGNADGTVVEDL

SEQ ID NO: 11987 - protein, 1033 aa, Oryza sativa
MERARRLANRALLRRLLAAAASTTSPAPSRGISTLAKAPGAGSRPRAPRPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 11988 - protein, 151 aa, Brassica napus
  misc_feature (9)..(9): Xaa can be any naturally occurring amino acid
  misc_feature (11)..(11): Xaa can be any naturally occurring amino acid
  misc_feature (18)..(18): Xaa can be any naturally occurring amino acid
  misc_feature (21)..(21): Xaa can be any naturally occurring amino acid
  misc_feature (29)..(29): Xaa can be any naturally occurring amino acid
  misc_feature (34)..(35): Xaa can be any naturally occurring amino acid
  misc_feature (38)..(40): Xaa can be any naturally occurring amino acid
  misc_feature (47)..(49): Xaa can be any naturally occurring amino acid
  misc_feature (53)..(53): Xaa can be any naturally occurring amino acid
  misc_feature (57)..(59): Xaa can be any naturally occurring amino acid
  misc_feature (67)..(68): Xaa can be any naturally occurring amino acid
  misc_feature (79)..(79): Xaa can be any naturally occurring amino acid
  misc_feature (82)..(82): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(106): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(127): Xaa can be any naturally occurring amino acid
  misc_feature (135)..(135): Xaa can be any naturally occurring amino acid
  misc_feature (142)..(142): Xaa can be any naturally occurring amino acid
  misc_feature (144)..(144): Xaa can be any naturally occurring amino acid
  unsure (1)..(151): unsure at all Xaa locations
MASSMLSSXAXVTSPAQXTMXAPFTGLKXSAAFXXTRXXXNDITSFXXXGGRXSCMXXXPPVGKKKXXTLSYLPDLTEXELXKEVDYLLRXKWIPXVEXEXEXGXXYREHGSTPGYYDXRXWXMGKXPLFGCTDXAQVLKEXQXCKTEYPN

SEQ ID NO: 11989 - protein, 99 aa, Arabidopsis thaliana
MKLLFTSAFTQMFGYSNHMDQASNCQSTRNKIIKMMKKEEFPSGFQVPLHYPKYSKSDYEVMDDLRLDLLLKQYGFSFEGSLEDKRVFAIESFLWPDQL

SEQ ID NO: 11990 - protein, 543 aa, Alkaliphilus metalliredigenes QYMF
MKIQFFGAAKVVTGSNVLISTDKHKILLDCGMFQGSNELEALNYEPFQYDPKEIDFLLLSHTHIDHSGRIPKLVKEGFNGKIFCTKATKDLSEIMLVDSGHIQQSDVEWENRKRKRSGKPPIKPLYTVEDALSSLRYFDSVLYNQKINLNESISVRFRDAGHVLGSSIIELWITEEKDTVKIVFSGDLGMKNKPLIRDPEIIDDADYLILESTYGNRVHENVEQRMDELMSTINKTVLRGGTVIIPSFAVGRTQELIYELSQYYKANNELDAFMRIPIYIDSPMAISATEVFKKNSYCFDDETKKLILGGSNPLDFENLHFVRDHKESMRLNESNYPKVIISASGMCTGGRIRHHLKHNLWKANNSLIFVGYQAQGTLGRILKDGAKKVKLLGEEIAVLSEIYSIEGFSGHADQTDLIEWLGHFKKKPKRVFLVHGEDTSLDNLSSLIKEKFDIPTIIPNMGYSFQIEDDVLKAFSGEMLEPVQQKENIKKELQQVYNQFESLVSKTDRFMDDKVLKKEYDELRNKLFDLQRELLDISMLLGE

SEQ ID NO: 11991 - protein, 251 aa, Burkholderia pseudomallei K96243
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLAAVLAVLSQDEAARIVVAYEPVWAIGTGRSATAEQAQQVHAFLRGRLAAKGAERVSLLYGGSVKADNAAELFSQPDIDGGLIGGASLKSGDFLAICRAAQ

SEQ ID NO: 11992 - protein, 300 aa, Symbiodinium sp. CS-156
RIGRQVARIAMKDPETELKLINASYDSDYLAYMMKYDTIHGKYDGTVEADGDSLVVDGQKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNTIPSSTGAAKAVAKVIPEVKGKLTGMALRVPTIDVSVVDLTVELEQDTTYEEICAEMKKRSEGDMKGFLGYTDEALVSTDFETCPISCTFDARAGIMLDPTFVKVVC

SEQ ID NO: 11993 - protein, 404 aa, Oceanospirillum sp. MED92
MPVIRKSNKLINVCYDIRGPVLQEAKRLEEEGQRILKLNIGNPAPWGFEAPEEIVQDVILNLPASQGYCDSKGLFSARKAVMQECQKNGIKNVGIEDIYIGNGVSELIVMAMQGLLNDTDEMLIPAPDYPLWTAAVSLSGGNPIHYHCDEEKDWAPDIEDMRSKITERTKGIVVINPNNPTGAVYPKPVLEQIIELAREHNLIVFADEIYDKILYDEAEHTSMASLADDVLCISFNGLSKSYRAAGFRSGWMIVSGPKHNARDYIEGLEMLSSMRLCSNVPTQHAIQTALGGYQSVNELIVPGGRLYEQRNLAWEMLNEIPGVSCTKPEGALYMFPKLDPDVYPIKNDEKMALDLLLQQKVLIVQGSGFNLPDTQHFRLVILPREDELRDAIERIATFLKTYEQ

SEQ ID NO: 11994 - protein, 300 aa, Polarella glacialis
RIGRQVARIAMKDPEVELKLVNASYEADYLAYMMKYDSIHGRYDGTVEVDGDSLVIDGHKVALSHTRDPAEIPFAKYGADYVCESTGVFLTTEKIQAHLKAGAKKVVFSAPAKDESHTIVMGVNQETYKPEMQAVSCASCTTNGLAPMVKAINDAFGIKRGLMTTIHAMTASQPTVDGASKKDWRGGRAASGNIIPSSTGAAKACALVIPAIKGKLTGMAFRVPTIDVSVVDLTCELEKATTYEEICAEIKRRANGDMKGYLGYCDESLVSTDFETCPISSTFDAKAGIMLDSTFVKLVA

SEQ ID NO: 11995 - protein, 320 aa, Oryza sativa (japonica cultivar-group)
MPADDDDASYLLCAEDAGAAVFDVAVDISTCTTEDDECCSVGGEELYSAASIAELIGGEAEYSPRSDYPDRLRSRSIDPAARAESVSWILKVQEYNGFLPLTAYLAVNYMDRFLSLRHLPVFVLFPSMQEGQGWAMQLLAVACLSLAAKMEETLVPSLLDLQASTVECSRYVFEPRTICRMEFLILTALNWRLRSVTPFTFIDFFACKHISNAMVQNANSDIQFLDHCPSSMAAAAVLCATGETPSLAFVNPELAVNWCIGLAEEGISSCYQLMQQLVIGNVQRSAAAAAAVNLFSDEGLSYDSSSPPPPKRRKRSPPGT

SEQ ID NO: 11996 - protein, 313 aa, Rhizobium sp. TAL1145
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 11997 - protein, 145 aa, Antirrhinum graniticum
PKSYCSLTTTTCRRNPLPSRFTIHGLWPDNYSWPLNECGFDFDLPVIKDKGLLRKLDKKWPDLTKRKRKPIRDADKKFWMSQWVKHGTCALSVYTFDDYFQETLKLKSRFNLLKILQDSQIRPGDLVDPALVVQAIKKYTKHVST

SEQ ID NO: 11998 - protein, 475 aa, uncultured bacterium 582
MTLITPVLLAGGYGTRLWPTSRKGYPKQFSKLLGDETLFQSSAKRLVSSQTVQFDAPITMTNSDFRFIVVEQLQRASVDPGAVLIEPEGRNTAPAVLAAAIYASNRNPDANILIAPSDHIIPDTLAFHAAICKGVKETANGRIVTFGITPTRPETGYGYLELSAPSSGCAVPLKRFVEKPDLASAKAMLDAGTYLWNAGIFLFRAKDMIAAFKALAPELIGPVSDAIEQGHADLGFFRLAAAPWTKCQNISIDYAIMEKINTLSAVPYSAGWNDLGEWDSVWLELGPNAEGVVTSENATAIECQDVLLRSENESQHLVGLGLENIIAIAMPDAVLVAHKSRAQDIKLVVSTLKTNGVPQAETFPKDHRPWGWFESLIIGGRFQVKRIHVLAGAALSLQSHHHRSEHWIVVEGTAKVTVDDNVTLLTEGQSTYIPLGAVHRMENPGKVPMVLIEVQTGVYLGEDDIKRYKDNYART

SEQ ID NO: 11999 - protein, 183 aa, Malus sp.
MASSMISSGTVATVSADRPAPAQARMVAPFTGLKSSSASPVTRKSNDITSIASNGGRVQCMQVWPPLGLKKFETLSYLPPLSTESLAKEVDYLLRKNWVPCLEFELEHGFVYRENHRSPGYYDGRYWTMWKLPMFGCTDSSQVLKELEEAKKAYPQSFIRIIGFDNVRQVQCISFIAYKPAGF

SEQ ID NO: 12000 - protein, 415 aa, Frankia sp. CcI3
MEFTQSDKLADVCYDVRGPVLDEATRLEAAGSRILKLNIGNPAPFGFSAPPEVLEAVVANLADAQGYSDSKGLLAAREAVVRYHLRKGVTGIDPGGVYLGNGVSELIMMSLQALLNNGDEVLLPAPDYPLWTAVVSLCGGRPVHYLCDESAGWAPDLDDIAAKVTPRTRAIVVINPNNPTGAVYDRQVLENIVEVARRHHLMLLSDEIYDRILYEDAEHIATAALAPDLVCMTFNGLSKSYRLAGFRAGWMVMSGPRGHASSYIEGVNILANMRLCANAPGQFATVAALTEDGGAGDLVLPGGRLREQRDTVVKLLNDIPGVSCVPPRGALYAFPRLDPAVYPIRDDERFVLDLLLAEKILLVQGSGFNWPHPDHVRIVTLPAVDDLTDAIGRIDRFLASYKRPSQQQCPSQRRN

SEQ ID NO: 12001 - protein, 477 aa, Corynebacterium glutamicum ATCC 13032
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 12002 - protein, 255 aa, Rhizobium sp. NGR234
MSKSRLWVGTSWKMNKTLSEAIAFADGLAAADAKRDDRIQRFVIPPFTVVREMKERLKETSVKIGAQNMHWEDAGAWTGEISPLMLKDCGLDLVELGHSERREHFGETDRSVGLKTAAAVRHGLVPLICIGETLAEREAGEADAVLKRQVEGAFALLDGAAKQAPILLAYEPVWAIGVNGIPATADYADARHQRIAEVAEAALGVAVPVLYGGSVNPGNCEELIAQPHVDGLFIGRSAWEVDGYLDILERVAGTI

SEQ ID NO: 12003 - protein, 376 aa, Fucus vesiculosus
MADEDVQALVVDNGSGMCKAGFARDDAPRAVFPSIVGRPKHPGIMVGMDQKDAYVGDEAQSKRGVLTLKYPIEHGIVTNWDDMEKIWHHTFYNELRVAPEEHPVLLTEAPLNPKANKERMTQIMFETFNVPAMYVNIQAVLSLYASGRTTGCVLDSGDGVSHTVPIYEGYALPHAINRLDLAGRDLTDNLMKVLTERGYSFTTTAEREIVRDIKEKLTYVALDFDQEMKTAAESSQLEKSYELPDGNVIVIGNERFRCPEVLFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 12004 - protein, 196 aa, Arabidopsis thaliana
MSAIKITNVAVLHNPAPFVSPFQFEISYECLNSLKDDLEWKLIYVGSAEDETYDQLLESVLVGPVNVGNYRFVFQADPPDPSKIQEEDIIGVTVLLLTCSYMGQEFLRVGYYVNNDYEDEQLKEEPPTKVLIDKVQRNILSDKPRVTKFPIDFHPEEEQTAATAAPPEQSDEQQPNVNGEAQVLPDQSVEPKPEES

SEQ ID NO: 12005 - protein, 341 aa, Agrobacterium tumefaciens str. C58; identical to SEQ ID NO: 212

SEQ ID NO: 12006 - protein, 273 aa, Nostoc sp. GSV224
MLEDLQIAFIGGGTMGEMIISRLLSTKIVPKADLIIVSDPVSARCLHLEREYGVRTTTSNIEAVLGVSIVILAVKPQILAEVLGMLKDKIPPNALVISIVSGASISSLCQGLNHPAVVRTMPNIAVQVGHGTTVWSASSSVTEIQRSHTQIILQALGKEFATQNEHYLDMATALSSAGTGFVFLYIEAMIDAGVQMGLTRTQAQELTLHTIAGSVELMFQTHEHPAVLRNKVTSPGGVTAAGLYELEKGGMRTVISNAVLAALSRTQQLGNIS

SEQ ID NO: 12007 - protein, 115 aa, Arabidopsis thaliana
TTVRFTSNVSEDTDYGRPIPQNSNHKVTLTQLRQQHRQRVPISMGTAYEYPSAVHIDTAGINVCLVGHSPAMDVHGYDTTLPISLKEMLVHCRSVARGAKRPRLVGDLPFGTYES

SEQ ID NO: 12008 - protein, 271 aa, Ustilago maydis 521
MPALIALVAAVAGVLTLSRAASLRQSAFALPSNTTLDTCLSCSTAPTCPLDPCVTNTPGGLLLLTQFWDFAPAIGPSDAWTIHGLWPDTCNGGFDQYCDPSRNNNNIASVLRSSSSPQAADTLDAMNQFWLALNGNDGQLWSHEWNRHGTCVSTLAPSCYTQSTYVENQDIVDFFSTTVSLYEKYDIYHTLAQAGITPSTSQTYTLDQLHAATSAQWGKDAVFRCRNGALNEAWVYFHTKGRSTTADAFVLSDPLRSNNRCPQTGIRYLPK

SEQ ID NO: 12009 - protein, 265 aa, Streptococcus pneumoniae TIGR4
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRAEDSELFYQLLAKAGLLVELGESLIDAATGLAGCGPAFVYLFIEALADAGVQTGLPREIALKMAAQTVVGAGQLVLESQQHPGVLKDQVCSPGGSTIAGVASLEAHAFRGTVMDAVHQAYKRTQELGK

SEQ ID NO: 12010 - protein, 252 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 12011 - protein, 239 aa, Triticum aestivum
  misc_feature (10)..(10): Xaa can be any naturally occurring amino acid
  unsure (1)..(239): unsure at all Xaa locations
GKGDKEFLAXIRLEMNYNPEKFKLSQPLMEVLGVEVDTRARVIAALWQYIKAKKLQNPSDPSYFMCDPQLKKVFGEDKMRFAMLSQKISQHLAPPPPINLEHKIKLSGNGANSSACYDVLVDVPFPLQKEMTAFLANTEKHKDIEACDEVISASIKKIHEHRRRRAFFLGFSQSPVEFINALIASQSKDLKLVAGEASRNIERERRADFYNQPWVEDAVIRYLNRKPPGGNDGPGAGGS

SEQ ID NO: 12012 - protein, 321 aa, Yersinia pestis CO92
MSESKMRLVVTDQAFGNTVYEQAAANAVGADFAAYQCRTEDETRDAVQGADVVLNNFAPMTERVMAAMPPGAVIVRYGVGVDNIDLSAARKRGMRICNVPDYGIEEVADHAAAMTLALARKLGRYEAGIRSGRWEIDQMVDGVRSLRDTTVGLIGLGRIARAYATRMAVFGCRIIGFDPYVTETEARSAGIEPLPQDKVIASAHILSLHVPLTPETRDLIDTTAIARMPEGAILINCARGGLVNEVALIEALTRGHLSGAGLDVFEQEPLPADSALRKAPHLLLSPHAAFFSDASVKKLQQLASEEALRGLRGEPLRCPLT

SEQ ID NO: 12013 - protein, 336 aa, Porphyromonas gingivalis W83
MTKVGINGFGRIGRLVFRAAQTQNRSDIEIVAINDLIDVEYMAYMLKYDSVHGRFNGTVEVKDGQLIVNGKAIRVTAEKNPADLKWDQVGVEYVVESTGLFLTKEKSEAHLAAGAKYVVMSAPSKDDTPMFVCGVNTDKYVKGTKIVSNASCTTNCLAPIAKVLNDNWGMVGGLMTTVHATTATQKTVDGPSAKDWRGGRAAGGNIIPSSTGAAKAVGKVIPELNGKLTGMSFRVPTLDVSVVDLTCQLAKPAKYEDICAAMKKASEGELKGILGYTDEEVVSSDFIGETRTSVFDAKAGIALTDTFVKIVSWYDNEIGYSNKVLDLIAYMAKVNA

SEQ ID NO: 12014 - protein, 269 aa, Psychrobacter arcticus 273-4
MQAWVIGNWKQNPATSHDVDALLNELCTAISTTKQLSHNNSTRCQIMVAPSFLHLAAVSSRLKDTSVLCAAQDVSAYSASVGAYTGDCSAQQIADVGATWTILGHSERRQYHQESNDTLLQKMTHALTQELGVVFCIGETQAQYDAKQTLPVIDSQLAVVKKLIAEQPEVIDSLSTRLIIAYEPVWAIGTGKVPTVSEVSATHQYIKQTLAGFADSLSNMTVLYGGSVNADNADSFAADPMIHGALVGGASLKAESFLAIVTAFSKGSM

SEQ ID NO: 12015 - protein, 371 aa, Malus x domestica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 12016 - protein, 400 aa, Bartonella henselae str. Houston-1
MAFIADKLSHIKPSATIAVSQKARNLKVLGRDVITLGAGEPDFDTPENIKNAAIEAIRRGETKYTPISGIPELRQAISAKFKRENNLTYQPEQIIVGTGGKQILFNALMATLNKGDEVIIPSPYWVSYPEMVTLNGGIPVFLETKAEFSYKLQPQELEAAITHKTKWFIFNSPSNPSGAAYTHEELKKLTDVLIKYPHVYILTDDIYEHLTYEGFTFVTPAQVEPNLYDRTLTMNGVSKAYAMTGWRIGYAGGPQELIKAMDTIQGQQTSGTSSISQWAAVEALNGPQDFIAKNKTVFQTRRDLVVSMLNQAPGIECPTPEGAFYVYPSCAKLIGKKTPEGKVIAHDEDFVTALLEAESIAVVHGSAFGLGPAFRISYATSEKFLEEACSRIKHFCESLL

SEQ ID NO: 12017 - protein, 368 aa, Malus x domestica
MGKGGQSCNGMVRQAKPVEQENMAAWLVDVNTIKILPFKLPSIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVGPETTVLIIGAGPIGLVSVLAARAFGAPRIVIVDMDDKRLAMAKSLGADEAVKVSTKMEDLDDEVAEIKEAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 12018 - protein, 300 aa, Gymnodinium simplex
RIGRQVARIAMKDPETELKLINASYDADYLAYMMKYDTIHGKYDGSIEVDGDSLVIDGKKVALSHTRDPAEIPFGEHGADYVCESTGVFLTTEKVQPHLKAGAKKVVFSAPAKDDSHTIVMGVNEDTYKPEMECVSCASCTTNGLAPAVRVLQEKFGIKRGLMTTCHAMTASQPTVDGTSKKDWRGGRAGPGNIIPSSTGAAKAVAKVIPAVKGKLTGMALRVPTIDVSVVDLTCELEKETTYEEICAEMKRRAEGDMKGFLGYTDEALVSTDFETNPISCTFDSKAGIMLDPTFVKVVC

SEQ ID NO: 12019 - protein, 337 aa, Acidovorax sp. JS42
MKILVVETEEWEHRACQRLLPGHKLVCRSNALGPDEPTADNDAEVITPFVHSRLTAEVLAQFPRLRLIATRSTGYDHIDLDYCRAHGIAVSNVPDYGDATVAEHAFALLLAVSRHIVTGAERTRRGDFSQHGLRGFELRGKTLGVLGTGRIGRRVIEIGKGFGMKIVAYDLFPDAAVAEHLGYEYLDLHVLLSQADVVTLHVPATPQTHHLLGDPEFAAMKKGAVLINTARGGVVDTSALVRALSARKLRAAGLDVLPAEPLIREEAEIFRNDRRNSDTDLRALLADHVLLRFSNVIVTPHVAYDTDEALRRILDTTIANIEAFARGQPRNLVLARD

SEQ ID NO: 12020 - protein, 197 aa, Zea mays
  misc_feature (116)..(116): Xaa can be any naturally occurring amino acid
  misc_feature (140)..(140): Xaa can be any naturally occurring amino acid
  misc_feature (171)..(171): Xaa can be any naturally occurring amino acid
  unsure (1)..(197): unsure at all Xaa locations
MSAYCGKYKDELIKNAAYIGTPGKGILAADESTGTIGKRLSSINVENVEENRRALRELLFCCPGALQYISGVILFEETLYQKTKDGKPFCDVPQGGSVLPGIRLTRGTIELVGTDXRKHHPGHDDLGKRWRKYYEAGARXFAKGGAVLKMGPMNHQSLHRPDVQGLVPFAXICQENGLGQLLTPKPLGGPPRIGPWA

SEQ ID NO: 12021 - protein, 633 aa, Oryza sativa
MAICMSNFYVSIYLVYCEPFNLKHLVFVLIHYYAIVSWVSGRTLPAYHGDNRFLLGACFLSKLPMLRPMKLSLVCSANPNNHRSRSSDITRHQKGGSARRKSKPYQEKDDSENIDEFDTDIMSSKNGPPISLTSNSRPQATSVPGEREKEIVELFKRVQAQLRARGKGKEEKKPEQAKAQGERGSVDSLLNLLRKHSVDQRRKSGDEKEQSVDQTKRSNESGNKQNSSIFIKNDTQEEQKKPHPAAFKRPASNFRRRSPVPNVKFQPVTNVDAERVINNINDAVQEAKPTLENKAATDEPDSVSTFEPNSVIEPENLSLDDLDHISDDEPDASDTDEPSGEYDEPSLQIPSVPIIDESHDTTLKSSLGGPDLSTLKVTELRELAKSRGIKGYSKMKKNDLSQGTDWEDFLGIVCLPIINSTISFIKENNAGDAAAALMSRLALKTKVLRDEQWQELDASTLVPGDIISIRFGDIVPADACLLEGDPLKMNCHTPFMRKMSITGIQLSLVNPFLSPKEPGTIVFTGSTCKHGEIEAVVIATGIHSFFGKAAHLVDSTEVVGHFQKLCVFFSLSQRMQGLPQSFHQNMNHHCLDLGCLDGLVEGGAVYDGGGGFPSILYTRIIIGQCTTLIFACS

SEQ ID NO: 12022 - protein, 718 aa, Aspergillus nidulans FGSC A4
MSLEHTKKVYTLNTGDKIPAIGLGTWQSKPNEVREAVKNALLKGYRHIDTALAYGNEAEVGQGIKDSGVPREEIWITTKLDNTWHHRVTDGINSSLKDLGVDYVDLYLMHWPSSTDPNDLKKHLPDWDFIKTWQEMQKLPATGKVRNIGVSNFGIRNLEKLLNDPSCKIVPAVNQIELHPNNPSPKLVAYNSSKGIHSTGYSCLGSTNSPLYKDPTLLKLAEKKGKTPQQVLLVWGIQKGWSVIPKSVSKSRIDANFEIDGWSLTDEEINELDNLKDRFKSILRFAYAKAYKAVRAKIPEPAQQVSLRVQPVYARITPQQPVNRAAAIRQARSRYFSTRASGPFASYFKAAVQGDKTAYRSSRIAGNISRLTSRAPFASTLRPNLTGGTLGRTAGGYVIGAGRIGGARYFSHGPAAPAQVIHNVSVGVRAFFLSGQKARFDGIDPITGNKKFKVVSALQDEAERKMTAISRAAPGSFIDFKISPTITAFGLQKQFAPAGDESDTLNTEGLLDFLSADFARAVKDFAAILNDLKRLAALGDLPISLQDRSTIRVRFPGCDAETVERLCDEVGVQRGKVGQDADFDINTGAELALLFPFAPSVAPSSDTDIFFFHKEAQPQQPEEVDWQAMLSSEDVTQTSLGYAKLSNHDLSFDDMTMFGSNPWARSPSGYSSIGVSELGDRAFFPDTVSYSIPESLSGCEGSDGIRRFIAECDQAAAH

SEQ ID NO: 12023 - protein, 481 aa, Pseudomonas aeruginosa
MIPVILSGGSGSRLWPLSRKQYPKQLVALTGDDTLFQQTIKRLAFDGMQAPLLVCNKEHRFIVQEQLEAQNLASQAILLEPFGRNTAPAVAIAAMKLVAEGRDELLLILPADHVLEDQRAFQQALALATNAAEKGEMVLFGIPASRPETGYGYIRATADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCDLYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 12024 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 12025 - protein, 267 aa, Synechocystis sp. PCC 6803
MSIQLGIIGGGVMAEAILARLIAEKTYAPEEIIVGEPHGARRDYLQKTYQVRVSPDNQEAANVSEVLLLAVKPQVLDRVLASLAGGANRPLVISILAGVSLQRIQKGFPDHAIIRAMPNTPATVGAGMTAIAANKMVEPDQLAKAKAIFSAVGNVVEVPENLMDAVTGVSGSGPAYVALMIEALADGGVLAGLPRAIAQKLALQTVLGTAELIKETEEHPAQIKDKVTSPGGTTIAGVAVLEKMGFRSAIIEAVRAAYRRSQELGKK

SEQ ID NO: 12026 - protein, 323 aa, Acinetobacter sp. ADP1
MSNLTLAQYLQQKNGNLTPELAQVIETIANSCKKIDHAIQKGALADLLGSAGNENVQGETQKKLDVLSNDFLIDALKVHPHVGGLASEELDEFTPGQQDGKYLVLFDPLDGSSNIDINMCVGTIFSILPAKNSITQTQDFMQAGTEQVAAGYVLYGPSTMMALTCGEGVAFFTFDPESQTFILTSDAIQLDADTQEFAINASNQRHWEEPVKRYIDELLAGKTSVRGKDFNMRWVACMVADIHRILCRSGIFMYPYDLKDPSKAGRLRLMYEANPMSFLIEQAGGSATTGRVRIMDIQPNDLHQRVPVIIGSKNEVDLVTSYH

SEQ ID NO: 12027 - protein, 431 aa, Vibrio parahaemolyticus RIMD 2210633
MTKSSELYQKAQQTIPGGVNSPVRAFNGVGGSPLFIERADGALIFDADGRAYIDYVGSWGPMILGHNHAVIREAVIDAAQRGLSFGAPTEMEIAMAELVSELVPSMEQIRMVSSGTEATMSAIRLARGFTGRDKIMKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYVAPTGPVYQAGTLSGNPVAMAAGFACLNLLKEEGNEKRLASKTKQLADGFKSLAEKHGIPLVVNQVGGMFGFFFTDQETVTCYEDVTKCDIERFKRFFHLMLDHGVYLAPSAFEASFTSLAHGSKEIDATLEAADRCFAIIAAEAK

SEQ ID NO: 12028 - protein, 148 aa, Hyacinthus orientalis
AGGSCCCLLKSLISLFLAGISGAPQDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRRVREIVEQSWTAD

SEQ ID NO: 12029 - protein, 481 aa, Burkholderia vietnamiensis G4
MKLTFLGATETVTGSKYLVEHGSRRILVDCGLFQGTKNLRLRNWRTLPFAADTLDAVVLTHAHIDHTGYLPVLAREGFRGPVYCTAATAELCDIMLRDSARLQEEEADFANRHGYSKHHPAQPLYTLDDAQRALHLLKPVAFDECTSLGGGVSFRLLPAGHILGAASVVMHWDHKVLAFSGDLGRYNDPIMQPPRAPAHADYLVVESTYGDRLHPASDPEIELAAMFDKTFGRGGVVVMPCFTVGRAQEILHYIARLKASGRMARVPVFLDSPMATDVTEIYRHHILEHRLTVSEANALGHAATMIRSVDQSKAISDHHGPMVIIAGSGMATGGRVLHHLARYAPDPRNTIALVGYQAAGTRGAALAAHEPTVKIHGEYVRVRAQIESITTLSAHGDYEDVLKWLGTMQGAPVRTFVTHGEPAAADALRRRIADTLHWTCEVPVYEQCVDLNEGDEMGGRDEGGTAAAPADGTQQPAARSS

SEQ ID NO: 12030 - protein, 346 aa, Burkholderia vietnamiensis G4
MKALVYHGPGRMALEQRPKPELQSPTDAIVRVTRTTICGTDLHILKGDVPTCEPGRVLGHEGVGVVEQVGAAVDALKPGDRVLISCISSCGRCEYCRRGLYSHCTTGGWILGNRIDGTQAEYVRIPHAQTSLYPIPAGADEDALVMLSDILPTGFECGVLNGKVQPGCSVAIVGAGPIGLAALLTAQFYSPGQIIMIDPDSNRLDIARRFGATDCVDGRSGDAAADVMKLTDGIGVDCAIEAVGIPATFELCTSIVAPGGVVANVGVHGVKADLHLEKLWDRNIAITTRLVDTVSTPMLLKTVRAGRLDPAQLITHRFALDDVEGAYDTFGRAAQTHALKVIIEVS

SEQ ID NO: 12031 - protein, 803 aa, Magnaporthe grisea
MAHCQDRGSNSRRGSLAHGTFEDEELSLSLTAIDPRNTAATTTRTTPTQHRRDDSNGRPRPKHSHSHSRRHSQHAQHQNQHQNQDQNQQSPPSAMPPTVHRGGGGGGPNAMPADGSTSSKIRVDQRISAYEISKTLGEGSFGKVKLAVHKGTKQMVALKIISRKRLASTDMAGRVEREIEYLQLLRHPHIIKLYTVIKTDNEIIMVLEYAGGELFDHIVTNGRLSEDEARRFFQQMLCAVEYCHRHKIVHRDLKPENLLLDDNLNVKIADFGLSNIMTDGNFLKTSCGSPNYAAPEVISGKLYAGSEVDVWSCGVILYVLLVGRLPFDDDHIPTLFSKIARGTYVVPHWMSPGAAALIKKMLVVNPVNRATITEIRQDPWFTTELPEYLQPPIEPFFNTGIDPEKAIRPSDIAPNAPPKVQEKLHAEVTDKISKTMGYGKQDVLDALEAEEPSAIKDAYMIVRENKMMQSNPALGGDNPFFATTPLGDENGSTGIMETMDSAMSASGHDPNASPMTSMSVRSATSSTLSAALAYQRPYTSKIGILPSSLPAYHNAYMESEKSGTAQDVPDMMALNEPPAPARTPAEQEETARRLRPHARSSQSAADSKPQSLTPSNAPKKTKPTRWQFGIRSRNAPFEALLCIYKALKKLDCSWKIDRDYHKVHGDENEKHRSRGDAGTPYILPADPWHIEARWETGPLRTHSVMTDPKNSAAFPGGKVRVQKKHSNNSSEDDDEEANATYEVIAMRLSIQIYEMESGVYLVDFKCAGYELPDGRLMEEKDVTSPFPFLDLAARLIIQLADAD

SEQ ID NO: 12032 - protein, 306 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIQDM

SEQ ID NO: 12033 - protein, 527 aa, Arabidopsis thaliana
MGKKNGSSSWLTAVKRAFRSPTKKDHSNDVEEDEEKKREKRRWFRKPATQESPVKSSGISPPAPQEDSLNVNSKPSPETAPSYATTTPPSNAGKPPSAVVPIATSASKTLAPRRIYYARENYAAVVIQTSFRGYLARRALRALKGLVKLQALVRGHNVRKQAKMTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 12034 - protein, 448 aa, Listeria monocytogenes str. 4b F2365
MAKHRYLPMTEQDEKEMLDVIGVKSIDDLFQDIPEKIRFKRDYDLKPAKSEPALLRELSKLASKNANTTEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNESLLDEGIIGGYDLGFYEEKYENHMLVAVTEMRTKEEIDAFVASLEGAK

SEQ ID NO: 12035 - protein, 482 aa, Listeria monocytogenes str. 4b F2365
MPLVFERSIPGRIGFSLPESDVPETKASDYFEQAYIRSVPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEEGYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 12036 - protein, 172 aa, Zea mays
MDSTFIMIKTDGVQRCLIDEIISRFEKKGFYLKDLKLVNVERSLDDKHYNNLVSKSFFQGLECYIISEPEVCMVWEDKSVVTTVRKIIGATNPLTSETGTIRGDFAGDIGRNVIHGSDSIDSANKEIALCVPEGPGDCQSIQHPCIYYNQTCIASHHILTDRGSMSPLVLSQ

SEQ ID NO: 12037 - protein, 82 aa, Populus x canadensis
TLLKPNMVTPGSDAPKVANEVIAQFTVRALQRTVPAAVPAIVFLSGGQSEEEATRNLNAINKLKTKKPWSLSFSFGRALQQS

SEQ ID NO: 12038 - protein, 307 aa, Akashiwo sanguinea
RIGRLVFRAASANSDVTIKAVNDPFMDLKYMVYQLKYDSVHKQFPGTIATKEEDGKEFLVINDVPIRIFHEKDPASIPWGEAGAEYVCESTGVFTQREKAELHIKGGAKKVIISAPPKDDVPIYVVGVNHKEYKTTDTVVSNASCTTNCLAPLTKVVHEKFGIVQGLMTTVHAMTATQLTVDGPSRGGKDWRGGRCASQNIIPSSTGAAKAVGKVLPSVNGKLTGMAFRVPTPDVSVVDLTCQLAKEASYDDIVAAIKEAAAGDMKGVLDWTEDEVVSTDFVSCKASSVFDVGAGIALNKTFVKLVS

SEQ ID NO: 12039 - protein, 101 aa, Populus x canadensis
TVVSIPNGPSALAVKEAAWGLARYAAISQDNGLVPIVEPEILLDGEHGIDRTFEVAQKVWAEVFFYMAENNVMFEGILLKPSMVTPSAECKDRATPEQVAE

SEQ ID NO: 12040 - protein, 300 aa, Amphidinium operculatum
RIGRQVARIAMKDPETDLKLINASYDADYLAYMFKYDTIHGQYDGTIEVDGDSLVVDGQKIALSHTRDPGEIPFGKEGAEYVCESTGVFLTADSVKPHLKAGAKKIVFSAPAKDDSHTIVMGVNEDTYKTSMTEVSCASCTTNGLAPAVRVLEEGWGVKRGLMTTCHAMTASQPTVDGTSKKDWRGGRAGPGNIIPSSTGAAKAVAKVIPAVAGKLTGMALRVPTIDVSVVDLTVELEKETTYEEICAEMKRRSEGDMKGYLGYTDEALVSTDFETCPISCTFDSKAGIMLDPTFVKVVC

SEQ ID NO: 12041 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 12042 - protein, 307 aa, Amphidinium operculatum
RIGRLVFRAASANPDVTVKGVNDPFMDLTYMVYQLKYDSVHGRFKGTIETKTADGKEFLIVNGNEVAVFHEKDPTAIPWGASGCDYVCESTGVFTAKEKAELHLQGGCKKVIISAPPKDAVPIYVMGVNHTDYKTSDTVVSNASCTTNCLAPLAKVVNDKFGLLEGLMTTVHATTATQLTVDGPSRGGKDWRGGRCASQNIIPSATGAAKAVGKCLPALNGKLTGMAFRIPTPDVSVVDLTCRLEKPAKYDDIVAAIKEAAAGPMKGVLDWTDEEVVSTDFVSCPSSSIFDVQAGIASNDTFVKLVS

SEQ ID NO: 12043 - protein, 153 aa, Arabidopsis thaliana
  misc_feature (106)..(106): Xaa can be any naturally occurring amino acid
  misc_feature (108)..(108): Xaa can be any naturally occurring amino acid
  misc_feature (114)..(114): Xaa can be any naturally occurring amino acid
  misc_feature (120)..(120): Xaa can be any naturally occurring amino acid
  misc_feature (126)..(126): Xaa can be any naturally occurring amino acid
  misc_feature (128)..(128): Xaa can be any naturally occurring amino acid
  misc_feature (133)..(133): Xaa can be any naturally occurring amino acid
  misc_feature (135)..(135): Xaa can be any naturally occurring amino acid
  misc_feature (137)..(137): Xaa can be any naturally occurring amino acid
  misc_feature (146)..(146): Xaa can be any naturally occurring amino acid
  unsure (1)..(153): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGIXCXREHGNXPGYYDXRYLAMXEXPFFGXTXSXKFLREFKDXRRPLGLN

SEQ ID NO: 12044 - protein, 300 aa, Heterocapsa triquetra
RIGRQVARIAMKDPEVELKLINASYDAEYLAYQMKYDSIHGRYNGTIEVDGDSLVIDGQKVALSHTRDPAEIPFKKHGAEYVCESTGVFLTTEKVQPHLKAGAKKVVFSAPAKDDSHTVVMGVNQETYKSSMECVSCASCTTNGLAPLVKCINDAFGIRRGLMTTIHAMTASQPTVDGASKKDWRGGRAASGNIIPSSTGAAKAVAKVIPEVAGKLTGMAFRVPTIDVSVVDLTCELEKATTYEEICAEVKKRAEGDMKGFLGYCDEDLVSTDFETCTISSTFDSKAGIMLDPTFVKLVA

SEQ ID NO: 12045 - protein, 307 aa, Heterocapsa triquetra
RIGRLVFRAAVSNPSISLKAVNDPFMDLKYMVYQLKYDSVHGRFAGTVEAKEADGKEFLVVNGTEIQIFHEKDPAAIPWGAAGADYICESTGVFTAQEKAELHIKGGAKKVIISAPPKDAVPIYVVGVNHLDYKASDTVVSNASCTTNCLAPLTKVVHEKFGIIEGLMTTVHAMTATQLTVDGPSRGGKDWRGGRCSSQNIIPSSTGAAKAVGKVIPSVNGKLTGMAFRVPTPDVSVVDLTVRLEKGAKYEEIVAAVKEAAAGPMAGVLDWTDEEVVSTDFTTCKASSIFDVGAGISLNDTFVKLVS

SEQ ID NO: 12046 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 12047 - protein, 152 aa, Hyacinthus orientalis
METGGKMKKGAGGRKGGGPRKKSVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKTASKEKEGAKSPAKAGRSPKKAAV

SEQ ID NO: 12048 - protein, 157 aa, Glycine max
MQASRARLFKEYKEVQREKAVDLDIQLVCDDSNIFKWTALIKGPSETPYEGGVFQLAFSVPEQYPLQPPQVRFLTKIFHPNVHFKTGEICLDILKNAWSPAWTLQSVCRAIIALMAHPEPDSPLNCDSGNLLRSGDVRGYQSMARMYTRLAAMPKKG

SEQ ID NO: 12049 - protein, 252 aa, Ehrlichia ruminantium str. Gardel
MKTMQQYIKLPSGYSLEHHEVLYSTNYEAIKLAQCGGNDGTIIISDKQIKGKGRNNRTWYSPQGNLYFSIIIRELSEVFHLPFISALSVGTTLEQILNKENNTNAKVQYKWPNDILVNSKKISGILLESNIEHNKSQEWVVIGIGVNIYHAPEYATTIQNNIPNISLSNLELLEKIIYNFDKLRKDYLNNGFSNIRNLWLKNTYHNFNDQITIQSCNNIYVGNFVTLDLNGSLVIEQDGQAVHITSGEIFNI

SEQ ID NO: 12050 - protein, 101 aa, Chlamydomonas reinhardtii
MAWRNSLSKSMQELRIHLCQTSAGSKGVRDFIVANYAEMKKANPHFPILIRECAGTEASLTARYDFGAEKSVNVQGATTGAVQQQLEQLILAGQSMPKSGE

SEQ ID NO: 12051 - protein, 380 aa, Debaryomyces hansenii CBS767
MSDSTTGKTIICKAAIAWEAGKPLTIEDIEVAPPKAHEVRIKILHTGVCHTDAYTLSGVDPEGAFPVVLGHEGAGIVESVGEGVDNVKVGDSVVALYTPECKECKFCKSGKTNLCGKIRSTQGKGVMPDGTSRFKCKGKELLHFMGCSTFSQYTVVADISVVAVNPKAQPDKTCLLGCGITTGYGAATITANVGEGDNIAVFGAGCVGLSVVQGALQRKAAKIIVVDINDSKKEWAEKFGATDFVNSAKLPSDTTIVDKLVEMTDGGCDFTFDCTGNVNVMRNALEACHKGWGTSVVIGVAAAGKEISTRPFQLVTGRVWKGAAFGGVKGRSQLPDIVENYMNGGLKVDEFITHRHELENINTAFDDMHAGDCIRAVINM

SEQ ID NO: 12052 - protein, 467 aa, Chlamydomonas reinhardtii
MRRQAVTCLRGLWRAGSASQEVANQAGASSFALQGLLAQTERGLRTSVDAKDAKIAPLSAMPWSLQAARSATAEALTPAKVNNFTLNFGPQHPAAHGVLRLVLEMQGEIIMRADPHIGLLHRGTEKLLEYKTYLQGLPYFDRLDYVSMMCMEHSYVLAIEQLLNVSVPLRGQYIRVLFSEITRVLNHLLAITCHSMDVGALTPFLWAFEEREKLFEFYERVSGARMHAAYFRVGGVSQDLPIGLLRDVYDWARQFASRLDEMEELLTGNRIWKERTVDVGTITAQMAWDWGCSGPILRASGIDWDLRKTQPYDAYGKMQFNVPIAGHGDCYDRYLVRLQEMRESLRIIYQCLNEMPDGLYKSPDGKVCPPSRSTMKQSMEALIHHFKLYTEGFHVPAGETYRAVEAPKGEFGVYLVSRGGNRPYRCKIRSPGYAHLQMTDVISRGAMLADVVTIIGTLDVVFGEIDR

SEQ ID NO: 12053 - protein, 152 aa, Hyacinthus orientalis
METGGKIKKGAGGRKGGGPRKKSVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKMASKEKEGAKSPAKAGRSPKKAAV

SEQ ID NO: 12054 - protein, 648 aa, Shewanella oneidensis MR-1
MEHGFLIQILLMLVIAIIAIALLRRIGLPAILAYLLTGVLSGPSGFHWFTQQQMQSVAELGVVLLMFTLGLEFSVPRLWAMRRTVFGLGSAQVFVTTVLTMLVALACGLNWRESLVIGAAIALSSTAIVLKLLNELGWLRRRHGELSVSVLLFQDLAVVPLLILLPLLGQSDEPLVLASIAWALLKGILAFFFLMALGKWALPRLFDEVARSRSNELFVLSTLVVALVTGAFTQWLGLSMALGAFMAGMLLGESQYRRQLEADIRPFRDLLMGLFFISIGMMLNFALVIQFWWQILLILLAVVFGKALIIHGLLRLVGEPFRIAISTALSLAQVGEFSFVVLALAVSYGLLSNETSTMLVMVAVLSMSIAPWLVRHCMDIAKWLLGIRQSGHVDDVVPVITDDHDLVVILGYGRVGQTIARFLKTEAVPYLVLDLDPTRVYEARRAGEPIYFGDVCKRAILKQIGIKHAKMIVITFCESRSVEEALPLCRQLAPEANILVRTRDDSELDLLQKAGANQVIPETLEGSLMLVSQVLHQCGVPLARILKRLESERRNHYQFLHGFFSGTETDFTLESLHAVLLHRGADAVGKQVADIDWELLRVELRAIRRSGQEIEHPASDWVFRAGDILLIVGKPRRLEKAEAKLLQG

SEQ ID NO: 12055 - protein, 479 aa, Agrobacterium tumefaciens str. C58
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRIAYIGSDGQSGV

SEQ ID NO: 12056 - protein, 335 aa, Cytophaga hutchinsonii ATCC 33406
MSKIKVGINGFGRIGRLVFRAAVNNPNIQIVGINDLIDVDYMAYMLKYDSTHGRFSGTVDVTDGKLVVNGNAIRVTAERDPANLKWNEVGAEYVVESTGLFLTMDTADKHIAAGAKRVVLSAPAKDDTPTFVMGVNNKSYTKDMTIVSNASCTTNCLAPVAKVLNDNFGILEGLMTTVHAATATQKTVDGPSAKDWRGGRGAYQNIIPSSTGAAKAVGLVIPQLKGKLTGMSFRVPTPDVSVVDLTCRLEKAASYETIKAAMKAASEGDMKGILGYTEDEVVSTDFLGDARTSIFDAKAGISLNDNFVKVVSWYDNEWGYSNKLVDLIVHMDTVK

SEQ ID NO: 12057 - protein, 496 aa, Arabidopsis thaliana
MASCDTPDAFAWLQTLPPLSLWKGNLMSMCICSPNSSHPSLNFTLTRTPQSPNFFTFSIVANFKTPITLFISKTFRTISTNSTTFLNENVISTLLMGFVDVVLNYNVKRTTCSIQLQNLGSTSNLKDVFNLAFFTFVFLICIYEAPTSLRTTCLKTVKDQLVTCRSRQGSKLLMVQLGSNLEEQWMRSLNLAITNWIIEIKAFQHLKSPSPLFSYAFSTQGLWKVHMYCPVVAMEMESVNSSLNDERLFFSLNYHQLEGVIQLNHRIYVREKWFNVAVNIDNVRCDIIRLVNEKLLSERGMGTEEKHFPSRISLQLTPTNQSNILMVSVQKSSENPLTEFEVEKGIEATIDPPNTFFGLKVSANETTTKSMKPWKFEEWVHGYSANLTWFLHDLDDGREVSSSKPSKVSMMNPRAWFKNRYSSAFRPFTKQGGVVFAGDSYGQSVLWKVDKTAIGKVMEFEVKGCVWLTYWPNKHHTFYSDTRKLEFKEMLYLNLP

SEQ ID NO: 12058 - protein, 399 aa, Pyrococcus horikoshii OT3
MRIPEEIIKLVDTPEFQRLRGVKQLGLANLVYPGANHTRFEHSLGTWYLARKLSLELQLPREDSLLIQLAALLHDIGHGPFSHTFERIYRDRLDFHDHMEVSRRIVEGKIQICEDGGELPDIISSLGYEPREVGELIVGKHKKRYLRMIIHGDIDVDQLDYLTRDAHYTGVAHGIIDLERLLTVMRVFNGELVIDEKGIEAVEGMLVARSLMYSRVYFHRTVKIAEGMLIRAVEFALDEGELEDFWKMTDDRLVIELEDLGDFPGDIIRRIRRRKLFKAAVIIGPEDLTAEEKKSLTTLYRSQKKRKKIESELAEIVGAREGEVMVELSIPELILSEPRLKQVEVNVLLSGGKVEPIGKVTPLASAIKRRQTPRWILLVATLPEYMEGVKRVWREVILE

SEQ ID NO: 12059 - protein, 337 aa, Oryza sativa (japonica cultivar-group)
MAASDVHHGGATPAAAATAVPCVTLNSGHAMPVLGFGTGSSTPPADLAATIAHAVRLGYRHLDTAAVYGTEGAVGAAVAEAVRCGAVASRGELFVTTKLSMADAHPPRVVAALRESLSRLGLDYVDLFLIHWPVAIGKKDAAGELTWDDLSRGLVPFDMEGVWRGMEECHRLGLARSIGVSNFSAAKMSRLLALAAVPPAVNQVEMNVGWRQEKVREVCGEGGVVVAAYSPLGAHGAHWGSDAVMNSGVLHDVAAARCKTIAQVALRWLYEQGVCMVARSFNEGRMKQNMDIFDWELSDQDKAMIAGVPQRRACHGNYFVSPDGPYKSLHDLWDGEI

SEQ ID NO: 12060 - protein, 502 aa, Staphylococcus epidermidis RP62A
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQDIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 12061 - protein, 107 aa, Zea mays
RFPPVRASPETMAPEKLGLKVERNPPEFPLFELGVPQWPKWGCEKNKFPWAYSPKETCFLFQGKVKVFPQGPGEEFLEIGAGDLFVFPKGINCPWGVTKAVAKPSHF

SEQ ID NO: 12062 - protein, 448 aa, Staphylococcus epidermidis RP62A
MSHRYIPLTEQDKNEMLNSIGAKSISELFDDIPTDILLKRNLNIAESEAETILLRRLNRLAAKNTTKETHATFLGAGVYDHYTPAVVDAMISRSEFYTAYTPYQPEISQGELQAIFEFQTLICELTDMDVANSSMYDGMTSFAEACILALSHTKKNKIVVSSGLHYQALQILHTYAKTRDEFEIIEVDLKGTITDLEKLEQLIDDNTAAVAVQYPNFYGSIEDLEQINNYIKDKKALFIVYANPLSLGLLTPPGTFGADIVVGDTQPFGIPTQFGGPHCGYFATTKKLMRKVPGRLVGQTQDDEGNRGFVLTLQAREQHIRRDKATSNICSNQALNALASSIAMSALGKQGIYEIAVQNLKNANYAKNKFEEHGFEVLKAQSFNEFVVKFNQPIKNINLKLAEYGYIGGFDLGEVSDDFKNHMLVAVTELRSKDEIDDFVTKAGELND

SEQ ID NO: 12063 - protein, 575 aa, Zea mays
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLKSCNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGKEVALVQSGKHPIWRSQSTHNIQVRKI

SEQ ID NO: 12064 - protein, 260 aa, Campylobacter upsaliensis RM3195
MIKAKKQYGQNFLHDKEILTKITQAIPKDVKKIVEIGPGLGDLTQELLKISPVKAYEIDADLIGFLRDKFQKELKEEKFILLHQDASELFCFDEDKYFLVANLPYYIASKLILQALEDENCQGLIVMVQKEMALKFCAKSGSSDFGTLGVLSAMICEREILFDVSPLCFNPPPKVVSSVMRLIKQKELKQICELDSFKSFLRICFKSPRKQLLSNLKAEKCKLLELFEDLGLKENVRPHELCVNSYLKIYEKLKDQYERK

SEQ ID NO: 12065 - protein, 384 aa, Burkholderia pseudomallei K96243
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRDFFRAGLANTRFALLPCAGTYFQCVDYSAISDLPEAEFAKWLTTEIGVAAIPVSAFYHEPHESGVVRFCFAKREDTLATALERLARL

SEQ ID NO: 12066 - protein, 328 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 12067 - protein, 256 aa, Synechococcus sp. WH 8102
MTWTARPHRCGGRQLALHDRRFRTDRLGTWNLRWLPVCSSTEISLAEWLQDEPNLVRPRAVVARRQRRGVGQRGRHWQSPTGGVWLSAAMPWPGQSVTAAGLLGLAVALELSNRLERQGVPVRIKWPNDLLVEGRKLAGVLPRLVHRGPQLRLVRCGIGLNVMNTVPIGAIALRELLPRSDASVEIWVGELLLSLERSLQLLAGSSAWLQLVEDRLWSDQVSSSDDGPSWTIDGLSPSGGLLLRRGQQRTEWIRWP

SEQ ID NO: 12068 - protein, 300 aa, Scrippsiella trochoidea
RIGRQVARIAMKDPEVELKLINASYDAEYLAYQMKYDSIHGRYDGTIEADGDSLVIDGHKVALSHTRDPAEIPFTEHGAEYVCESTGVFLTTEKIQPHLKAGAKKVIFSAPAKDDSHTVVMGVNQDTYESSMTAVSCASCTTNGLAPMVKAINDAFGIKRGLMTTIHAMTASQPTVDGSSKKDWRGGRAASGNIIPSSTGAAKAVAKVIPEVKGKLTGMAFRVPTIDVSVVDVTCELEKETSYEEICAEIKRRSEGDMKGFLGYCDEPLVSTDFETSPISSTFDAKAGIMLDPTFVKLVA

SEQ ID NO: 12069 - protein, 307 aa, Scrippsiella trochoidea
RIGRLVFRAAMGNPDVAVKAVNDPFMDLKYMVYQLKYDSVHKQFAGTIAAKEDGGKEFLVVNGVEIQIFHEKDPAAIPWGDAGAEYVCESTGVFTAKEKAELHLKGGAKKVIISAPPKDSVPIYVVGVNHKEYKATDTVVSNASCTTNCLAPLTKVVHEKFGIVEGLMTTVHAMTATQLTVDGPSRGGKDWRGGRCASQNIIPSSTGAAKAVGKVLPAVNGKLTGMAFRVPTPDVSVVDLTCRLEKPAKYDEIVAAVKEYAAGDMKGVLDWTDEEVVSTDFVSCKSSSIFDVGAGISLNDTFVKLVT

SEQ ID NO: 12070 - protein, 161 aa, Antirrhinum hispanicum
PDSNGQHLYNCKLDLDEESLGLNSSSTERLEASWPDLLKPEGEDMSFWISQYHKHGSCSQPLYDPQEYFLKALELKDRFDILTILEQGGIYPGKENSRSRVMSVINQATRGNPRLLCNMPKKKILREIVICTNIGGTRVIPCPFPNFRTCGPESNLHDLSN

SEQ ID NO: 12071 - protein, 241 aa, Saccharomyces cerevisiae
PKLVLVRHGQSEWNEKNLFTGWVDVKLSAKGQQEAARAGELLKEKGVNVLVDYTSKLSRAIQTANIALEKADRLWIPVNRSWRLNERHYGDLQGKDKAQTLKKFGEEKFNTYRRSFDVPPPPIDASSPFSQKGDERYKYVDPNVLPETESLALVIDRLLPYWQDVIAKLVGKTSMIAAHGNSLRGLVKHLEGISDADIAKLNIPPGTILVFELDENLKPSKPSYYLDPEAAGAAVANQKKG

SEQ ID NO: 12072 - protein, 370 aa, Psychrobacter arcticus 273-4
MSLNTIPEIIEDIRAGKMVILMDDEDRENEGDIIMAATHVRPDDINFMITHARGLVCLTLSQARCQQLALPLMSDRNEAKFSTNFTVSIEAAEGVTTGISAADRARTIQAAVSSSAKPEDIVQPGHIFPIMAQNGGVLHRAGHTEAGCDLARLAGLEPAAVIVEIINADGTMARRDDLEVFAKEHDLKIGTIADLINYRIANEQTVEEIAAHPFETEYGTFTLHRFREFGADETHLALVKGDVSQGVSTVRVHGFHPLRDLFAAKNDTTGRSGWSVRSALEEISTSERGVLVWIGNHEPTDLGDALDKASLNEAMSTITQQPYRSIGVGAQILRHLGVRDMRLLSSPMKFHALSGFDLNVVDCVHAPKQD

SEQ ID NO: 12073 - protein, 582 aa, Glycine max
MVLKSMVASASDLSLVSVAGNSPLDFKNRVFGGRLISLGFRFNKGSKCKGNERFNFEVRAAVEVGVERSKSKALEGGFGLDVVSEAELTVKGFAGLRKTKLVCTVGPACSSMEDLENLALGGMSVARLNMCHGTREWHRDVIRKIKKLNEEKGFCVSVMIDTEGSQIHVVDHGAPSSVKVEEGSNWVFTAEHYEGSRPFTVQTNYRGFSEGTEVGDELVIDGGMACFEVTEKTGNDLHCKCIDAGLFLPGAKFSFWRDGKLVRGNNKLPTLSTKDWADIDFGIAEGVDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQVKTII

SEQ ID NO: 12074 - protein, 827 aa, Oryza sativa (japonica cultivar-group)
MEAATANIFHLSLTFFFMVLLTLGTSAAGVASDTLSNGRNLTDGNTLVSAGGSFTLGFFSLGLPNRRYLAIWFSESADAVWVANRDSPLNDTAGVLVNNGAGGLVLLDGSGRAAWSSNTTGKSSSATAAQLLESGNLVVRERDQLNTGVFIWQSFDHPSNTLIAGMRLGNNRQTGDAWFLSSWRAHDDPATGDCRRVLDTRGLPDCVTWCGGAKKYRTGPWNGQWFSGVPEMASYESIFSSQVVVTPDEIAYVFTAAAAAGSPFSRLVLDEAGVTERLVWDPSSKVWIPYMKAPRGVCDDYAKCGAFGLCNEDTASTLFCSCMAGFSPVSPSRWSMRDTSGGCRRNAPLECGNGSTTDGFVPVRGVKLPDTDNATVDTGATLDECRARCLANCSCVAYAAADISGRGCVMWIGDMVDVRYVDKGQDLHVRLAKSELVNNKKRTVVKIMLPLTAACLLLLMSIFLVWLYKCRVLSGKRHQNKVVQKRGILGYLSASNELGDENLELPFVSFGEIAAATNNFSDDNMLGQGGFGKVYKGMLDDGKEVAIKRLSKGSGQGAEEFRNEVVLIAKLQHRNLVRLLGYCIYGDEKLLIYEYLPNKSLDAFIFDHANKYVLDWPTRFKIIKGVARGLLYLHQDSRLTVIHRDLKPSNILLDVDMSPKISDFGMARIFGGNQHEANTNRVVGTYGYMSPEYAMDGAFSVKSDTYSFGVILLEIVSCLKISLPRLTDFPNLLAYAWNLWKNDRAMDLMDSSISKSCSPTEVLLCIQIGLLCVQDNPNNRPLMSSVVSMLENETTTLSAPIQPVYFAHRAFEGRQTGENSISLLEGR

SEQ ID NO: 12075 - protein, 499 aa, Aspergillus nidulans FGSC A4
MAQQYKLPFELDNPDLLHFDSYVGNAWVTAKSGARFEVVDPGTDLPWASCPTNSAEDVDSAVQIAHDAFEKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITKTGTLTIDGQY

SEQ ID NO: 12076 - protein, 271 aa, Rhizobium sp. NGR234
MKHRRPTVADLLSIKGKRQLTMLRVVTLEEAEAAEKAGIDLVSVPPALLGHEFREAAPTVFAFPGLEYGDFITAEDYLRGAFQAMRAGGDAVYCAAGLSTVRRLREEGIPVCGHVGLIPSKATWTGGFRAVGKTADSALEIWRQVKALEEAGAFAAEIEVVPGEIAGAISQRTSLLMLSMGAGTGCDAQYLFAEDVLGQNRGHYPRHAKVYRDFAAEFERLQQERISAFREYAEDVRSGAYPEKVHLVGIVPAELEEFLSRIDTEGPIHTN

SEQ ID NO: 12077 - protein, 155 aa, Arabidopsis thaliana
MGLQGQLSDVSSDSIPLMLLSLLAVFINHLRSFLLRLTSKSNPNLPVDDVSIASGLANIIVLADQLSLNRLFSYRCGDGGGGGSDCVVCLSKLKEGEEVRKLECRHVFHKKCLEGWLHQFNFTCPLCRSALVSDDCVSKTQRSVGRDLISCFSLH

SEQ ID NO: 12078 - protein, 331 aa, Novosphingobium aromaticivorans DSM 12444
MSDPLYDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQRLG

SEQ ID NO: 12079 - protein, 951 aa, Pseudomonas fluorescens Pf-5
MTVNLSTANEFIARHIGPRQGDEQAMLNSLGFDSLEALSASVIPESIKGTSVLELGHGLSEAQALASIKAIAARNQLFKTYIGQGYYNCHTPSPILRNLLENPAWYTAYTPYQPEISQGRLEALLNFQTLISDLSGLPIANASLLDEGTAAAEAMTFCKRLSKNKGSHAFFASQHCHPQTLDVLRTRAEPLGINVVVGDERKLTDVSPFFGALLQYPASNGDLFDYRELTERFHAANALVAVAADLLALTLLTPPGEFGADVAIGSAQRFGVPLGFGGPHAAYFATRDAFKRDMPGRLVGVSVDRFGKPALRLAMQTREQHIRREKATSNICTAQVLLANIASMYAVYHGPKGLTQIAQRIHQLTAILAKGLVQLGLTVEQESFFDTLSLHTAGRTAALHDKARAQGINLRVIDAERLGLSLDETTTQADVETLWSLLADGKPAPDFAALAAAVTSGIPAALARQSAILSHPVFNRYHSETELMRYLRKLADKDLALDRTMIPLGSCTMKLNAASEMIPITWAEFGALHPFAPAEQSAGYQQLTTELEAMLCAATGYDAVSLQPNAGSQGEYAGLLAIRAYHQSRGDERRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLAPFLPGHAALENKKGAVCAAPFGSASILPITWMYISMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGALDKDDNPLKNAPHTAAELVGEWSHPYSREQAVYPVASLVEGKYWPPVGRVDNVFGDRNLVCACPSIESYQDA

SEQ ID NO: 12080 - protein, 905 aa, Saccharomyces cerevisiae
MNNQPQGTNSVPNSIGNIFSNIGTPSFNMAQIPQQLYQSLTPQQLQMIQQRHQQLLRSRLQQQQQQQQQTSPPPQTHQSPPPPPQQSQPIANQSATSTPPPPPAPHNLHPQIGQVPLAPAPINLPPQIAQLPLATQQQVLNKLRQQAIAKNNPQVVNAITVAQQQVQRQIEQQKGQQTAQTQLEQQRQLLVQQQQQQQLRNQIQRQQQQQFRHHVQIQQQQQKQQQQQQQHQQQQQQQQQQQQQQQQQQQQQQQQQQQQQQQQQQQQQGQIPQSQQVPQVRSMSGQPPTNVQPTIGQLPQLPKLNLPKYQTIQYDPPETKLPYPTYWSDKKADTDTLLYEQIIQRDKINKYSLIRETNGYDPFSIYGFSNKEYISRLWHTLKYYQDLKNTRMKSITSTSQKIPSASIWGNGYSGYGNGITNTTTRVIPQVEVGNRKHYLEDKLKVYKQAMNETSEQLVPIRLEFDQDRDRFFLRDTLLWNKNDKLIKIEDFVDDMLRDYRFEDATREQHIDTICQSIQEQIQEFQGNPYIELNQDRLGGDDLRIRIKLDIVVGQNQLIDQFEWEISNSDNCPEEFAESMCQELELPGEFVTAIAHSIREQVHMYHKSLALLGYNFDGSAIEDDDIRSRMLPTITLDDVYRPAAESKIFTPNLLQISAAELERLDKDKDRDTRRKRRQGRSNRRGMLALSGTSASNTSMNGVHNTVAAGNASSLPPGEILLPDIADIPRTFRTPVPSTLMPGGVDVGPSVESYELRNTTTYKSRPDRPKPVSPPCYIIDHIPGHSLLLSIKLPGKVNTKEEFAAAPNDTSSGTNAMLPSPESLKTKLNSNIRAGVTIPSIPNPIANHTVTNSPNPTLQPVIPGGAASKSVPTPSLPIAPPVAPHDSEATLLTNSNNGSSNNNTQNT

SEQ ID NO: 12081 - protein, 248 aa, Lactobacillus reuteri
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTKIIKKVVFESRASDIYLIVEEGFYKRTLDIHRTLGLLLHTQVSIQQLLKLPAECFHPKPKVNSVLIKLTRHTTDVPDKYWKLYKYFVSKWVNREYRQLFTKNQFYQAMKHAKVNNLSTITYEQVLSIFNSYLLFNGRKIIL

SEQ ID NO: 12082 - protein, 449 aa, Arabidopsis thaliana
MASSSLHFFFFLTLLLPFTFTTATRDTCATAAPDGSDDLSIIPINAKCSPFAPTHVSASVIDTVLHMASSDSHRLTYLSSLVAGKPKPTSVPVASGNQLHIGNYVVRAKLGTPPQLMFMVLDTSNDAVWLPCSGCSGCSNASTSFNTNSSSTYSTVSCSTAQCTQARGLTCPSSSPQPSVCSFNQSYGGDSSFSASLVQDTLTLAPDVIPNFSFGCINSASGNSLPPQGLMGLGRGPMSLVSQTTSLYSGVFSYCLPSFRSFYFSGSLKLGLLGQPKSIRYTPLLRNPRRPSLYYVNLTGVSVGSVQVPVDPVYLTFDANSGAGTIIDSGTVITRFAQPVYEAIRDEFRKQVNVSSFSTLGAFDTCFSADNENVAPKITLHMTSLDLKLPMENTLIHSSAGTLTCLSMAGIRQNANAVLNVIANLQQQNLRILFDVPNSRIGIAPEPCN

SEQ ID NO: 12083 - protein, 255 aa, Arabidopsis thaliana
  misc_feature (113)..(113): Xaa can be any naturally occurring amino acid
  misc_feature (124)..(124): Xaa can be any naturally occurring amino acid
  misc_feature (163)..(163): Xaa can be any naturally occurring amino acid
  misc_feature (202)..(202): Xaa can be any naturally occurring amino acid
  misc_feature (221)..(221): Xaa can be any naturally occurring amino acid
  unsure (1)..(255): unsure at all Xaa locations
LEVLHFPSSPSASHSSSSSSSSPSPSSLSYASRSNATLLISSDHNRRNPVARFDQDVDFHASIEEQDLRRRSSTDGGEEDDGGEDQISLLALLVAIFRRSLISCKSNRRGLCXSWRLGWPSNVXRHVAHVTFDRFNGFLGLPVEFEPEVPRRAPSASATVFGXVSTESMQLSYDSRGNCVPTILLLMQNWLYSQGGLQAEGXFRLTAENSEEEAVRGKLNXRGFIPERIDVHCLGGLIRGWFKELPTSVLDSLLP

SEQ ID NO: 12084 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 12085 - protein, 284 aa, Triticum aestivum
  misc_feature (68)..(68): Xaa can be any naturally occurring amino acid
  misc_feature (258)..(258): Xaa can be any naturally occurring amino acid
  unsure (1)..(284): unsure at all Xaa locations
VTLQNKFVQKSRLVPVRNSRDIVDPRVRTREWRRRRPSPPPASPPPPRPRSTTTTRTTSSASAAPAAXAQRLVAMAGSGKFFVGGNWKCNGTKVSISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTWERLLLPEQAXQEVHAAVPVIGGKNQCYPAGCCFLPV

SEQ ID NO: 12086 - protein, 88 aa, Brassica napus
MSSRSKAWLVAATIGAVEASKDQLGLCRWNYMIRSVNQRIRNNVRSAARANRFSSSSTIPRASCKDGDKAKQAEESLRTVMYLSCWGP

SEQ ID NO: 12087 - protein, 324 aa, Haloquadratum walsbyi
MNKTRSRLIEMLHDSSAPMSGPTLATRLNISRAAIWKHIEALRDAGFEIDSGPDGYYVASVTGYNGPAITFGLEASYRIEYADQYESTNDRARELAKMGTTDDVAVVADAQTGGRGRLDRQWSSPSGGIWVSLLLLHPHCSPAELPVYTFAAAVAVVRAVQQCGIDVNIKWPNDVLLSRDTPEINPSDGRKIAGILTETAGEADQVSWLIVGIGLNANVDSTALPPEATSLQSVIGAVDRRALLQRLLNSFAELTNPIDLDNIIDAWRTHSTTLNQRVRITTPRETIEGVAVDIQTPGALIVQTNNGIKTIHAGDCEHLRSTEK

SEQ ID NO: 12088 - protein, 509 aa, Yarrowia lipolytica CLIB122
MGTGKKEATRRAKGGETGNGFGNIRVKGVNFYRDAKKVKKLSMYKEGRAKHNARGEEVQAATFQSKEIPNARIDPNRRWFGNTRVIAQDALNHFREALGETKRDSYQVLLRQNKLPMSLLEENNKIPQVKVVETESYANTFGPKAQRKKPQLAVGDFAELASAADESQQDFEAKKEEDNSWKVDGWSQEAKEAIFHKGQSKRIWNELYKVIDSSDVVIHVLDARDPLGTRCTSVEQYIKKEAPHKHLIFVLNKCDLVPTWVAAAWVKHLSQDYPTLAFHASITNSFGKGSLIQLLRQYSALHPDRQQISVGFIGYPNTGKSSIINTLRKKKVCKTAPIPGETKVWQYITLMKRIFLIDCPGIVPPSQKDSETDILFRGVVRVEHVSYPEQYIPALLERCETKHLERTYEVSGWSNATEFLEKIARKHGRLLKGGEPDESGIAKLILNDFNRGKIPWFVPPPQAEDMENVKFAAGEGRLGEMKKREIHEAPAATETAEETKEEEFKGFDD

SEQ ID NO: 12089 - protein, 207 aa, endosymbiont of Riftia pachyptila
MRKPLVAGNWKMNGSLESVRELLEGLKSGIDAVSNAEVAVCPPYVFIPEVQKLLDGSAISWGGQDLSVEVSGAYTGEIAGSMLNDFGCKYAIVGHSERRSYHGESDELVAKKFAAARAGGLVPILCVGETLEEREQGITEDVCARQLDAVIDLVGVDGLACGVIAYEPVWAIGTGKTATPEQAQDVHAFIRGRIAEKSAEVAEGMRI

SEQ ID NO: 12090 - protein, 342 aa, Legionella pneumophila subsp. pneumophila str. Philadelphia 1
MTMKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 12091 - protein, 300 aa, Brucella melitensis 16M
MELPLEHALYPFSNNDGFQLQRSKGGTINMQDKVVLVGCGNMGFAMLRGWLDSGILKAGDVHVVEPAEALRERAALAHVHVYADAADLPADLQPRMVLVAVKPQMMANVLPAYKRFAPASTFVSVAAGIPVALFESHLGKDVAVIRCMPNTPAAIGKGMLVTFKNANVSDANEAFVTSLLKTSGKVASVDEEGLMDAVTAVSGSGPAYIFHFIEALTDAGVNLGLPRETAALLAMQTVMGAGALADASTDSPSKLREQVTSPNGTTAAALDVLMGGDRLKELVAEAVKAAHKRSVELGKS

SEQ ID NO: 12092 - protein, 837 aa, Magnaporthe grisea 70-15
MSERQVEAHRLLSEYPKTATPDVNSGLVTGTAIPRRNPRKTSPSVAFLSIVTAALLSLSFLFITCSSPATWTWLASTLHPSLQHAETGGAETGNAGAAADRYLIGVGKADITGPVVEINLMGYADPNQVGSGLRQRLYSRAFMVGDLAHPADRFVYLVLDTQSGDTAVRYGIISALQSLGPEYAHYGHHNVAVTGTHSHSGPGGWLNYLLPQITSKGFDHQGYRAIVDGAVLSIRRAHESLTPGYLYVGKTKVAGANINRSLFAYLANPEVERNRYNVSSEDDGSVEKEMTLLKFQRASDWRHLGILTWFPTHGTSMLGNNTLITGDNKGVAAYLFEKSMRYDVSAVPGVEFVAGFSQASVGDTSPNVKGAWCEDGSGLMCSFENSTCADGKAQACHARGPFFGRDDGGTASCFEIGMRQFKPARELYDKLLLSEGTRISGGMVKSFHTFHDMSRFEFAHPRNSSQIIRTCPAALGYSFAAGTSDGPGVFDFTQHDGDSSNTSPVWRAVSNMLKKPSDEQVACHAPKPILLDVGEVSRPYQWTPNIVDVQLFRVGQLAIIVSPGEATTMAGRRWKESVERAFVGFLDTERNDADGNEDSDSEQLSPIVVLGGPANSYTHYITTEEEYGIQRYEGASTLYGPHTLDAYINVTLSHLPYLFAGGKGSPGNGGSSPHHEDPSSFPPDNTNRSLSFITGVLRDGTKPFKSFGDVLTDVFSDEEKKMPKLHFRRGVDIVRAVFVGANPRNNLRLEETYASVEKLDVARGSVWKTVRTDADWTLVFRWRRVSSVLATSEAEISWETESWADPGVYRLRYFGDSKSLGGDIKPFEGTSSVFVLV

SEQ ID NO: 12093 - protein, 838 aa, Oryza sativa (japonica cultivar-group)
MQGKKESTVMEAATTNIFYRPVIFFSVLLCFQYRAAGVASDTLSNGRNLTDGDTLVSANGSFTLGFFSPGLPSRRYLAIWFSESADAVWVANRDSPLNDTAGVVVIDGTGGLVLLDGAAGQAAWSSNTTGSSPSVAVQLLESGNLVVRDQGSGDVLWQSFDNPSNTLIAGMRLGRNPRTGAEWSLTSWRAPDDPATGGCRRVMDTRGLADCVSWCGAGKKYRTGPWNGLWFSGVPEMASYSSMFANQVVVKPDEIAYVFTAATAAAPFSRLVLSEAGVIQRLVWDPSSKGWNTFAQAPRDVCDDYAKCGAFGLCNVNTASTLFCSCMAGFSPMFPSQWSMRETSGGCRRNAPLECGNGSTTDGFVPVRGVKLPDTDNATVDTGATLDECRARCFANCSCVAYAAADIRGAGGGSGCVMWTGDVIDVRYVDKGQDLYLRLAKPELVNNKKRTVIKVLLPVTAACLLLLMSMFLVWLRKCRGKRQNKVVQKRMLGYLSALNELGDENLELPFVSFGDIAAATNNFSDDNMLGQGGFGKVYKGMLGDNKEVAIKRLSKGSGQGVEEFRNEVVLIAKLQHRNLVKLLGCCIHGDEKLLIYEYLPNKSLEAFIFDPASKYALDWPTRFKIIKGVARGLLYLHQDSRLTIIHRDLKSSNILLDVDMSPKISDFGMARIFGGNQQEANTNRVVGTYGYMSPEYAMDGAFSVKSDTYSYGVILLEIVSGLKISLPRLMDFPNLLAYAWSLWKDDKAMDLVDSSIAESCSKMEVLLCIHIGLLCVQDNPNNRPPMSSVVFMLENEAAALPAPIQPVYFAHRASGAKQSGGNTSSSNNNMSLTVLEGR

SEQ ID NO: 12094 - protein, 366 aa, Bacillus cereus E33L
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSEEDAISYSLSGANLRCTGVNWDLRKDEPYSIYDRFDFHIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 12095 - protein, 814 aa, Oryza sativa (japonica cultivar-group)
MAYLPVLIYLLLISFCKCDDQLTQVNRLISPSGKLVSKSGVFALGFFSPATSNQSLFLGIWYNNIPERTYVWVANRDNPITTPSSAMLAISNSSDLVLSDSKGRTVWTTMANVTGGDGAYAVLLDSGNLVLRLSNNVTIWQSFDHPTDTILSNMKILLRYKEQVGMRLVAWKGLDDPTTGDFSCSGDPSSDLQVFVWHGTKPYYRSIVLDSVWVSGKAYGSSTSFMYQTYVNTQDEFYVIYTTSDGSPYMRIMLDYTGTFRLLSWNVNSSSWAIYSQRPAAIGDCDPYGSCGPFGYCDFTSVIPRCQCPDGFEPNGSNSSSGCRRKQQLRCGEGNHFMTMPGMKLPDKFFYVQDRSFEECAAECSRNCSCTAYAYTNLTITGSPGTTASQSRCLLWVGELVDMARNNLGDNLYLRLADSPGHKKSRYVVKVVVPIIACVLMLTCIYLVWKWISKGEKRNNENQNRAMLGNFRASHEVYEQNQEFPCINFEDVVTATNNFSDSNMLGEGGFGKVYKGKLGGGKEIAVKRLSTGSTQGLEHFTNEVVLIAKLQHKNLVRLLGCCIHGDEKLLIYEYLPNKSLDHFLFDPASKFILDWPTRFKIIKGVARGLLYLHQDSRLTIIHRDLKTSNILLDADMSPKISDFGMARIFGGNQQEANTNRVVGTYGYMSPEYAMDGVFSVKSDIYSFGVILLEIVSGLKISLPQLMDFPNLLAYAWRLWKDDKTMDLVDSSIAESCSKNEVLLCIHIGLLCVQDNPNSRPLMSSVVFMLENEQAALPAPIQPVYFAHRASETKQTGENTSSSNNNMSLTVLEGR

SEQ ID NO: 12096 - protein, 130 aa, Debaryomyces hansenii CBS767
MSGGKGKAGSSEKASTSRSAKAGLTFPVGRVHRLLRKGNYAQRVGSGAPVYLTSVLEYLAAEILELAGNAARDNKKSRIIPRHLQLAIRNDEELNKLLGHVTIAQGGVLPNIHQNLLPKKSAKGKASQEL

SEQ ID NO: 12097 - protein, 478 aa, Klebsiella pneumoniae
MTAPVQHPMYIDGQFVSGRGDGWIDVLNPATEALLSRIPDGTAEEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVRSGGAGGAGGAGGQPLEGKGYFYPPTLLLDVRQEMDIIHEETFGPVLPVVAFSTLDEALATANDSDYGLTSSIYTRDLNVAMKAIKGLKFGETYINRENFEAMQGFHAGWRKSGIGGADGRHGLNEYLQTQVVYLQA

SEQ ID NO: 12098 - protein, 616 aa, Bacteroides fragilis NCTC 9343
MKKLLLLLGSFLLSLTTYAAMNISKIDPPFWFTGMNNPELQLMVYGEGIGQASVSVNYPGVSLSSVVKLESNNYLLVYLHLDKEVKPGKMPITFTVGKKKLVKEYELKARSKAGVDHKGFDASDALYLLMPDRFANGNPDNDRIEGMAEYKVDRNDPNARHGGDLAGIEQNLDYFTDLGVTALWFTPVLENNMKGGSYHGYATTDYYKVDPRFGTNEEYRSLIAKAHNRGIKVVMDMIFNHCGVEHPWIKDMPSKDWFNHADFKNNFVQTSYKLTPHVDPYASEYDFDQMNNGWFVEAMPDLNQKNPHVYKYLLQNSLWWIEYADIDGIRMDTYPYADYDAMSNWMKELNEEYPNYNTVGETWVTEPAYTAWWQKDSKLSAPRNSHLKTVMDFSFFDKVNTAKNEQTDTWFKGLDRVYNNFVYDYLYPNPASVLAFIENHDTDRFLGEGENLDMLKQASTLLLTTRRIPQLYYGTEVMMNGVKSKSDGYVRKDFPGGWTDDKENALTPEGRTRLQNESYNFYRNLLNWRKGNDVIAKGSMKQFMVQHGVYAYARQYKGKTVFVLLNGTDKEVKLPLKYYAEVLKDKTQGKDVISGKVTALNEELTMAPRQSMVIEL

SEQ ID NO: 12099 - protein, 690 aa, Medicago truncatula
MSSVKKRESNGGTINRETEDQLIVTPLGAGNEVGRSCVYMTYKGKTVLFDCGIHPGYSGMAALPYFDEIDPSTVDVLLITHFHLDHAASLPYFLEKTTFKGRVFMTYATKAIYKLLLSDYVKVSKVSVDDMLYDEQDINRSMDKIEVIDFHQTVEVNGIRFWCYTAGHVLGAAMFMVDIAGVRVLYTGDYSREEDRHLRAAETPQFSPDVCIIESTYGVQHHQPRHTREKRFTDVIHSTISQGGRVLIPAYALGRAQELLLILDEYWANHPELQNIPIYYASPLAKKCLTVYETYTLSMNDRIQNAKSNPFAFKHISALSSIDIFKDVGPSVVMASPGGLQSGLSRQLFDMWCSDKKNSCVIPGYVVEGTLAKTILNEPKEVTLMNGLSAPLHMQVHYISFSAHADSAQTSAFLEELNPPNIILVHGAANEMGRLKQKLMTQFADRNTKILTPKNCQSVEMYFNSQKMAKTIGKLAEKTPEVGETVSGLLVKKGFTYQIMAPDDLHVFSQLSTANVTQRITIPYSGAFCVIQSRLKQIYESVEPSVDEESGVPMLLVHDRVTVKHESEKHVSLHWASDPINDMVSDSVVALVLNINRDLPKIVAESDATKIEEENEKKTEKVMQALLNSLFGNVKVGENGKLIINIDGNVAELNKESGEVESENEGLKERVRTAFRRIQSSVKPIPLSAP

SEQ ID NO: 12100 - protein, 171 aa, Hyacinthus orientalis
NYFTYRQHAPMGKAVATTIDHCNSAPAKGETMRCITSAEDMIDYLATSLVAKINITARSTDNSIQLGGNVLIGEVKAANGGKLGHVVSCHQAAFPYLLYRCHSVPETKLYEVEILDPETKAKISAATAICHFDTSVWSRDHVAFMALGYERGMEICQWVFPGAIAWTAATE

SEQ ID NO: 12101 - protein, 429 aa, Rhodococcus sp. RHA1
MPGGAHTYARGPDQYPDYMAPVLVGGKGARVWDVDGNSFVEYGMGLRSVTLGHGYAPVVDAVCAAISRGTNFSRPTELELHAAEDFLQLVPGADMVKFAKNGSDATTAAVRLARAVTGRELVAVCNQPFFSVDDWFIGTTAMNSGVPSDVAAKTRSFRFNDLNSLVSVFDENPHRVACVVMEAATATAEPTPGYLDAVRSLCDERGALLIFDEMITGFRWSQGGAQTEYAVTPDLSCWGKAMGNGFPISALAGKREYMEFGGLNTDHDRVFLLSTTHGPECGALAAFRAVVHAYATEDPISRMEQSGRRIAEGVGATAADMGIADYVQVIGRPSCLIFVTRDLNYQPSQEFRTLFLQELLSGGVLCQSFVTSAAHRSADVDLTLEVIHRALEIYSRAIESGGVAGFLRGRPVAPALRRYAAPRRTDTSD

SEQ ID NO: 12102 - protein, 326 aa, Aspergillus nidulans FGSC A4
MALKRTFKLNTGYEIPAVGLGTWQSKPSEVEEAVTAALNIGYRHIDAAAVYGNERDVGNGIKASGVPRGEIFLTSKLWNTHHDPENVEAAVDRSLSDLQTDYLDLYLIHWPVAFRYSTTTIQPVDEKTGLIDVIDVPIKDTWAAMEALVAKGKVRSIGVSNFNRRRIEELLKTAKIPPAVNQIEAHPYLQQRELLEWSKEKGILITGYSPLGNNIYNIPRTVDDPLVIEVAKFLNRTPAQVLISWAVQRGTAVLPKSVTPERIKSNFRDFILPEDAFQAIQSLERHQRMNFPARLGVDIFDEVGEESARRSALEWAEGQRLSKSQA

SEQ ID NO: 12103 - protein, 109 aa, Triticum aestivum
  misc_feature (75)..(75): Xaa can be any naturally occurring amino acid
  unsure (1)..(109): unsure at all Xaa locations
MAWRASLSRSLKEIRVLFCQSSPASAAAREFVKKNYGDIKARNPSLPFLVRECSGVQPQLWARYDMGVERCVNLXDGLTEAQIDKNWRTCQGRRVSLKPNSFGTSTCHV

SEQ ID NO: 12104 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVELGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 12105 - protein, 146 aa, Triticum aestivum
MKSLGLKIAASLKKNSGFPADGCLENDDTLSLKSTSVRAQDHPTTNSVIPVDSVVAAEIISTDLSCVVDTLSNEEDDAELDLDSPTEGFSSISEAIEDIRQGKLVIVVDDESRENEGDLILAASLVTPEAMAFIVRHSTGIVCVSM

SEQ ID NO: 12106 - protein, 370 aa, Methanosarcina barkeri str. fusaro
MKEIKFSENVARIDTSGIRKIFEAAGSDAINLGLGQPDFDTPEHIKAAAIKAINEGFTGYTVGPGIPELREALSSKFKEENGFSVSPEEIIVTSGASEALAIALAALLNHGDEVLISNPGFVSYNALTEILSGKAVGVPLAEDLTMKPEAVLEKITPKTRAIVFNSPSNPTGTVASRADIKALAEIADDYNITIISDEVYEYFVYEGEHVSPASYSDNVITVNATSKSYAMTGWRLGYVAARKDYIGQMLKVHQYFQACANSIAQKAAYAAVAGPKDSIKAMREEFRKRRDVLVKGLNDLGMECALPKGAFYAFPKVPNSTEVASKFISNGVIVTPGTAFGSEGDGHIRISYAASMKDIEKALGIMEKVL

SEQ ID NO: 12107 - protein, 448 aa, Magnetospirillum magnetotacticum MS-1
SHGSHDDHKTRIFTIRELEKKVKRPIAILADLQGPKLRVGDFVDGRARLEAGAVFRLDMDDALGTALRAPLHHPEVFAALKPGSELLIDDGKLRLAVESCGPDFAETRVVVGGEISNHKGVNVPNVMLPISPLTEKDRRDLEFAVEMGADWIALSFVQRPSDVQEARKLIAAYVGSRVRILSKLEKPSAIEHLASIIEWSDAVMVARGDLGVECPPETVPILQKRIIKACRRAGKPVVVATQMLDSMVHSPSPTRAEASDVATAVYDGSDAVMLSAETASGEYPMEAVTMMDRIIQQVEHDKNYLLITDASRLDPEHTTRDAISAAARQVAHTLGAAAIVTYTSSGSTTLRAARERPEQPILSVTADIEVARQMALVWGAHSIMAKDVRSFTEMVTKAVHFAQGEGFARVGDRVVITAGVPFGHSGTTNILRVAEVEDSGHHHKHESD

SEQ ID NO: 12108 - protein, 260 aa, Zea mays
MPQGDHIELHQKRHGKRLDHDERKRKREAREVHRRSKDARNLIGAKGKRFAKKRYAEKAQMKKTLKMHDESNKRQKVDDDVQEGALPPYLLDRDQTQRAKVLSNTIKQKRKEKAGKWDVPLPKVRPVAEEEMFKVLRTGKRKTKQWKRMVTKATFVGAGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 12109 - protein, 319 aa, Porphyromonas gingivalis W83
MAKILVAFNTVSEGFDRLTARHEVVFPPKGRDFTQEEIAERIVDCDVLCSVFDIPIGRDLIDKGRSLKLIANYAVGYNNIDVTYAASKGIVVTNTPRAVIEPTADLALALLLSCTRRIAEWDRLFRRDGEMVERGRLCRLGVNLYGKTLGIIGFGNIGAAVARRCKAFGMNVLYNKRTRLSEAEEKAQGITFADKDDLIRRADVLSLHTPLTPETKHLIGTAELSMMKPTAILINTARGAVVDERALVEALREKRIAAAGLDVFENNDIPSPELFAMDNVSLTPHVGTQTYDSRVEMVHELCDNVLGFLHGDRPISRVN

SEQ ID NO: 12110 - protein, 125 aa, Glycine max
  misc_feature (99)..(99): Xaa can be any naturally occurring amino acid
  unsure (1)..(125): unsure at all Xaa locations
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 12111 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 12112 - protein, 470 aa, Chlorobium tepidum TLS; identical to SEQ ID NO: 375

SEQ ID NO: 12113 - protein, 401 aa, Bifidobacterium adolescentis
MENVENGVQPQLSKRAQIANPFRAMVFGAMADEMIANGTDVVKLSLGEPDFGAPPAVRDAMREQYDGRPLPYTAAMGLPELRQAISDFYKERHHVDVDPKRIAITAGGSTALLLSAALTVNDDDEVLIADPSYPCNRELVRAFGGKVVDVPASAATRFHLTPELCKEYWTDRTKAVMITSPSNPTGTTIAFDTLKAVCDLARERGAWRIVDETYLDLADREPDGSDVKSVLACDPDAIVCSSFSKFFGMTGWRLGWMVVPEYALEAMDDLATNFFLCAHTPTQHAALACFTPETLAVCEERRQELLERRRIVVDGLAEIGLPLEVEPNGAFYAYFNISGTGLDAWTFCERALKEAHIALTPGRDFGEATADTHVRLSYAASREALREGLKRLGDFVAKVRG

SEQ ID NO: 12114 - protein, 399 aa, Pseudomonas syringae pv. tomato str. DC3000
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLIHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRLGLGWAKSHSFHTGQTPVMKYNRQLMQAIMWDRIKIADVVGVEVISLDDAPRGYGEFDAGVPKKFVIDPHGLFGGV

SEQ ID NO: 12115 - protein, 337 aa, Hordeum vulgare
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 12116 - protein, 458 aa, Methanosarcina barkeri str. fusaro
MSDFGGINIRIAMLSPIAWSTPPKKYGPWESIVSLLTEGLVKRGIDVTLFATADSHTAAKLHAVCPRPYEEDKDMIRKVYEGLHISEVFERAKEFDIIHNHFDYLPLTYSALVDTPVVTTIHGISSRKILPVYKKYNNKTFYVSISDAYRCRDLDYIATVRHGIDIGSFYFNEKPQDYLLFLSRLHKDKGVREAIEVAKKTGRKLRIAGFIADQAYFEKEVQPHLDNKQIIYEGHVDPEFKKELLSNAYALLHMINYEEAFGIGVVEAMASGTPVIAMNRGSMPELIRDGETGFLVNSVEEAAEAVQKLGSISRKKCRENVEKRFSVDRMVDDYIKVYETILEKCKREEERPWGFYEVLRQRPGYKVKSLTVLPQGEISLQRHFHRSEHWYIISGEGLVVKNGNEIRVLPGDSVDLPVNEIHRIKNIGSQNLVFIEIAQGDYIGEDDIERLEDKYGRV

SEQ ID NO: 12117 - protein, 530 aa, Oceanobacter sp. RED65
MEFIWIVIAFACGFIAKQVNMPPLVGYLLAGFGLHAYGVEPHDNLETLANLGITLMLFTIGLKINIRSLLKPTVWAGSVIHMSSWVVVGSLLLKGFAMFGVTMLEGLSGESLLLIAFALSFSSTVCVVKLLEDKTEMKANHGKLAVGILIMQDIVAVGFLVLATGKIPDVYALALLLLWPARKPLGLLLTKAGHGELLPLVGLLLAFGGYELFNAVNLKGDLGALIAGLMLSQHTKANELAKSLLNFKDIFLIGFFLNIGFAALPTVDMLMPLLVISFILIIKGVLLFHILALLKAPGRSMFLGSMILTNYSEFGLIVMYLCVENSWISNEWLVIVAMAVSISFVFTSIFYEYAHRAYAFMRIYVKRFERQRPKPLYHEQLKQAEVLVIGMGRVGRSSYDVLHHYLGDKVWGVESDADKARRHQDAGRHVIIGDAEDADFWETRELWHIKLIMLAMPSITDMKDITQQLKLCNFTGQVAAIARYEDERRALVDYGVDNVFNHYAEVGAGFAEECLTLIAPESKSQQEVSP

SEQ ID NO: 12118 - protein, 469 aa, Bacillus clausii KSM-K16
MKLFINGEWVSEELDVFDVVNPATGEVVGSVPKGGAKEAKVAADGAYESLPAWAERSAYERSAILEAWHDLIAEQKEELARLMTMEQGKPINEARGEIAYANSFIKWYAEEGKRIYGETIPASSPDKRLFVVKQPVGVVAAITPWNFPAAMITRKVAPALAAGCTVLIKPASQTPLTALKLAELAEKAGLPKGVLHVVVGSTSDISKAWQEDERVRKLTFTGSTEIGRTLMSEAGQTVKKISLELGGHAPVLVFEDADIDNAVQETIASKFRNGGQTCVCANRIYVHESIAEAFITKMKQAVEQLKVGNGLNEETDIGPLIDEEAVDKVLTHIRDAKDKGAEVLTGGNSSDGLFIEPTVIAGVTDDMACMSEETFGPLAPISTFKTEEEVVKRANDTIYGLAAYLFTTDLSRGIRVAEKLDYGVVGLNDGGPSVAQAPFGGFKQSGIGREGGHEGLEEFLESKYVSLKM

SEQ ID NO: 12119 - protein, 190 aa, Brassica napus
  misc_feature (41)..(41): Xaa can be any naturally occurring amino acid
  misc_feature (52)..(52): Xaa can be any naturally occurring amino acid
  misc_feature (99)..(99): Xaa can be any naturally occurring amino acid
  misc_feature (154)..(154): Xaa can be any naturally occurring amino acid
  unsure (1)..(190): unsure at all Xaa locations
WLPLCFPAAAVVTSPAQATMVAPFTGLKSSAAFPVTRQSKXNDITSIASNGXGELAGMKVWPPVGKKKFETLSYLPDPYRKLNGGKEVDYLLRNKWIPXCLNSSWEAPGFVYPWSTESTPGILTMGRYWDNVGSFPCSGCTGLCSKWLKEVQEXKRSTPNAFIRIIGFDNNRQVQCISFIAYKPPSFTGA

SEQ ID NO: 12120 - protein, 477 aa, Methanosarcina mazei Go1
MEIPDHKTKIVCTIGPASSSEEMIRKLMLAGMNVARINFSHGDFESHSRVVRIIRKVADELGRTIAILADLPGPKIRIGKLEKEPVMLHKGNPITLTIDDTPGNEERIPVSYKQLPESVTPGSLIYLSDGFIQLLCKEVTGKDVLCEVLIGGELYSHKGLNLPGAKIFLDAVTEKDFRILEFALEEDIDTFSISFVENAEDIRKVRNFAASRGKQVNIVSKIERRQAVENIGEILDETDALMVARGDLGVEIPIQEVPSVQKELIQRAKLLGVPVITATHMLASMTDNIRPTRAEATDVANAILDGTDAVMLSEETAVGNYPVEAVEMMAKIAKTTENWRSRTKWGLDTMIKSITAREMSVDEVITLQVYEALQKLPVAAVLTPTRSGATPRRISRFNPDPWILAFSRVPKTCRFLSLSYGVYPVAVNESIESWEKETTERTKELGFAKSKDLVIFTQGPASGKPGGTNMLKILTLD

SEQ ID NO: 12121 - protein, 347 aa, Bifidobacterium longum DJO10A
MSETMKAAIFVEPGKMTVEEVPKAMLEQDDDIVIRVVRTCVCGSDLWFFRGLSGQAAHSQVGHESIGVVEEVGAAVESVKPGDFVVVPFPYSCGKCPVCKAGFESVCPHGGYFSACQAEYLRVPEADGTVVKVPGSPEDYSDEQLASLLTISDVMSTGYHAAVSAEVKPGDTAVVMGDGAVGLCGVIAAKMRGATRVIAMSRHEDRAALAREFGATDIVPERGQEAIDKVLEMTGGYGADAVLECVGSKQSFDTAIGLIRRGGVIGRVGLPHDVEISAEGTFYGNIGIKGGPAPVRHYDLDEGLLDAVLKGEINPGRVFTAEYDLDHIQDAYEAMDQRKVIKALIRF

SEQ ID NO: 12122 - protein, 266 aa, Psychrobacter arcticus 273-4
MTTLSTLNKFKKDGTKFTCLTCYDAMFARMMEKAQIDTILIGDSLGMVVQGHDSTLPVTVDDMAYHTANVARSNKQALILADLPFMSYVTLPEAIANSRKLMQVGAHVIKIEGGSELCELVTMLAQAGTPTCVHLGLTPQSVNVFGGYKVQGRGDEAGQKLLDDAKAVVNAGAALLVLECVPAELAKAVTEAVAVPVIGIGAGADTDGQVLVMHDMLGMAHGRTPRFVHDFLTDERNTEHSIEGAFALYQQSVKEGSFPKEQHQFS

SEQ ID NO: 12123 - protein, 128 aa, Synechocystis sp. PCC 6803
MIATPLAQAATTPSHLPTETRPWGSFTTLEEGNGYKIKRIEVNPGHRLSLQMHHHRSEHWIVVSGTARIVCGDKEELLEPNQSTYVPQCTAHRLENPGVIKLVLIEVQNGEYLGEDDIIRFQDDYARG

SEQ ID NO: 12124 - protein, 542 aa, Zea mays
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAAGQLSACSSFPCHQAEQEAIMRSIPSSQRGLTLRDFRKMEYLSQVIDETLRLVNISFVSFRQATRDVFVNGTSPRSGTGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 12125 - protein, 151 aa, Methanosarcina acetivorans C2A
MNMEQTYVMVKPDGVQRGLVGEVISRIEKRGLKILALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIGKYSRVDEVCLYE

SEQ ID NO: 12126 - protein, 349 aa, Cytophaga hutchinsonii
MAGGIGSRFWPFSRTKYPKQFHDVLGTGATLIQQTVNRFKNICPPENIIIVTNKDYVGLVKEQLPFLQDHQILAEPIGRNTAPCLAYASYKILQRDKNANIVVAPSDHIILQEKEFENVIVEALQATEQADILITLGMKPTRPDTGYGYIQYIDEKKLRIKKVKTFTEKPALELAIKFIESGEFVWNAGIFIFNAQTIVDAIKKHLPEMDEVFTEGSGLYWTDKENDFINKAYSRCGNISIDYGIMEKSDNVYVMLADFGWSDLGTWKSLFENMPKNDDGNVIDGNVLTYDAKDTIIKTPKNKLVVVEGLEGYIVAEFDDVLMICRKENEQRVKDFVSDVKATQDKRFV

SEQ ID NO: 12127 - protein, 452 aa, Magnaporthe grisea 70-15
MATAQAAYAAEKAVGHQEGGITRQDVSDYTETGDPSRTMKALVWMGKNKVEIADMPRPKIIEPKDVILKVTGSTVCGSDLHLLHGSVIQMNKNDILGHEFCGIVDEVGPEVTKCKPGKRYVASFQIACGECFFCKQKLSSQCERTNDNTIAKAMYGNQTAGMFGYSHFTGGFAGGQAEYVRVPFGDVNLLEIPDDVPDEKALYLSDVLPTSYNAVKDTAVYPGDTVAVFGAGPIGQMAGYWALLEGAEKVIFVDTEPRLSYIQERFNAEQKAKTTCIDYKKLSSGITNKETVVSKLKEMCGGRGPDCAIECAAGEYAKGWAHWLEMTLGAETDTSEILNEMIEGVRNYGRVGVTGVYVGYTNHFNIGSLMQRGVRLIGNGQAPVHKYWEELLARIQSNDFDPLQMLSHRVRLEDLDKVYYKFEKREDSMQKIFVETKFSLPRATGTPELTTY

SEQ ID NO: 12128 - protein, 483 aa, Vibrio vulnificus YJ016
MNLNYPELFQQRCYIDGQWVAESGQTQAVTNPSTGKVIGEIPVFGEQQAKECITAAQAAFELWKKTTADYRADVLRRWYELMMVNIDDLAAILTLEQGKPFTEAKGEITYAASFVQWYSEEARRAYGEIIPSHRENGKIVVTKEPIGVVAAITPWNFPAAMITRKAAPAFAAGCSMVLKPAQETPFTALALAKLAEDAGLPKGLFNVITGDSRSIGGVFTSDKRVRKVSFTGSTNVGKILMNKSASTIKKLALELGGNAPFIVFEDADIDAAVEGAMIAKFRNAGQTCVCANRLFVHHAVYDEFAEKLANRVKQLKVGDGFADGVAIGPLINSSSVAKVQEHVDDAVAKGAKVLCGGLLNDEQLFVAPYVLTDMSDDMLVAEEETFGPVAPLFRFKDEAEVLERANDTESGLAGYFYTRSLGRAWRVADALEVGMVGINEGLISTAAAPFGGIKESGLGREGSRHGMDEYMEMKYMLMGGLDS

SEQ ID NO: 12129 - protein, 530 aa, Burkholderia pseudomallei K96243
MTDLATKPTPAASHGTLPRILPVILAGGSGTRLWPLSREHHPKQLIDLIADESPLSATARRLTGIANAELADALLLVCGEQHRFTSAAQVSARGLDARILLEPAARNTAPALTLAALEALAHHGDPVLAAMPADHAVSDTRAFQETIALAARYAQDGAIVTLGVLPRRAETGYGYIKVGAPLAGANGDTGGYAIDSFVEKPHQELAQQYLQSGDYWWNSGIFVVRASTWLAAIRALQPDMHAACEAAWRGGTSEGAFFKADAAAFAACPSDSIDYAVMERLTGARALGIPGVIVPLTAGWSDVGSWDAIWELLPKDEAGNVARGEVLFEGTEDSFARSEGRLVACVGLKDVVVVETPDAVLVANKHRVQDVKTVVARLKSGRHEQVRDHRKVQRPWGYYDSIDRGERFQVKRIVVDPGKQLSLQMHYHRAEHWIVVRGTAKVTRGDETFLLSENESTYIAVGAVHRLENPGRIPLEIIEVQSGDYLGEDDIVRFDDRYGRASTQHAPDAAKPADAERAPAAGPARALGAQ

SEQ ID NO: 12130 - protein, 711 aa, Oryza sativa
MATTVATAMRRRRNLTPCDSRLATAVPLLVAFLLLLHAPPLAEAQPLPWQMCDTAGGNYTEGSTYQANVRALASALPVNASSSRALFAKGAAGAAPDVVYAIALCRGDTNASSCAACVATAFQDAQQLCAFNRRATMFDDPCILRYSDQDILANATDGQGNFIAWNYNNVSAARAAAFDAASGRLVNATAGYAAADPVRRFGTGEVGFDDATYPRIFSLAQCTPDLSEADCRSCLGRIIRWVPQYFAGKPGGRVFGVRCNFRFESYSFFSGRPLLQLPGPPPAPAPSPANMAPPSPPGTMGGRTRHRTGRVLAITLPIAGAILALIVLTCFCFWRRRTPARKASPVPYSTNPDDIQSIDSLLLDLSTLRAATDNFAERNKLGEGGFGIVYKGVLPEGREIAVKRLSQSSRQGIEELKTELVLVAKLRHKNLVSLVGVCLEEGEKLLVYEYLPNKSLDTILFDYEKSKDLDWGKRLNIVSGVARGLQYLHEDSQLRVVHRDLKASNVLLDFDHNPKISDFGLAKLFEWDQTQDVTSHIAGTYGYMAPEYAMRGQYSVKSDAFSFGVLIIEIVTGRRNSSFSNSEQSIDLLSLVWEHWTTGTIEELLDPAIGSRAVNVLLKLINIGLLCVQDNPADRPAMSAVNVMLSSDTVSLQAPSRPTFSIQEMDGAADTDLYESGAYPRSAFQPTGDGNTRAAAAASPNELSLSELEPR

SEQ ID NO: 12131 - protein, 137 aa, Brassica napus
  misc_feature (127)..(127): Xaa can be any naturally occurring amino acid
  unsure (1)..(137): unsure at all Xaa locations
MGCVDLINLTSTNIYRPVLTRTSNKPYITRGPSMAAIRAESVATEKLGIFIEKNPPESKLTQLGVRSWPKWGCPPSKFPWTYDAKETCFLLEGKVKVYPDGSDEGVEIEAGDFVIFPKGMSCTWDVXVAVDKHYQFE

SEQ ID NO: 12132 - protein, 89 aa, Zea mays
MAGAAKASWMVAMSVGAVEALKDQAGLCRWNYALRSIHRTAKARANVRGGVSQGARQLPASAAVAEKRRAEKTEEGLRTVMYLSCWGPN

SEQ ID NO: 12133 - protein, 575 aa, Gibberella zeae PH-1
MSPAIQNINSPITAAWWKEASVYQIYPSSFKDTNGDGIGDIPGIIEKLDYFKQLGVDIIWLCPIYPSPQIDMGYDVADYRDIDPQYGTMADVERLIEGLHSRGLKLLMDLVVNHTSDQHKWFQESKSSRDNPYRNWYIWRKPRYDEDGQRHPPNNWLSYFRGSAWEYDPASDEYYLHLFAKEQPDLNWEHAPVREAVHEIIRFWLDKGVDGFRKSEGLPDAPITVLGSEYQFGHDHYACGPRLHEYLRDIGSILKEYDAFSVGEMPAVQDPEEIIKSVGESRGELNMIFNFEIVDMDHGDQGKFSAKKWEMKELKMIVNKWQTFMYNNKGWNALYLENHDQSRSISRWVSDKPVYREMSAKMLSTFLCFQSGTVFVYQGEELGMANMPPDWEMTEHRDVETLNHWEELKRTTGSDAKVLELARKEYQLKARDHARTPVQWDSSPNAGFTTGKPWIRVNDDYQQWNAATQTNTKGSVFDYWRSALSLRKELKDIVVYGDFELLDAENSDIFAYARSDGKQKLIVVCSFRDREIAWPVPASTGLQSSKVLLSNYPEIDLSQDVISIRPFEAFVCLVG

SEQ ID NO: 12134 - protein, 260 aa, Gibberella zeae PH-1
MPQNEYMERWRKLHGRRLDHEERVRKRTAREGHKASQDAQNLRGLRAKLYQQRRHKEKIQMKKQIKAHEERNVKTADEKDPTTPMPSYLLDRTNPSTAKALSSAIKNKRAEKAAKFAVPLPKVRGISEEEMFKVVKTGKKIQKKAWKRMVTKPTFVGPDFTRRNPKHERFIRPMGLRYKKANVTHPELGVTVQLPIISVKKNPQNPLYTQLGVLTKGTVIEVNVSELGLVTAGGKVVWGRYAQVTNNPENEGCINSVLLV

SEQ ID NO: 12135 - protein, 479 aa, Campylobacter coli RM2228
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSIYDEFVDKFVKAMSKVSVGNTLKGDFDMGPLVNQAGVDNALAMLQRATAKGAIVECGGKITDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 12136 - protein, 290 aa, Pyrococcus horikoshii OT3
MSSRIRINTKSLLVQPGYSGSKMRDRLFFLLSKYGIRPRDSIGQHFLIIEDVIEKAIETANVNENDVILEVGPGLGFLTDELAKRAKKVYTIEIDQKIIEILKKEYSWNNVKIIQGDAVRVEWPKFNKVVSNIPYKISSPFTFKLLKTDFERAVVMYQLEFALRMVAKPGSRNYSRLSLMAQALGNVEIVMKIGKGAFYPRPKVDSALVLIEPRKDKIVLNENLVKALFQHRRKTVPRALKDSIHMLGVSKDEIRGIINNVPHSNKRVFQLYPEEVKDIEEYLKKHGIIS

SEQ ID NO: 12137 - protein, 401 aa, Gibberella zeae PH-1
MASSVPRPGPANLGPNAGLDEWLEEAKQCHYLPERVMKELCEKVKEILMEESNIQPVCTPVTVCGDIHGQFYDLLELFRVSGGMPGESNVQAPKTATTVITSDDIEPPTEITNPKLRKKIKASGENATSSGTEEAEAGEGDEDPDATMADRLESGVTVNSTSQSADNRYIFLGDFVDRGYFSLETFTLLMCLKAKYPDRIVLVRGNHESRQITQVYGFYEECQMKYGNASVWKACCHVFDFLVLAAIIDGEILCVHGGLSPEIRTIDQIRVVARAQEIPHEGAFCDLVWSDPEDVETWAISPRGAGWLFGDKVATEFNHVNGLKLIARAHQLVNEGYKYHFPENSVVTVWSAPNYCYRCGNVASIMAVDKDLNPKFSIFSAVPDDQRHVPALKRGPGDYFL

SEQ ID NO: 12138 - protein, 972 aa, Azoarcus sp. EbN1
MPNASPASPLNAPLAELEQRDAFIGRHVGPNATEIATMLAAVGAPDLDTLIDQTVPPAIRLAAPLPLEGPKPEHEALADLRAIAAKNVIRKSLIGMGYYGTHTPAVILRNVMENPGWYTAYTPYQAEIAQGRLEALLNYQQMVIDLTGLELANASLLDEATAAAEAMTMARRVAKSKSNVFYVDEACFPQTIDVLRTRAGLFGFELKFGPAHDAANADAFGALLQYPNERGEIIDLSGTVAALKAKGAVVAIASDLMALVLLKSPGTMGADIALGSAQRFGVPMGFGGPHAAFFATREANVRAMPGRIIGVSKDARGKTALRMTLQTREQHIRREKANSNICTSQVLLANMSGFYAVYHGPQGLRTIAARIHRLAAILAQGLRDAGFNVPAGAFFDTLQVDTGARTAELLAACDAAGFNLRPVSDTVLGLSVDETTTGDDVATLLRLFGASGELAALDAKVGAAGGAIPAALLRDDAILTHPVFNTHHTEHEMLRYLKKLQNRDLALDHSMISLGSCTMKLNATSEMIPITWAEFANLHPFAPREQVRGYLEMIDGLAGYLKAVTGFAAISMQPNSGAQGEYAGLVAIRRYHDSRGDTHRRVCLIPKSAHGTNPASAQMCGMDVVVVACDERGNVDLADLEAKVAQHADRLAALMITYPSTHGVFEESIREICASVHRHGGQVYMDGANLNAQVGLTSPATIGADVSHMNLHKTFCIPHGGGGPGMGPIGLAAHLAPFMADHVVAATGDETRPNKGQGAVSAAPFGSASILPISWMYIAMMGDTGLKLATEVAILNANYVANRLAEHYPVLYTGSQGRVAHECILDIRPIKANTGISEVDIAKRLMDYGFHAPTMSFPVAGTIMIEPTESEDLGELDRFIAAMITIRNEIREVENGAWPTDDNPLKNAPHTQADFIAADGAQWSRPYSREQAVFPLPWVAENKFWPSVNRIDDVYGDRNLFCACVPIEDYAS

SEQ ID NO: 12139 - protein, 293 aa, Gibberella zeae PH-1
MAPDVCTFTLNTGDEMPAVGFGTWNIPRSQAAKAVETALRAGYRHIDTALAYGNEKEVGAGIRASGVPREEIWVSGKLRNNWHKHARKCLQTSLKNLGVGYLDLYLIHWPCSRDADNPAICYEDWDYVDTWMEMEELLDEGKVLNIGVSNFGIQQLERLLTSTEIVPAVNQIELHPCNPSPKLVAYCNNRGIHSEGYSCLGSGHSALHRNKTLRDIADAKEKTVQQVLLQWGIEKGWGVVCKSVTPSRIKSNFELSGWELTDDDMEAIDGIKKRFKAVGDGFLPHRVFFGDDE

SEQ ID NO: 12140 - protein, 199 aa, Candidatus Kuenenia stuttgartiensis
MTEAKQAGSILKKEGYVFDIAFTSVLKRAIKTLWYILDEMDLTWIPVQKTWRLNERHYGALQGLNKAEVAKKYGEEQVFLWRRSYDTPPPPLTLTDNRYPGNDVRYRSLSKEEIPFTESLRDTIFRFLPYWDDAIAPAIREKKRVIVVAHGNSLRALVKYLDDIPDDKIAELSIPTGIPLVYELDEGLKPTSKYYLRGD

SEQ ID NO: 12141 - protein, 381 aa, Alkaliphilus metalliredigenes QYMF
MFNLGSESAFEVLEKAKKLEAEGKNIIHFEIGEPDFDTPRNIIEAGKTALDEGYTHYTAAQGYLPLREAVTQYALEYKNIKTNPEEVVIVPGGKPIMFYTMTALINPGDEVIYPSPGFPIYESLIRFYGGIPVPLAIREENDFRLDVEELKSKLTTKTKLLLINSPANPTGGVLSEEDIDEIANVLIGKNIFVLSDEIYDRMIYDGSTKSIASIPEMKEWTIVLDGFSKTYAMTGWRLGYGIMNKTLAQKVTDLMINTNSCTAAFAQVAGIEALTGPQHAVDEMKSEFFNRREIIVDGLNGIKGFKCIKSPGAFYAFPNIKDTGMRSSELSDYLMNHAGVAVLSGSSFGAFGEGYLRFSYATSTENIKIALKRIDEAMKKL

SEQ ID NO: 12142 - protein, 401 aa, Methanosarcina acetivorans C2A
MFFYRGVCLRPPCDPSKFVAEAVKSIPPSGIRRFFDLVSGLEDIISLGVGEPDFITPWHIREMCIHSLEKGQTSYTSNYGLPELRDELARTYYKRYGLDYDPASEILVTTGVSEALDIAVRAVVNPGEEVIVVQPSYVAYVPSVILAGGKPVIVSTSRDDDFSLTAEALKPAITSKTKAIILNFPNNPTGAIMEQEGMEDIADLVVENDLFVISDEVYECLTYGGTHVPFSSLEGLKDRTVMLNGFSKAYAMTGLRLGFAMGAPDIIHSMMMIHQYSMLCAPITAQVGAIEALRNGKEEMERMVREYDRRRRFIVKGFNSIGLECGNPKGAFYAFPYIGGTGLSSSDFAERLLEEKKVVTIPGDVFGEAGEGFLRCAYAASLDDIRKSIERMGDFVEELKQ

SEQ ID NO: 12143 - protein, 458 aa, Haloquadratum walsbyi
MTDENKSDSATTDGGLSAEAQRVIDQIEEGDVEFLRLQFTDILGTVKNVAIPVSRAEKAFKDGIYFDGSSIEGFVRIQESDMRLKPDPSTFAVLPWRSGRSARLICDVINTSTGEPFAGDPRAVLKETIERANEMGFTINTSSEPEFFLFEEDEDGRATTKTNDAGGYFDLAPKDLASDIRREIIHGLEEMDFNIEASHHEVAEGQYEINFEYESALTTADNIATFRTVVRAIAAQHDLHATFMPKPIAKINGSGMHTHISLFDENGNNAFHDESDEFNLSETAHSFLAGVLEHAPAITAIANPTVNSYKRLVPGYEAPVYVAWSDRNRSALIRKPAARVPAASRIELRSPDPSCNPYLALAAIITAGLNGIDDGLEAPDPIRENIYEFDEETRMEYGIDTLPGNLGEAIDALDSDEVIQGALGDHVYDKFAEAKTQEYDEFRVDVSDWELDRYLETY

SEQ ID NO: 12144 - protein, 391 aa, Nocardia farcinica IFM 10152
MSGTALGLLELGAVLFALGLLGRVAMRIGMSPIPLYLLGGLAFGSGGFTELHSAGEFSHLAGEIGVVLLLLLLGLEYTAAELVTGLRRSWAAGLFDLVANATPGALVALLLGWGFTGAITMAGVTYISSSGIVAKVLNDLGRLGNRETPVILSILVFEDLAMAVYLPILTTILAGLSFFSGMKALGIALVTVTLVLVVALRYGRYVSALVNSPDNEVFLLKLLGAALLVAGAASALNVSAAVGAFLLGIAISGSTAHQAVKLLEPLRDLFAAIFFVAFGLNTDPRAIPPVLGWAVALAVLTTLTKIGTGWWAARRQGIRRMGRARAGAALVARGEFSIVIAGLAVTMGAVDGRLAALASAYVLLMAVLGPVAARVVEPVAGFAQRRRAPAL

SEQ ID NO: 12145 - protein, 455 aa, Clostridium acetobutylicum ATCC 824
MDQTKSKNQNLSRGLKNRHVQLLAIGGAIGTGLFLGSGRSIHLAGPSILFAYMITGAICFLVMRALGELLVSNLNYHSFVDFVQDYLGNGAAFITGWTYWFCWISLAMADVTATGLYVQYWIPSLPRWVPSLVILLILLIMNLTAVRLFGEMEFWFALIKVVAILALIIVGIFMIIKGFSTSAGAASFTNLWKHGGWFPNGSNGFILSFQMVVFAFTGIELVGLTAGETEDPEHVIPKAINNIPVRIIIFYIGALAVIMSIYPWNSINPDKSPFVQVFAAVGVAAAATIVNFVVLTSAASACNSGIFSTSRMVFSLANENNAPESMKKLTSHKIPSNATIFSAAVILIAVILNYIMPEGVFVLITSISTFCFIFIWAIIVICHIKYRKANPELASKNNFKMPLYPIANYIILAFFAFVIVTLALNSETRVALFVTPVWFIVLGIIYFISKSKKKN

SEQ ID NO: 12146 - protein, 444 aa, Xylella fastidiosa Ann-1
MNHSRSHALFVQAQTRIPGGVNSPVRAFRSVGGEPFFVARADGPYLFDVDGHRYIDYVGSWGPMIVGHNHPGVREAVQVAISNGLSYGAPCAAEVTMAETIARLVPSCQMVRMVNSGTEATLSAIRLARGATGRNYIVKFEGCYHGHGDSFLVKGGSGMLTLGLPSSPGVPAELSKLTITLTYNDFDAATALFEEMGHHIAAVIVEPVIGNANCIPPRPGYLQHLRTLCTQYGVLLIFDEVMTGFRVALGGAQALYGVTPDLTTFGKIIGGGMPVGAYGGRRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 12147 - protein, 87 aa, Oryza sativa (japonica cultivar-group)
MAGAAKASWMVAMSVGAVEALKDQGGLCRWNYALRSIHKAAKANAAGVSQGKKLPASAAAVAERRRAEKAEEGLRTVMYLSCWGPNC

SEQ ID NO: 12148 - protein, 601 aa, Shewanella oneidensis MR-1
MKLTRDFPHNDTMAQWQPSDHKDAKVVGELFAHFGAEHFTVQTTRTGVPVVWLPRELLQDVVGFLRKLPAPFVMLYDLSATDERLRSHRDGLPQSDFTVFYHLISIDRNADVMLKVALAESDLHLPTITNHFPNANWYEREVWDLMGITFDGHPHLTRIMMPKSWQGHPLRKDYPARATEFDPFMLDAAKQDMEQENLLFKPEEWGLARGNENEDYMFLNLGPNHPSAHGAFRLVLQLDGEEVRNCVPDIGYHHRGAEKMGERQSWHSYIPYTDRVEYLGGVMNNLPYVLAVEKLAGIKVPQRVDMIRVMMAELFRIQSHLLFLGTYIQDVGAMTPVFFTFTDRQHIYTIIEAITGARMHPAWFRIGGVAHDLPKGWQRLVQDNLLSWLPKRLMDYEKAAMRNSILRGRTIGVAAYTTEQALAWGTTGAGLRATGLNFDVRKWRPYSGYEQFDFEVPVGSNGDAYDRATVRIEEIRQSMRIIEQCMNNMPEGPFKADHPLTTPPPKERTLQHIETLINHFLQVSWGPVMPAAESFQMIEATKGINSYYLTSDGSTMSYRTRIRTPSFAHLQQIPSVIKGSMVSDLIVYLGSIDFVMSDVDR

SEQ ID NO: 12149 - protein, 535 aa, Streptococcus pneumoniae TIGR4
MQEKWWHNAVVYQVYPKSFMDSNGDGVGDLPGITSKLDYLAKLGITAIWLSPVYDSPMDDNGYDIADYQAIAAIFGTMEDMDQLIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKFYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLVRADFELLDTADKVFAYIRKDGDRRFLVVANLSNEEQDLTVEGKVKSVLIENTAAKEVLEKQVLAPWDAFCVELL

SEQ ID NO: 12150 - protein, 993 aa, Delphinium 'MagicFountains dark blue'
MKSIFKKLHIGSSSRSSSSTNHDPNRSNELSSSQSLPATTSDHGTNSVQFTTAPTPLTSSYPGIPVSTPATLASDRTDYFSSEEEFQLQLALAISASSNSEFREDPDKDQIRAATLLSLDRNRNDLRRQENESAESLSRRYWDYNVLDYMEKVVDGFYDIYGLSSNPSSQGKMPSLVDIQRDHGDPNFEVVMVNRAVDPALVELEQIAHCIVLDCPSSNVGLLVQRLADLVTEHMGGPVMDANIMLARWMERISNLRTSLHTSVIPIGSVNIGLSRHRALLFKVLADNVGVPCRLVKGSHYTGIDDDAVNIIKLENQREFLVDLMAAPGTLIPADFLSTNDSSGNSYNPRLSETLTSWATQESEVGRSRGETSFGEHNGGDRKSAINYETALDRKSSFDKVPEPSVPIASSGLPFVSFGNGYSEDSKGVDSAKQLYIGSSFPYKGNQEGTSVGDVFKTFDAPPYTQDNVDSKALFADLNPFQMVGVGKDSVKSKPTESDGNNLQRQKERLNLGPGRPPLPLVWKNRSANEVPRTKQYGFVEGPFPKNNQEDRGYNTSIPLSSSGNLEKLYPNVNAAEFSGVSSVARKSIGDGSSSHHGNSTSESSANQHNRLHADRVGNTDTTQTSNQFRDENHHQRDGEILRNSIVDETKECEKNFLAEHDRRKYTHDRYMGGRVIAMDTGGNSSSVDSGRSRPDPMLDDVAELEIPWEDLSIGERIGLGSYGEVYRADWNGMEVAVKKFLDQDFYGDALDEFRSEVRIMRRLRHPNIVLFVGAVTRPPNLSIVSEFLPRGSLYRILHRPNCQIDEKRRIRMALDVAMGMNCLHTSIPTIVHRDLKSLNLLVDDNWNVKVCDFGLSRLKHNTFLSSKSTAGTPEWMAPEVLRNEPSNEKCDVYSFGVILWELATLRLPWTGMNQMQVVGAVGFQNRRLDIPKELDPLVATIIRECWQTDPNLRPSFSQLTAALQSLQRLLIPSHQDQQSFPLPQEISVSSTP

SEQ ID NO: 12151 - protein, 453 aa, Lactococcus lactis subsp. lactis Il1403
MEKVFRDPVHDYITVNHPVISELIDTAEFQRLRRIKQLGTSSFTFHGAEHTRFSHCLGVYHIAKRITDYFSRNFPLEWNPDENLLTQCAALLHDVGHGAYSHTFEGLFNTDHEAVTQEIITSPDTEINEILRKVSPDFPEKVASVISHEYSNPQVVQLISSQIDADRMDYLLRDAYFTGAVYGQFDLTWILRVIVPTENGIAFKYSGMHAVEDYIVSRYQMYMQVYFHASSRSMEVLLQKLLARAKFLYASQPDYFAISSPCLVPFFEQNHNLQDYLRLDDGVMNTYFQVWMSHDDEILADLASAYVNRHLLKSITFDPKTVELEDLEILSSLVEEAGFNPDYYTGIHSNYDLPYDFYRPSSEKPRTEINILQKNGSLTELSVLSPLIKSLTGTIHGNSRFYFPKIMLENPEFTKYIVNDSLVINQNFTDRNSTASENTDDSVSKQLSLDDNL

SEQ ID NO: 12152 - protein, 125 aa, Triticum aestivum
  misc_feature (5)..(5): Xaa can be any naturally occurring amino acid
  misc_feature (9)..(9): Xaa can be any naturally occurring amino acid
  misc_feature (15)..(15): Xaa can be any naturally occurring amino acid
  misc_feature (25)..(25): Xaa can be any naturally occurring amino acid
  misc_feature (28)..(28): Xaa can be any naturally occurring amino acid
  misc_feature (44)..(44): Xaa can be any naturally occurring amino acid
  misc_feature (58)..(58): Xaa can be any naturally occurring amino acid
  misc_feature (67)..(67): Xaa can be any naturally occurring amino acid
  misc_feature (72)..(72): Xaa can be any naturally occurring amino acid
  misc_feature (90)..(90): Xaa can be any naturally occurring amino acid
  unsure (1)..(125): unsure at all Xaa locations
EGFFXKGLXFFQCPXDLAQELYRDXREXPFFPNLIRLHNSWTCXVCMAWEGDVLLRQXAKLIGVLTXFQAEXPGTIRGDLAVQTGRNVVXHGSDSPDNGKREIGLWFKEGELAQWESVQTPWLIE

SEQ ID NO: 12153 - protein, 748 aa, Bacteroides thetaiotaomicron VPI-5482
MSEVAPLISDLAIILIIAGIVTVIFKWLKQPVILGYIVAGIMAGPSVSLVPTVSDPANIKIWADIGVIFLLFAMGLDFSFKKLINVGITAIVATVTIVCGMMFIGYTAGNAMGFSHMSSIFLGGMLSMSSTAIVFKAFNDMGLLQQKFTGIVLGILVIEDLMAVVMMVVLSTLAVGKHFEGKEMLESILKLAAFLIFWSALGIYLIPTLLKKIRRFTSNEILLITSLGLCLGMVMIATKAGFSAALGAFVMGSLLAETVEAEKIVHIVQPVKDLFASIFFVSVGMMIDPAMMWEYAVPILILTLLVLSGQVLFGSFGVLLSGQPLKIAIQSGFSLTQVGEFAFIIASLGVSLNVTDKYLYPVIVAVSVITTFLTPYMIWLSEPAYRFIDIHMPESLKDYLVHYTSGAMTVKHQGTWHKLIRSMLVSVTLYLVVCVFFITLYFSYVHPLIRKSLPGMEGNLLGFIIIFLVISPFLWAIIMKRNNSTEFRKLWTDNKFNRGPLVSIVLVKILICTIIMMSIITHLFNVALGAGLVVSSIIIAVIYFSKRIKKRSLTIERQFMANFQGTDGNGLSTESDTGSTFGSNIPFKELHLADFTVSPDSIYVGRTLKESSLRTLFQINVISITRGEKRLDIPQGEEHLYPYDKVTVVGTDRQLESFRTSMEQKKVERNGNGTSSQDEMEIGQFPVEGGSPLIGKTIREADISDSIIIGIERSTVNIMNPDPDTIFKENDTVWIVGKRKIIKGLNKD

SEQ ID NO: 12154 - protein, 404 aa, Symbiobacterium thermophilum IAM 14863
MSMAEDLHLEEQRPERMTLSIGPHHPATHGVLRVKLELEGETVVKAEPETGFLHTGIEKTAEHLTWNQATTVMDRMDYLSPISNNTGYVMAVEKLLGIEDRIPEKARVTRVILLELNRVASHLVGLGTGGLDYGNIGTPIFWAFELRDRILDIFEHTTGQRMNPSYMRVGGLAYDLPHNFKEMVEDFLKVAPGRIQELKDVMLHNPIFVDRAKGVSVITYEQALRYGLTGRNLRVTGSDYDVRKYYPYLGYENYDFKVPVYTDGDSWSRVAITFDEMFESLKIIRQALDNLPWDDRYIIDDRKLVLPPKQEVKHSMEALIHHFKLVHHGFDVPAGEVYVSIESPRGEIGFYVVSDGGNKPMRVRVRPPSFYAVYSLPVLLEGHLLSDMVGAIATIDPVFGEVDR

SEQ ID NO: 12155 - protein, 149 aa, Glycine max
MVEQTSIMIKPDGVQRGLIGEIISRLEKKGFYLKGLKLVTVDRPFAEKHYAHLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 12156 - protein, 597 aa, Oryza sativa
MASSKETYRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKNLERMEVEERQAQNFVEALLFLAKHCKSIGRFEEAEHYCTRLLDYTGPERETAKSILQGLKRAQSVLPLMDIDHFAM

SEQ ID NO: 12157 - protein, 558 aa, Picrophilus torridus DSM 9790
MLDNNGLWYRDAVFYEVPVKSFYDSNNDGIGDFNGLTMKLDYLKKLGVDALWLLPFYKSPLKDDGYDISDYYSILPEYGTIDDFKNFIDTAHSMNIRVIADLVLNHVSDQHPWFIESRSSIDNPKRDWFIWSDTPEKFKEARIIFIDTEKSNWTYDPETKQYYFHRFYSSQPDLNYDNPDVRNEVKKVIRYWLDLGLDGFRADAVPYLFKRENTNCENLPETHNFFKEIRKMMDEDYPGTILLAEANQWPTETKAYFGNGDEFHMAFNFPLMPRIFIALARSDYYPIMDIIKQTLPIPDNCDWCIFLRNHDELTLEMVTDSERDIMYREYAKIPKMRLNLGIRRRLAPLADNDINTIELLNALIFSLPGTPIIYYGDEIGMGDNIYLGDRNGVRTPMQWSYDRNAGFSMADSEQLYSPVITNPNYHYESVNVEAELRLSSSLLNWMIKIIHVRKDYKELLGRGSIKFIEQGNKRVLSYIREYENQRMLCLFNLSRNPTYVELNLSDYIGLKPIEAITKAAFPRIKDDRYFITMTPRSFFWFNLIVPERDDSYDLIGED

SEQ ID NO: 12158 - protein, 323 aa, Halobacterium sp. NRC-1
MFTVLVSDGMGMLGALPDAVADRATRDVAFEHRRVETGEGLVAAVDDTGADAVVGGPETPVPAETIAEIDGDVAAIVRAGVGVDAIDCAAAADHGVAVANAPSYCTREVGEHALSLVFGAARRLHEYDRQTRRGGWAWNDAPAPLRLADATVGFVGFGEIARGVADTATTVAESVIAYDPYVDAATAERHGVAMAEFEAVCAQSDVLVVFAPLTEETRGLVDEAACNRLPEGAVVVNVGRGAVVDDAALAGALEDGPVSAAALDVLPTEPPVESPLVGRSDVLVTPHCGWYSEAAAESLVASLAGTVAAVADGDGVPERTRVA

SEQ ID NO: 12159 - protein, 323 aa, Fragaria x ananassa
MTATQIPEVVLESSNGRRTMPVLGFGTASNNLQPEVLIEAVLEAIKLGYRHFDTASIYGSEQTLGVAIAQALKLGLVASRDELFITSKLWPNDGHPNLVIPALKKSLQNLELEYLDLYLIHWPISAKPGKLSHALEEKDQMPMDFKGVWADMEEAQRLGLTKSIGISNFSTKKTQNLLSFATIPPSVNQVEMSPFWQQKKLRDFCKASGIVVTAFSPLGAIGTSWGTNHVLESKVLNEIAEAHGKTVAQVCIRWVYQVGATLAVKSYNKERLKQNVQVFDWELTEEDLEKINQIPQRKMMPREELVTATGPYKSLDDLWDGEY

SEQ ID NO: 12160 - protein, 444 aa, Prosthecochloris aestuarii DSM 271
MPFIANTDDDRRSMLQAIGVGSFEELIPDIPSEFCLKEALSLFPSMSEMEVASLLDRLASANRTSPDYVSFIGGGAYDHYIPAALKTIVSRSEFYTAYTPYQAEVSQGTLQAIYEYQSMICRLYGMSVANASLYDGATAMAEAVSMAMNVTGRSTVLVAGKIHPNTSAVLKTFIEAGGKASVVQNVLTDGVCDIAALESRMSDQIAAVIVQQPNFYGCLEDVEAIGALARSHGALFIVSADPVSLGLLNAPGRYGADIAVGEGQPLGSALNFGGPYLGIFAVAEKYVRKIPGRLVGMTKDRDGEDGFILTLQTREQHIRREKATSNICTNQALNALQAVVYLSLMGKDGLCQVAEHCLQKAHYLADKIADLPGYSLRFAGPFFREFVVNTPVDASVVVNTMMEKGFFAGYDLGIHDDSGLLIAVTEKRSRAEMDSFVENLGAIS

SEQ ID NO: 12161 - protein, 360 aa, Bradyrhizobium japonicum USDA 110
MGLLERAGRVLMSVNNKRVFYVKYLANPIYIDILKARPDVRLDRIENESPEDFYAPIVSAAHVYQIGAARDELAPHFHVDAAFLKRTPNLLLVSSNGAGFDPVDVEACTDAGVLVVNQSGGNAHSVAEHALAMMLTLSKRIIQSDRRLRRERDVNRNDLVGNEVEHKTVGIIGLGNVGRRIAALCNGLLGMKVLAYDPYLTAEVMAERGGEKVELDELLRRADFVSISCPLNKGSRNMISVREFALMQPHAYFITTARGFIHDEDALLQALRDKRIAGAGLDVWSKEPPPPEHPLLQFDNVLASPHTAGVTTEARQNMGRIAAEQVLDTLDGKRPPRIINPEVWPRYAERFKQAFGVMPG

SEQ ID NO: 12162 - protein, 361 aa, Porphyromonas gingivalis W83
MAVKDNYCVIMGGGIGSRFWPFSRESHPKQFLDFFGTGRSLLQMTYDRFARFIPRENILVVTNELYVDKVREQLPEIEPDQILREPTRRNTAPCIAYASYHIYARNPKANIIVAPSDHLILREDEFVRAASEALEFVADHEHLVTLGIRPSRPETGYGYIQMAEEKTGDFIRVKTFTEKPNAEMASIFLASGEFLWNSGMFVWNVESILAAFRKHLPEVTSSLENGLAHFNTPEERRFIDQAFPYCPSISIDFGVMEKADNVLVMPVDFGWADLGTWGSLYELAQKDDAGNASLKTRTLFYEAERNIVTTDNPQKLVVVQGINDCIVAESGNVLLICRAEEEQRIKHFVADAALKYDKEYN

SEQ ID NO: 12163 - protein, 251 aa, Lactobacillus sakei subsp. sakei 23K
MRKPIIAGNWKMNMNPTQTTEFVNAIKANLPKFDQTESVIGAPAVDLPALLEAAKGTDLKVAAENCYFEEAGAFTGETSPKTLNEMGVDYVIIGHSERRDYFHETDEDINKKAHAIFKNNMTPIFCCGESLETREAGKAEEWVSNQVTEGLKGLSADQVSSMVIAYEPIWAIGTGKTASADQAQEICAVVRQTVAKLYDQTVADKVRIQYGGSVKPANVKEIMGKEDIDGGLVGGASMEPASFLDLVHFND

SEQ ID NO: 12164 - protein, 392 aa, Legionella pneumophila subsp. pneumophila str. Philadelphia 1
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQPFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 12165 - protein, 262 aa, Zea mays
MAAAGRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPLHSMQEDNGMFIPHSSFFFANKRRAIGVPYLKKKKKKKKKKKK

SEQ ID NO: 12166 - protein, 591 aa, Listeria monocytogenes
MEKAGIYHQPASSYAYSYDAKTLHIRIRTKRLDISKVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVRNTIWYQIFPERFANGNPAISPENTLPWGSKDPNTTDFFGGDIEGIIEHLDYLAELGINGVYLTPVFEAPTNHKYDTIDYKKIDPHFGDKETFRKLVKEAHKRGIRIMLDAVFNHIGDTSPEWQDVVEKEEKSAYRDWFHIHSFPVRQNENGNIEGEPTLSYDTFAFTTHMPKLNTANPEVQKYLLDIATYWIREFDIDGWRLDVANEVDHAFWKEFKKAAQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDEAKQNQDMLAFTKQLIALRKDNQAIITSGELTWLEASSETGITAFSKELNGEKLHFLFNQTKKDQDFTISFANTAIDIWNNQAVSDNLTIPAKGFLVIKENS

SEQ ID NO: 12167 - protein, 680 aa, Oryza sativa
MAPPPPSPPCRPRVKPERALLCFSLLLLLTATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYEGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVWRHWSRGGAGELLDGCPAAGRRPQELLRCIHVGLLCVQEDPQLRPGMAAVVVMLNSRSVTLPAPSAPAFVSASRGIGGSPPPAAAAGDAPARSTDHEVPTAAR

SEQ ID NO: 12168 - protein, 249 aa, Bacteroides thetaiotaomicron VPI-5482
MKRIVLLRHGESLWNKENRFTGWTDVDLSEKGVEEACKAGDALREAGFSFEAAYTSYLKRAVKTLNCVLDRLDKDWIPVEKTWRLNEKHYGMLQGLNKSETAVQYGEEQVHIWRRSYDVAPAPVGKDDPRNPGMDIRYAGVPDSELPRTESLKDTIGRVMPYWKCIIFPALMYKDSLLVVAHGNSLRGIIKHLKGISDTDISNLNLPTAVPYVFEFDDRLVLVKDYYLGNPEEIRKRAEAVAKQGMAKK

SEQ ID NO: 12169 - protein, 353 aa, Candida sp. HA 167
MSTPENLSFVLQKPFDVKFEDRPIPKLSDPYSVKIQVKKTGICGSDVHYFTHGAIGDFVVKAPMVLGHESSGVVLEVGSEVKSLKVGDRVAMEPGVPSRHSDEYKSGRYNLCPHMAFAATPPYDGTLCKYYILPEDFCVKLPEHVSLEEGALVEPLSVAVHSSKLGNIKPGSHVAIYGAGPVGLLVAAVASAFGAESVTIIDLVESRLNLAKELGATATVQVDFKDTPKESAAKVVAANNGIAPDVVIDASGAEASINSAINAIRPGGTYVQVGMGKPDVSFPIATLIGKELTVKGSFRYGYGDYPLAVSLLASGKVNVKKLITHEVKFEDAAEAFQLVRDGKAIKCIINGPE

SEQ ID NO: 12170 - protein, 114 aa, Glycine max
RDLGPDEQSLHPWEQDLLKKICDAYYLPAWCSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 12171 - protein, 798 aa, Pyrococcus horikoshii OT3
MMLMVEKKEIKLKVASAYQRDVGRGIVRIDRRSMRELGVSPGDVVEIIGTKNTAAIVWPAYPEDEGLGIIRMDGTIRKNAGVGLGDEVTIRKADVKEARKVVLAPTEPIRFGRDFVEWLHERLVGRPVVRGDYIKIGVLGQELTFVVTTTQPSGVVQITEYTDFDISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPSIIFIDEIDAIAPKRSEVTGEVEKRVVAQLLALMDGLKGRGKVIVIGATNRPDALDPALRRPGRFDREIEVGVPDKQGRKEILQIHTRGMPIEPDFRKEDVLKILEGLKKEGKFRDVIDKAIDRVMKVSEDDIPKVLKELNGELYEEVRTRLVDLLLEELAEVTHGFVGADLAALAREAAMAALRRLIKEGKIDFEAETIPREVLDELKVTRKDFYEALKMVEPSALREVLIEVPNVHWDDIGGLEEVKQELREAVEWPLKYPEAFRAYGITPPKGVLLYGPPGTGKTLLAKAVATESEANFIAVRGPEVLSKWVGESEKNIREIFRKARQAAPTVIFIDEIDAIAPRRGTDVNRVTDRLINQLLTEMDGIQENTGVVVIAATNRPDILDPALLRPGRFDRLILVPAPDEEARFEIFKVHTRSMPLADDVDLRELARRTEGYTGADIAAVCREAAMIAMRKALEKGIIKPGMKADEIKQKAKVTMKDFEEALKKIGPSVSKETMEYYRKIQEQFKQARG

SEQ ID NO: 12172 - protein, 498 aa, Schizosaccharomyces pombe
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 12173 - protein, 232 aa, Methanosarcina barkeri str. fusaro
MTERNISTDSPEKRAAGIAASRMVESGMVVGLGTGSTVAYTIKELGRRVRDEGLEILGVVTSYQSETLAIEAGIPLTTLAQHSELDIAIDGADQVDSKLHAIKGGGAAHTREKIVSASARRFLVVADESKTSTQLDKPIPVEVLPFAKTLVIKKIKQLGGKPEPRLALRKDGPVITDNGNFVLDANFGVINDPEGLALQLSSIPGVVEHGIFSNVDELYIGKKDGSVEIVKK

SEQ ID NO: 12174 - protein, 157 aa, Triticum aestivum
MAKLYVQAVPPPDLNKNTEWFMYPGVWTTYIFILFVSWLLILSIFGCTPGMAWTLVNLGHFAITYHFFHWKKGTPFADDQGMYNRLTWWEQMDNGKQLTRNRKFLVVVPVVLYLIASHTTDYQHPMLFLNTIAVTVLVVAKLPNMHKVRIFGINAGN

SEQ ID NO: 12175 - protein, 150 aa, Oryza sativa
MRVSKHTCEVRYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRKLAQYRQKLDSMV

SEQ ID NO: 12176 - protein, 372 aa, Deinococcus radiodurans R1
MPTACRGAVQMSSFVPVILAGGSGERFWPLSRRHRPKQFLTLDESGRSLLQATSDRLARLGGGQDRVVVVTGNDYRSQVLEQLPEMPIENLLVEPAARDTAAAILYAALWIAQDDPQAVMGVFPADHRVTDVEAFERVIQRAIEVAQESERLVTVGIAPTFPSTGYGYIQQGEVLQPGELPAFSVTRFTEKPDAVTAQAFLDTGRYTWNSGMFIWRVQSILAAFEQHQPQLYKQLHQVMSAGTASARRVQLQTTFPQLEKISIDYAILEKSDRVAVIPAEFGWDDLGDWNALERLLKGEGDNVAVGRHVGLDTGGAILYTTNGDDLIATIGLDDVVVVRAEDVTLVVRKDRTQDIKKVVQQLKAHPELERFA

SEQ ID NO: 12177 - protein, 458 aa, Pseudomonas syringae pv. phaseolicola 1448A
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGTADAVRIEHRVAGADANPYLVMASVLAGVHHGLVNKVEPGAPVEGNSYEQHEQSLPNNLRDALRELDDNPVMAKYIDPKYIDIFVACKESELEEFEHSISDLEYNWYLHTV

SEQ ID NO: 12178 - protein, 187 aa, Zea mays
  misc_feature (44)..(44): Xaa can be any naturally occurring amino acid
  misc_feature (49)..(49): Xaa can be any naturally occurring amino acid
  misc_feature (60)..(60): Xaa can be any naturally occurring amino acid
  misc_feature (91)..(91): Xaa can be any naturally occurring amino acid
  misc_feature (124)..(124): Xaa can be any naturally occurring amino acid
  misc_feature (138)..(138): Xaa can be any naturally occurring amino acid
  misc_feature (150)..(150): Xaa can be any naturally occurring amino acid
  unsure (1)..(187): unsure at all Xaa locations
MHIIKHLQRPVADSERDSTFMMIKSDRGQRPLIGDTSHRFEKKXGFYLXALNLENAEKPXDDKDYRDLASQIFFQRLQDYIISGPVEDMLXDGNSDGTTGRMIFVVTDPLDTEHETIQGHYDVXIDRNVILGNDTDVXEGNIEIVLWFPXGPDDWQRSHDPWIYQNETWKSLSLSVRARGSMSPFVL

SEQ ID NO: 12179 - protein, 601 aa, Legionella pneumophila str. Paris
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLNAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEINSFFTLVVALSMLATPFLMLLYHRFMMPKLISKLPEREYDSIHEKNNIIIAGYGRFGQIIGRFLSGENIKVTVLEKNPEQVELLRKFGYTGYFGDANRLDLLKSAGATHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEASLINFSRQAKGELERILQNNNP

SEQ ID NO: 12180 - protein, 560 aa, Magnaporthe grisea 70-15
MGEENGTRGRYSGDVESKAVDNGQALDIDIGQARTLSADGTPNLLAKHNQLERGLKSRHIQFIALGGAIGTGLFVGSGRILQLVGPAPLFMGYLSMMVLVWNIMNILGEMSTFLPLKGISIPYFVERFVEPSLAFATGWNYWYAYAMLVGAEAVAGAILLDYWNTPVPTAVWITIILIVTLALNIFAVGIFGEAEFWFASIKFISIMGLILTSLVIMLGGAPNNDRIGFKYWYDPGAIKPYLVEGDAGNFLAYWAAFIRAGFAFITSPELIALAAGETMAPRRNIPKAASRFIWRLAIFYGLGSLMVGVIVPSNDDRLLSPKSNATSSPWVIGIQRAGIVGLNHVVNAAILTSAWSAGNAFLYSGSRVMYSLALNGQAPAIFKRTSKNGVPYAAVLATWSVGLLSYLNVSNSSAKVFDWFQAICTISGYIAWIVVTITYIRFYAALKFRGLLHTLPYKTKFQPYATYFTLFMLILLTLTSGFDIFPTSKWNVESFVAAYVTLPIFLVLYLGHKIWHRTPLARKVEDIDVTSGVKEMEALAANDEEPVPKNLLQKIWFWIA

SEQ ID NO: 12181 - protein, 669 aa, Zea mays
  misc_feature (234)..(234): Xaa can be any naturally occurring amino acid
  misc_feature (274)..(274): Xaa can be any naturally occurring amino acid
  unsure (1)..(669): unsure at all Xaa locations
MEEVLSVHLAVAVALLLLLAAKRTPAVAVPSPQCQRQCGGVDIVFPFGIGDNCSLSAGFNVSCQEVQVQGGVVYRPFLGNVELLNISLIHGTIRELNHISTYCYDSSSSSMELSTWCFDASETPFRFSDVQNKFTAIGCQTLAYIMDNTDKSYQSGCVSTCQSLSNLADGSCSGIGCCQTDIPKGMGFYNVSFDTGQISPSGLGRCSYAVLMEAAAFSFRTTYIDTTDFNDTSXVLGSGNSKCVDSPNGPGYRCNCSDGYEGNPYLSDGCHDVXSARRTVHAVGGVCHNTKRKLNQVKQDHFRQHGGMILFERMRSENGLAFTVFSEAELVKATDSYDKSRIIGKGGHGTVYKGIVKGNVPIAIKRCALIDERQKKEFGQEMLILSQINHKNIVKLEGCCLEVEVPMLVYEFVPNGTLYELIHGKNQALQIPFSTLLRIAHEAAEGLSFLHSYASPPIIHGDVKSANILLDGNYMAKVSDFGASILAPSDKEQYVTMVQGTCGYLDPEYMQTCQLTEKSDVYSFGVILLEVLTGQEPLKLDGPETQRSLSSKFLSAMKENNLDVILPSHVNGGQGSNELIRGLAELAKQCLDMCGCNRPSMKEVADELGRLRKLSLHPWVQIDAEMIESQSLLSGTTTASFEIEVGTTGYPTQEAENLPMNPRSSYYAR

SEQ ID NO: 12182 - protein, 177 aa, Glycine max
DPKLGENISGVILFHETLYQKTDDGTPFVELLAKRNIIPGIKVDKGVVDLMGSENECTTQGLDDLAQRCAQYKKDGCHFAKWRCVLKIGKNTPSYQAILENANVLARYASICQANRIVPIVEPEVLPDGDHDLDRAQKVTETVLAAVYKALNDHHVYLEGTLLKPNMVTPGQSCPKK

SEQ ID NO: 12183 - protein, 528 aa, Prochlorococcus marinus str. MIT 9312
MTKVLITDPIDQTGIDILSQVAQVDQRIGISNSELASIIKEYDALMIRSGTQVTEEIINSSNKLRIIGRAGVGVDNVDVKAATQKGVLVVNSPGGNTIAAAEHTIAMMLALSRNIPIANSSTLLGKWERKKFVGNELYKKKLGVVGLGKIGAHVAKVANALGMEVYGYDPFVSTERAQQIKVKLSELDDLFQQSDYVTLHLPRTPETENLVNMKVLKSMKSSAKLINCARGGLIDEEALAEALNQSFIGGAAIDVFSKEPLESDSPLLQVEKNLILTPHLGASTREAQENVAVDVAEQIRDVLLGLSARTAVNIPGLSPDIMDSLKPHLQLAETMGLLVSQLAGGQIQKLEVKLQGEFVQHPSQPLIIASLKGLLSKALGDRINYVNASLEADSRGISVVESKDEARPEFASGSLQLTTYGDNGDHSVAGSIFADGELRIISIDQYPVNVSPSRYMLVTRHRDMPGIIGKLGSLLGSNNVNIASMQVGRKIVRGEAVMVLSIDDPIPNKLLDTIIEVEGITSANPVTL

SEQ ID NO: 12184 - protein, 230 aa, Streptococcus pneumoniae
MVKLVFARHGESEWNKANLFTGWADVDLSEKGTQQAIDAGKLIKEAGIKFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 12185 - protein, 252 aa, Oryza sativa
MEQRKFLLCLILGLLATSGPAKTVNADSPFDFYYLILMWPGAYCTDSEYGCCVPKYGYPSEDFFVKSFMTFDSSENTAVVRCNSDNPFDINKLDSIENNLNHYWSNIKCPRTDGVNSWKSEWNSYGVCSGLKELDYFKAGLQLRKNADVLSALAEQGIKPDYQLYNTAFIKWAVNQKLGVTPGVQCRDGPFGKKQLYEIYLCVDKDAKSFIDCPVLPNLSCPAEVLFHPFHTWMLNTTSAANIVMPTETVLA

SEQ ID NO: 12186 - protein, 387 aa, Silicibacter pomeroyi DSS-3
MNISSDTGFRRAGRLDGIELSEIVQISERVAQLRADGADIVALSTGEPDFPTPTHVIEAAHRAALAGQTRYPATAGTPALRAAIAAEAGVEPANVIVSTGAKQVLAGAFLATLDPGDEVITTAPFWTSYADMVRLAGGVPVVLDCPGAQGFKLTPAQLEAAITSRTRWLLLNTPSNPTGAIYSEAELQALGAVLDRHPHVWVISDEIYQHLAYVPFTPFVQAVPTLADRTLIVNGVSKAYSMTGWRIGWGIGPAPLIKAMVAVQGQITSGACSIAQAAALAALSGPQDLLVERRAEMLARRDLVVAGLNAAGLECASPDGAFYVFPKTPARMPVDHDFCHHLLDTAGVALVPGRAFGMSGHLRLSFAYARQSLEEGLARIARAVAAL

SEQ ID NO: 12187 - protein, 470 aa, Burkholderia thailandensis E264
MTRSPSSLQCSRALFASPARDRRVAAAPENASGCRANIRRRLPEGRRPAIPPRRRRSRRRPSGQRGRPSRRVRLKPAARGVKYALSLPPDPFMTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLIEFGKEHGLKIGTIADLIHYRSRTESIVERVAERTMQTAHGPFKAVLYRDHPTGSPHIALVRGTPAPHDETPVRVHEPLSVLDLLETGVSTHSWTLDAAMKEIAARELGVVVLLNCGDTKEHLVDVFLAFDEKEKAAELKRRPVDFKTFGIGAQILRDVGVGKMQVLSNPRKLGSMSGYGLEVTGFAPMPGSATSASDAA

SEQ ID NO: 12188 - protein, 159 aa, Hyacinthus orientalis
TKQTAPLQQKKMEQTFIMIKPDGVQRGLVGEIISRFEKKGFYLKAMKLITVERSFAEKHYEDLSSKPFFGGLVEYIISGPVVAMVWEGKNVVLTGRKIIGATNPADSAPGTIRGDYAIMVGRNIIHGSDAVESARKEIGLWFPEGISNWQSSLNPWIYE

SEQ ID NO: 12189 - protein, 446 aa, Methanosarcina mazei Go1
MKAVVYRGPNQVSVEEVEDPKIEHPADAIIRLTSSGICGSDLHMYEGRTVEKPGKVLGHEPLGVIEEVGDAVTSFKKGDRVVVTFNIACGHCLNCIRGFTSACLTVNPESAGGAFGYAKMGPYRGAQAEFLRVPFADLNCTKLPGSPGDKWEDDFIMLSDVFPTGFFATQLAMVMPGFPVAVFGAGPVGLLSAYSAILQGAAQVFVVDYIPERLKLAKSIGAIPVDFTLSDPVAMIEALRSQHSRVDTVLPGEEKLQGIMSSIENLAKSIGANLELARSDPVTMIQMLRAGNPAIVQSLIPGEEKMKGVMSGIDAVGYQARDRQDPSRENPTQVISDLVRLINPTGHLGVIGVYVADDPGAYNERAKKGEYILPFGQLWEKGISVGTGQTPVKKLQPMLRDMIIAGVAKPSFIVSHKISIEEAPDAYREFAKRSEGFTKVTIQFEK

SEQ ID NO: 12190 - protein, 170 aa, Zea mays
MSMFNRIFGKPKEQANSSALATLDKLNETLDMLEKKEKVLDKKAAAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALPTALGAYADFDEDELEAELEELE

SEQ ID NO: 12191 - protein, 253 aa, Brassica napus
METEREKQVYSAKLSEQTERYDEMVEAMKKVAQMDVELTVEERNLVSVGYKNVIGARRASWRILSSIEQKEESKGNEENVKRIQNYRKRVEEELAKVCNDILSVIDKHLIPSSTAVESTVFFYKMKGDYYRYLAEFSSGAERKEAADQSLEAYKAAVAAAETGLAPTHPVRLGLALNFSVFYYEILNSPESACQLAKQAFDDAIAELDSLNEESYKDSTLIMQLLRDNLTLWTSDLPEEGEEKSKGDEPKEEN

SEQ ID NO: 12192 - protein, 252 aa, Idiomarina loihiensis L2TR
MPNASLVIANWKMNGNRELTKTMSAALREKLNQLQQVKLVICPPFTLIGELANQCYYDDIAIGAQNVSEHTGGAFTGEISTAQLQEFGVSYVLVGHSERRQLFAETDKMVNEKALATVNAGMTAVICVGENKAQRDEGNTWEVVAQQAQAALADLPKEQAGKIVLAYEPVWAIGTGETASPEQAQDVHAKLRALLVEQFGAIGEKMPLLYGGSVKADNAAELFAQKDIDGGLIGGASLKESDFVAICQAAQG

SEQ ID NO: 12193 - protein, 178 aa, Glycine max
  misc_feature (93)..(93): Xaa can be any naturally occurring amino acid
  misc_feature (122)..(122): Xaa can be any naturally occurring amino acid
  misc_feature (125)..(125): Xaa can be any naturally occurring amino acid
  misc_feature (144)..(144): Xaa can be any naturally occurring amino acid
  misc_feature (165)..(165): Xaa can be any naturally occurring amino acid
  misc_feature (174)..(174): Xaa can be any naturally occurring amino acid
  misc_feature (177)..(177): Xaa can be any naturally occurring amino acid
  unsure (1)..(178): unsure at all Xaa locations
MASSMISSPAVTTVNRAGAGMVAPFTGLKSMAGFPTKKTNNDITSIASNGGRVQCMQVWPPIGKKKFNTLSYLPDLNNTQLAKEVEYLLKKRXIPYLQFDLNHNFIYHNHNESPRYYNKLYXTIXNLPIFNYTNTSHVCKDLQXTKTTYPSNCIPIIRFYNSHQXQYINFISYXPAXF

SEQ ID NO: 12194 - protein, 378 aa, Pisum sativum
TMSHLAVSQMAVTVPVSSDFSVRRSAFKSSNLNFRDKSWAPVFTLGMKAKNCGWRNHNVICMSVQQASVPKVTVSPLELENPSEPPLNLHKPKEPYTATIVSVERLVGPKAPGETCHIVINHDGNVPYWEGQSYGVIPPGENPKKPGSPHNVRLYSIASTRYGDNFDGKTASLCVRRAVYYDPVTGKEDPSKNGVCSNFLCDSKPGDKIKIAGPSGKIMLLPEDDPNATHIMIATGTGVAPYRGYLRRMFMESVPTFKFGGLAWLFLGVANVDSLLYDDEFTKYLKDYPDNFRYNRALSREEKNKNGGKMYVQDKIEEYSDEIFKLLDNGAHIYFCGLRGMMPGIQETLKRVAEKRGESWEEKLSQLKKNKQWHVEVY

SEQ ID NO: 12195 - protein, 565 aa, Xanthomonas axonopodis pv. citri str. 306
MHHDTSLIDIIAVGLAVAFILGTLAQKVKLSPLVGYLLAGVCVGPFTPGFVADQTIANQLSELGVMLLMFGVGLHFSLDDLMEVKWIAVPGALAQIVVATLLGWALAWSMGWSLIHGLVFGLALSVASTVVLLRALEERRLLDTQRGRIAVGWLIVEDLVMVLALVLLPALADVLGTGAPAAAHDAQSPSLLAALGVTLLKMVAFVAAMLVIGRRVIPWSLEKVAATGSRELFTLAVLGIALGVAFVSATLFGVSFALGAFFAGMLLKESELSHKAANDSLPLRDAFAVLFFVSVGMLFDPMILIAHPWQVLATFLTITVGKSLAAFLIVRAFGHPTGTALTISTSLAQIGEFSFILAGLGVQLAILPETGRDLILAGALLSIVANPFLFSWLDRWQAKQAQDAPAAVEPELPPGPALPADGHAIVIGYGRVGSSLAQLLRSRGVPVLVIDDNGDHVAKAHAAGIPGIRGSAAADRVLAEARPEHAKIAILAIPQPLEAGEALAKLRVINPSLTLLARAHSDAEVKHLLEHGADGAVLAERELAYSLAEMVMSTPPYRALNVPAS

SEQ ID NO: 12196 - protein, 302 aa, Arabidopsis thaliana
YGCEKTTEGYGCEKTTEGYGCEKTTEGYGCEKTTEGYGCEKTTEGVNALINVTETTIASGDDKGCVKIWDTRQRSCSHEFNAHEDYISGMTFASDSMKLVVTSGDGTLSVCNLRTSKVQSQSEFSEDELLSVVIMKNGRKVICGTQNGTLLLYSWGFFKDCSDRFVDLAPNSVDALLKLDEDRLITGCDNGIISLVGILPNRIIQPIGSHDYPIEDLALSHDKKFLGSTAHDSMLKLWNLEEILEGSNVNSGNASGAAEDSDSDNDGMDLDNDPSKSSKGSKRKSKSKANTLNATNNFFADL

SEQ ID NO: 12197 - protein, 392 aa, Deinococcus radiodurans R1
MKAIVWQGVNKVGVETVPDPTLLLPTDAIVKITSTAICGSDLHLLDGYIPSMETGDILGHEFMGEVVEVGSEVRKLKVGDRVVVPFNIACGVCDPCKRGFFSACDNSNPNHRMAEALYGATSGGALFGYSHMYGGYAGGQAQYVRVPFADVGPFKIESGLKDEQVLFLTDIFPTGYQAAEQCNIVPGRDVVAVFGAGPVGQFAARSAQMLGAAHVIVIDRVPERLAMAEAAGCQTINYEKEDVLLSLREATGGRGPDHVIDAVGMEAHGHGPGSTMDKVQQNLKLTFDRITALRWAILSCAKGGTVSMPGVYGGLVDKMPIGAAFAKGLIFRMGQTHTHRHIPSLLGRIEAGQIDPSFVITHRASLDQAPELYKTFRDKQDCCIKVVLNPWA

SEQ ID NO: 12198 - protein, 487 aa, Deinococcus radiodurans R1
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 12199 - protein, 587 aa, Nostoc sp. PCC 7120
MSQPKNTQQSSTNPLNGENPGTGVVPQIFASSTEKFMFDSIDAALSDLKAGRAIVVVDDENRENEGDLICAAQFATPDMINFMAVEARGLICLAMTGDRLDELDLPLMVTNITDPNQTAFTVSIDASPHLGVSTGISAEDRARTIQITLNPATKPSDLRRPGHIFPLRAKAGGVLKRAGHTEAAVDLSRLAGLYPAGVICEIQNPDGSMARLQQLIEYAKHHNLKIISIADLISYRLQHDRLVYREVVTKLPSQFGQFDIYAYRHTLDNTEHVAIVKGNPENFRDEPVMVRMHSECLTGDALGSLRCDCRMQLQAALKMIETAGQGVVVYLRQEGRGIGLINKLKAYSLQDMGLDTVEANERLGFPADLRDYGMGAQMLMDLGVKKIRLITNNPRKIAGVKGYGLEVVDRLPLLIEANDYNSYYLATKAKKLGHMLLQTYLVTVAIHWQDDPQLVTKRYERLEKLRHLVRGYDLLLQEEARPLAIALFDKPSLTVHLGFDQEKVASCDWYSQSGHPYVQAILPILDNLATLPYVQKLEFLISPGSDPLSNLQVQLDRQTISPDKLPSSVSNELETQKIYSLSKELED

SEQ ID NO: 12200 - protein, 498 aa, Arabidopsis thaliana
MAMIEQRPKTKIVCTLGPASRSVPMVEKLLRAGMNVARFNFSHGSHEYHQETLDNLHQAMLNTGILCAVMLDTKGPEIRTGFLKDGKPIQLKQGQEITISTDYDLKGDENTICMSYKKLAVDVNPGMVILCADGTISLLVLSCDKENGTVRCRCENSAMLGERKNVNLPGVVVDLPTLTEKDKEDIMQWGVPNQIDMIALSFVRKGSDLVQVRKLLGKHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMLYSPVPMSPLESLASSAVRTANSARATLIMVLTRGGSTARLVAKYRPGMPILSVVVPEIKTDFFDWSCSDESPARHSLIFRGLIPVLYAGSARASHDESTEEAIEFATQYGKEKELCKTGDSVVALLRVGNASVIKILTVK

SEQ ID NO: 12201 - protein, 309 aa, Prochlorococcus marinus str. MIT 9312
MTATISRPTISNWETSDIPNLNGKTALITGANSGLGYYTAKALAEKNAHVILACRSLEKANKSIQKLRASNPEGIFSPLELDLSDLNNVVEIQPKIFDDFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKPKNILSLAAHPGIAKTNLFTAQKPKPSPIETFSMELFSPIFQSAEMGALPQLFAATSPEARGGDHYGPKFNFRGYPKLSPTSPVAINKKERKNLWEKSLQILSNFL

SEQ ID NO: 12202 - protein, 358 aa, Gibberella zeae PH-1
MAPPKKGKEPQPKKATKTVEDRTFGMKNKKGGAAQREIGRMQANLKNGGTAEEKKKQAEKAAREREKKAAEDAKRDMEAMINRPAQIQKVPFGVDPKTVVCIFYKKGNCEKGKKCKFSHDLSVERKTEKKNLYTDKRGEEEETKKVETSADWDEDKLRSVVLSKKGNQQTTTDKVCKFFIEAIEDGKYGWFWICPNGGDKCKYKHALPPGFVLKTKEQRAAEKALMDKSPLKTLTLEDFLESERHKLTGTLTPVTPESFAKWKKDRLDKKAAEEQARNAKENTGRAMFESGKWRDEDDSDSEDDDDVWNLQKLREETENIRSKKEEERLMGSYETPNNGTTGQATPAEDTPAEEASGS

SEQ ID NO: 12203 - protein, 670 aa, Oryza sativa
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCARRNGGTGGAGASSGGTSSGTSTAASVQGK

SEQ ID NO: 12204 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 12205 - protein, 985 aa, Zea mays
MEVLCIGTADTKFEELLFLAAQLRSALAASGSDSKVQVSIVDVSTTEKTTANDFKDIIFIPRNTILSCHLGVDQHNLPDNRGEAIALMSKALQSFLKKRYDSGMLVGAVGLGGSGGTALIAPALRLLPLGVPKLIVSTVASGHTTPYVETSDLVLFPSVVDICGINSVSRVILSNAAAAFAGMVHGILSASNESDETSTKPTVGITMFGVTTPCVNAVKDRLNKEGYETLIFHATGVGGKAMEDLVRGGFIQGVLDVTTTEVADHIVGGIMACDETRFDAIIENKIPLVLSVGALDMVNFGARDTIPLAFADRNIHVHNEQVSLMRTTVEENKKFARFIADKINKSSSKVTVCLPQKGISAIDAPGMPFYDPEATSTLLGELNTLIQRTDIREVKLFPYHINDPEFANALVDAFLSMDVQASSSAQPKQDLNIGKSCSGQKISDSSIIWRTPVDFPDAKPEILRRTRSILHKLKEQISDGTPVIGAGAGTGISAKFEEAGGVDLIVLYNSGRFRMAGRGSLAGLLPFGDANDIVLQMANEVLPVVKGVPVLAGVCATDPFRRMEYFLRQLETIGFCGVQNFPTVGLFDGNFRQNLEETGMGYSMEVEMISMAHRMGFLTTPYAFNPDEAAAMAKAGAHIVVAHMGLTTAGSIGAMTAATLDDSVLRVQAIADAAFGVNPDIIVLCHGGPISGPLEAEFVLKNTKRVHGFYGASSMERLPVEQAITNTMRELRNVLIITVHSIMRTHEKMAPSLSPPSPTRPDAITLRSPSPEFIPNSATTPSNPSGAALGIEPRYPAASLEGRSKFQWSNESPVSSSSGSQRAPRSFKEAVLLNVGSSSEVVKEADCGCTADLSRVTARPCQEGDGWQVVGRRRARRTVPRLSPPVDLRGRCFNCFSPSHFAAACRRPTRCFGCRGLGHRALECPIKSVEKKAVWKPLKQQGVRVPVWQRLSGMHGPRQPGRAAPDIMRKGSVWQRITPSQPACG

SEQ ID NO: 12206 - protein, 493 aa, Zea mays
  misc_feature (473)..(473): Xaa can be any naturally occurring amino acid
  unsure (1)..(493): unsure at all Xaa locations
MRTLAPRPSQSRSLQQPRNLCRALHTGVQAAPGPALMNLAAFSSTLATLPWYEMPSINSSATFSSSLLRRSLCASLRTISHMASAAAPTSAPVATTENGAAKAIEQRPVQVAERLEKFKTTIFTQMSMLAIKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELEAAVSKDTKAIMINTPHNPTGKMFTREELESIAALCKENDVLLFSDEVYDKLVFEADHISMASIPGMYERTVTMNSLGKTFSLTGWKIGWAIAPPHLTWGLRQAHSFLTFATCTPMQAAAAAALRAPDSYYDELKRDYSAKKAILLEGLEAAGFIVYPSSGTYYIMVDHTPFGFDSDVEFCEYLIREVGVCAIPPSVFYLDPEEGKKLVRFTFXKDEDTLRGAVERMKTRLRKK

SEQ ID NO: 12207 - protein, 831 aa, Aspergillus nidulans FGSC A4
MTQLDLVEVDSLEAHVLIDNDLDPLSTISPDTVQVSGLMGHLAMNSPHHLKDRGDAHRELQMEDICCSAHGLSIILTATKGDQQHSILFDAGPEEEAWERNVRRMKPDLSSIELVQLSHWHRDHSGGLLRAVRMITEAKEAKGLSKDLIADLHPNRPDYRGFSIGENIISLQADPSFEELEAAGATVQKHDSAHTVLDDFFLISGEIPRRTPYEAGLKHGMRFDKEDNEWTSDEAIADERFIMCNVKADKGIVMLTGCSHAGVVNCTQHALELAGGSIPLHAVIGGFHLATSDANQIERSIKDLLKFDPAVLLPGHCTGWRAKFAIEKRQPGLLLLPTEYSKRPIRLFLYDRRFYLKGGIHAPMIPRDIISVTRFFFAVVKAQNEHRLYEFFKKSLEHGDPASPNCVESNIFGSFRVIQTREPEHLKAVLTGKFADFGKGELFHKLWIPFLGDSIFTTDGKEWQGSRNLIRPMFIKDRISDLDIFERKTQTMLSLYSPCGEPTDVVDLFYRMTLDAITEFLLGKGINSLENPQADFALAFADVQRIQTLLTMLGPAQYLYPRGRYNQGLKVINDFVWPFVHDTLGFQADDLKSSDKSFTFLHALANYTRSPKTIRDQVVSILLAGRDTTAATLSWAFYELSHYPEAYSKLRAEILDKVGPTRAPTYDDLKNMPYLRHTINEVLRLYPAVPYNIRFALTDTTLPIGGGVNGDLPITILKGDAVAYSTYAMQRRADLYPPVSEKFADPAIFSPERWEVWSPKPWHYVPFNGGPRICIGQNFALAEMGYTIVRILQRYERIEYVGDWERQFHKSEIVGTPGMGVKLRLYEARKP

SEQ ID NO: 12208 - protein, 603 aa, Phanerochaete chrysosporium
MPSSIDFPDRLVLRVIAYELVFLFYPAVPAAAGLVLLRRLTDIWLPTWAIVLLSVCSLPVVHGLSIWRNHWRAARKAARMGAVLPPRLKGRWPGSIDLLMRLTDAFETGFMSDLLWEYMHTIGQTFEVYVLWDSNYVTSDANVVKAILATDFTSFVKGKKFDVCMRSVLGTGVFNSDGDMWKFHRTMTRPFFTRERISHFDLFDRHADDAMAKMKARFAEGYAVDFQDLISRFTLDSATEFLFGQCVHSLASVLPYPHNAPAHLQTTSASAAEDFARAFAEAQTVLNFRIRMGWLWPWFELFGSRTKAPMAVVDAFLDPILKAAVERADKIKHANGGKVPEAKEEIDEDETLLDHLVKYTNDPKILHDEVLNIMIAGRDTTAGTLTSAVYFLSQYPEVLRRLREEILEKVGPTRRPTYDDIREMKYLRAFINETLRLYPAVPWNVRYPVKDTTIPGPEPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWAKAHLTLYAKGGLWVKMREAPTSEAV

SEQ ID NO: 12209 - protein, 500 aa, Thermoplasma volcanium GSS1
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 12210 - protein, 366 aa, Sorghum bicolor
RPLEYAWNKAANILFAESPAGVGFSYSNTSSDLSMGDDKMAQDTYTFLVKWFERFPHYKYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSQKAPFY

SEQ ID NO: 12211 - protein, 468 aa, Synechococcus sp. WH 8102
MASSTPFHDPPAWVADAVVYQIFPDRFRRSGQVKAQQHLELKPWGSDPREQGFQGGDLYGVIEALDQLQAMGISCLYLTPIFSSAANHRYHAYDYFEVDPLLGGNDALDTLIAALHQRGMRLVLDGVFNHCGRGFWAFHHLVENGQDSPYRDWFNVHRWPVKPYPAEGEDCGYDCWWAVPDLPKFNHANPAVRDHLLEVGRFWLERGIDGWRLDVPAEVPAEFWVDFRRVVREVNPDAWIVGEIWGDAREWLRGEHFDGVMNYRLGWSSLGWVAGDRLRQGYRNPEYPLNPLSSEDLIEIWSTTSGWYRPAVNRAQMNLLDSHDVPRALHSLDGDVKALKLALLLIFLQQGAPCVYYGTESGLCGGPEPACREAFPWGEPWPADLSSTIAALADLRRNQPNLIRGDLKWEPIGRDGLLGSTPGGLSVWVNRSTTTSLQIDPGISRIWSCGACDGQALEPQSAVVHLQG

SEQ ID NO: 12212 - protein, 138 aa, Streptococcus agalactiae A909
MEQTFFMIKPDGVKRGFIGEVISRIERRGFSIDRLEVRYADADILKRHYAELTDRPFFPTLVDYMTSGPVIIGVISGEEVISTWRTMMGSTNPKDALPGTIRGDFAQAPSPNQATCNIVHGSDSPESATREIAIWFNN

SEQ ID NO: 12213 - protein, 249 aa, Xylella fastidiosa 9a5c
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 12214 - protein, 553 aa, Synechococcus sp. WH 8102
MSQTMPWWTGTVIYQLIVRSFADGNGDGIGDFKGLASRLPYLRWLGVKTLWLTPTYPSPLRDGGYDITDFKDIHPDLGDLASFHRFLTAAHSQGMRVILDLVLNHTSDLHPWFQRARWAPKGSTERDVYVWSDDPSRYSDAPVLFRHFEASNWEWDPVAEQYYLHRFLSHQPDLNYANPWVQEAMLEVVDFWLERGVDGFRLDAVPFLFEEEGTRCEGLPETHAFLRRLRARVDAMGREVLLLGEAIQPVQEAAPYLAKDELHGAFNFVLTAHLFAAVASGSTRQLGDCLNEAEHAVDGPRWALPLRNHDELWLGDGHLIPDEVIQSIRVGLPQGQGHWLNWGINRRLAPLLNGDPRSNRLLHGLIYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALAHGSLQLLPCSHPGALVYVRATEAMTVLVAGNVTAAGASFSLDLTAWEGLRTREVMWGCEFPLASREWFVNLSPYGINWWLIGEVDTAVPVS

SEQ ID NO: 12215 - protein, 216 aa, Legionella pneumophila subsp. pneumophila str. Philadelphia 1
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFVTDNGNIILDVFNLSFSTPMALEDSLNVIPGVVENGVFAKRLADKVLVASASGVNNLK

SEQ ID NO: 12216 - protein, 261 aa, Thermus thermophilus HB27
MRLAFVGLGKMGRSILKGALERGFLRPEEVGVLGRTPERSRELAEPFGVRPLTRADLGMAERVLIAVQPRDFPALAPEIAHHRLGYISIMAGISTSVLARRLDNRRVVRAMPNLAVVIGESSTALTALKEAREAEDLAFARALFATVGDVYEIPEHLFDAFTGMSASAPAYLAVVAEALADAGVKMGMPRALALRLAADALAATGELLKGRHPAQVKDEVASPGGTTIHGLHALEARAVRAAFYEAVEAATRRGHELGESE

SEQ ID NO: 12217 - protein, 170 aa, Glycine max
  misc_feature (144)..(144): Xaa can be any naturally occurring amino acid
  misc_feature (161)..(161): Xaa can be any naturally occurring amino acid
  unsure (1)..(170): unsure at all Xaa locations
MSKLFHSACKAARSLIASSSAPAPRAASSLLADGRNAALATLANLGRNSTLPAAYAHHLHTNASSHGYAWIAAIPAAAYMLQDQDVHAAEMERTFIAIKPDGVQRGLISEIVSRFKRKGYKLVAIKLGGPSKQFAEKHYHDLKXRPFLSGLCDFLSSGPVXLAMVWEGKR

SEQ ID NO: 12218 - protein, 91 aa, Prochlorococcus marinus str. MIT 9312
MKVLITSPCSASLIIQYGIKSWPIWECEPSKFQWNYDDKEICLVIEGQAIISTQKGDIYLIKAGDLVEFPAGLSCEWEITKSIKKHYRLGS

SEQ ID NO: 12219 - protein, 118 aa, Lycium andersonii
NYSTTLNHCDHTKTYKKFKDNKEKSDLYKRWPDLTITEFDCLDKQAFWSREYMKHGTCCSDKFDRVQYFALAMALKDKFDLLKSLRNHGINRGYSYTVQKINSTIKAITRGYPNLTCA

SEQ ID NO: 12220 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSSSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 12221 - protein, 202 aa, Triticum aestivum
  misc_feature (65)..(65): Xaa can be any naturally occurring amino acid
  misc_feature (74)..(74): Xaa can be any naturally occurring amino acid
  unsure (1)..(202): unsure at all Xaa locations
MAARAVTMLALVVAAAVLAGGASAQSPTSGCTQTLIGMSPCLNYITGNETAPSKSCCSQLASVVXSKPECLCVXLNADPAALGLGTVNKTRAFGLPEQCGVKTPPLSNCRSGPTTSPSFGGPGGKTPNSSGRRSQVNTPRRTWGTGRPSPPKLGRDSSPVFHGAAGFPPLPPRCFVNVMAGETRSFFFCVSYMEVAFHFGKL

SEQ ID NO: 12222 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 12223 - protein, 142 aa, Wigglesworthia glossinidia endosymbiont of Glossina brevipalpis
MKIEQTLSIIKPNIISNNFIGNIINRLEQAKLYIIASKMIKLSWKEAVSFYIEHKNKSFFSDLINFMISHPIIVQILEGENAIKRNREIMGNTNPKIALAGTLRSDFSNDIIKNGVHGSDSEESADREIKFFFKKDRIFSRI

SEQ ID NO: 12224 - protein, 387 aa, Spinacia oleracea
METSMACCSRSIVLPRVSPQHSSALVPSSINLKSLKSSSLFGESLRMTTKSSVRVNKAKNSSLVTKCELGDSLEEFLAKATTDKGLIRLMMCMGEALRTIGFKVRTASCGGTQCVNTFGDEQLAIDVLADKLLFEALNYSHFCKYACSEELPELQDMGGPVDGGFSVAFDPLDGSSIVDTNFSVGTIFGVWPGDKLTGVTGRDQVAAAMGIYGPRTTYVLALKDYPGTHEFLLLDEGKWQHVKETTEINEGKLFCPGNLRATSDNADYAKLIQYYIKEKYTLRYTGGMVPDVNQIIVKEKGIFTNVISPTAKAKLRLLFEVAPLGFLIEKAGGHSSEGTKSVLDIEVKNLDDRTQVAYGSLNEIIRFEKTLYGSSRLEEPVPVGAAA

SEQ ID NO: 12225 - protein, 365 aa, Mesembryanthemum crystallinum
MAAAVTAAVSFPSTKSTPLSTRTSSVITHEKINFNKVPLYYRNVSVGGKVGTIRAVASDVEAPVAKVEKHSKKMEEGVIVNKYKPKNPYTGRCLLNTKITGDDAPGETWHMVFSHEGEIPYREGQSVGVIPEGIDKNGKPHKLRLYSIASRPLGDFGDSKTVSLCVKRLIYTNDNGEIVKGVCSNFLCDLKPGSEVVLTGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDRELWELLKKDNTYVYMCGLKGMEKGIDDIMVSLAAEDGIDWFDYKKQLKKAEQWNVEVY

SEQ ID NO: 12226 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 12227 - protein, 751 aa, Parvularcula bermudensis HTCC2503
MGSTFFPVILSGGSGTRLWPISRSYSPKQLETLFGDASLLVHTARRLRAHPGAGPVNILCSSRYGQRIVDQLEADGLNWSTLIEEPMGRDTAAAAGIAASWARATHGDEAVVVLLPADHYVDDLNAFHDALTKAVEAAAHGRIALIGITPDGPNTGYGYIRREQDKLDGLTCYPIRAFVEKPDLTKARAYVESGDYLWNSGIYAMRADVFLEELVRYEPKIAQGVAAAFDGRTVTDRSGRQILRFSADQFSAIPKTSIDYAVAERTHKGAVARGHFPWSDIGNWQSLRELTADPETGNSLKGQVVLHNSRECLVYGHNKPIAVVGLEKVTVVDTEDALLVCADDSVQSVKDVHTILAEEANACALHRSGDLDGALIRHRAWASDWLMRQAFPRWASDGIDPRHGGSVETLDEAGRPATDAPTRCRVQARQIYAYAKALELGWSGAAPILEGLVSFYTTNCRGEQGGYIYATHPDGTPADETIDTYDQAFSLFAFAWAYKATGDLRFRKLGEEAFSFLEEHLDHPQGGYREGVDVGGPRRANPHMHLLEAGLAWADLHGEERGLRLANEMVGLYKERFRVDGVLREYFEDDLSPILSHDNDALTEIMPGHLYEWSWLLKEYERVTGTPAPSPAVPIAFAEQFGHVKTLGLVADAIGADGRQAEGATSRLWPQTEFIRWHLSFGSAPQKLAALAMLDRMKEAFLFEGEAKAGLWRDQLRADGTIIKNVSPASTFYHLVGCLTVPDLILSRPRS

SEQ ID NO: 12228 - protein, 484 aa, Synechococcus sp. WH 8102
MGQFDQNRRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSSEEAPVNMI

SEQ ID NO: 12229 - protein, 427 aa, Staphylococcus epidermidis RP62A
MSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 12230 - protein, 145 aa, Haemophilus somnus 2336
MERPMTLEQTLAIIKPDAVERNLIGNIISRLEDKGFQIIAMKMLHLNQEQAEGFYAEHRNKAFFTELVKYMTSAPIVVLVLQKENAVKDYRTFMGTTNPEIAENGTLRYEFAINQTQNSVHGSDSLENAQREIAYFFAEAEIYAR

SEQ ID NO: 12231 - protein, 435 aa, Xylella fastidiosa 9a5c
MNQIRQAPATSASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFADTFPQRIDEYETLLTDNRIWKQRTVGVGVIEPDVAKAWGMTGVMLRGSGVAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 12232 - protein, 408 aa, Oryza sativa (japonica cultivar-group)
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVCELLLK

SEQ ID NO: 12233 - protein, 986 aa, Lotus japonicus
MRIRVSYLLVLCFTLIWFRWTVVYSSFSDLDALLKLKESMKGAKAKHHALEDWKFSTSLSAHCSFSGVTCDQNLRVVALNVTLVPLFGHLPPEIGLLEKLENLTISMNNLTDQLPSDLASLTSLKVLNISHNLFSGQFPGNITVGMTELEALDAYDNSFSGPLPEEIVKLEKLKYLHLAGNYFSGTIPESYSEFQSLEFLGLNANSLTGRVPESLAKLKTLKELHLGYSNAYEGGIPPAFGSMENLRLLEMANCNLTGEIPPSLGNLTKLHSLFVQMNNLTGTIPPELSSMMSLMSLDLSINDLTGEIPESFSKLKNLTLMNFFQNKFRGSLPSFIGDLPNLETLQVWENNFSFVLPHNLGGNGRFLYFDVTKNHLTGLIPPDLCKSGRLKTFIITDNFFRGPIPKGIGECRSLTKIRVANNFLDGPVPPGVFQLPSVTITELSNNRLNGELPSVISGESLGTLTLSNNLFTGKIPAAMKNLRALQSLSLDANEFIGEIPGGVFEIPMLTKVNISGNNLTGPIPTTITHRASLTAVDLSRNNLAGEVPKGMKNLMDLSILNLSRNEISGPVPDEIRFMTSLTTLDLSSNNFTGTVPTGGQFLVFNYDKTFAGNPNLCFPHRASCPSVLYDSLRKTRAKTARVRAIVIGIALATAVLLVAVTVHVVRKRRLHRAQAWKLTAFQRLEIKAEDVVECLKEENIIGKGGAGIVYRGSMPNGTDVAIKRLVGQGSGRNDYGFRAEIETLGKIRHRNIMRLLGYVSNKDTNLLLYEYMPNGSLGEWLHGAKGGHLRWEMRYKIAVEAARGLCYMHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWVNKTMSELSQPSDTALVLAVVDPRLSGYPLTSVIHMFNIAMMCVKEMGPARPTMREVVHMLTNPPQSNTSTQDLINL

SEQ ID NO: 12234 - protein, 685 aa, Lotus japonicus
MPLLSSQNYITVTQNQSIQDDETLVSAEGTFEAGFFGLGNSQRQYFGIWYKSISPRTIVWVANRDAPVQNSTATIKLTDKGNLLILDGSKGIIWSSNGSRAAEKPYMQLLDSGNLVVKDGGKRKKNLIWESFDYPGDTLLAGMKIKSNLVKGPTSYLTSWRNTEDPASGEFSYLIDTRGFPQLVITRNATAYYRAGPWTGKLFSGSSWLRLRKILTFSMQFTSQEISLEYETANRSIITRAVINPSGTTQRLLWSDRSQSWEIISTHPTDQCTYYGLCGANSMCDISNNPICHCLEGFRPKFQAKWNSFDWPGGCVPMKNLSCQNGDGFLKHTGVKLPDTSSSWYGKNKSLDECGTLCLQNCSCTSYAYLDNDIGGSACLIWFGDILDLSIHPNPDQGQEIYIKVVASELDHRRNKKSFMTKKLAGSLAGIVALVICIIILGLATSTCIQRKKNERGDGDSTRSKLLDWNKRLQIIDGIARGLLYLHQDSRLRIIHRDLKTSNILLDNEMNPKISDFGLARIFIGDQVEARTKRVMGTGYMPPEYAVHGSFSIKSDVFSFGVIVLEIISGKKIRKFYDPHHHLNLLSHAWRLWIEGSPLELVDKLFEDSIIPTEILRYIHVALLCVQRRPETRPDMLSIVLMLNGEKELPKPSLPAFYTGKHDPILLESPSRRCSTSVTISLEAR

SEQ ID NO: 12235 - protein, 151 aa, Eremothecium gossypii
MSDERTFIAIKPDGVQRGLISKILSRFESRGYKLVGIKLVTPTENLLKQHYAEHVEKPFFPKMLAYMTSGPILATVWEGKDVVKQGRVILGATNPLNSAPGTIRGDFALDMGRNVCHGSDSVESAQREIDLWFKKEELVDWKLNQLSWIYE

SEQ ID NO: 12236 - protein, 865 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDQCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGEIGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKIGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 12237 - protein, 826 aa, Lotus japonicus
MAQKQSIQDDETLVSPEGTFEAGFFRFGNSLRRYFGIWYKSISPRTIVWVANRDAPVQNSTATLKLTDQGNLLILDGLKGIVWSSNASRTKDKPLMQLLDSGNFVVKDGDKEENLIWESFDYPGDTFLAGMKIKSNLATGPTSYLTSWRNAEDPASGEFSYHIDTHGYPQLVVTKGATVTLRAGPWIGNKFSGASGLRLQKILTFSMQFTDKEVSLEYETVNRSIITRTVITPSGTTQRLLWSDRSQSWEIISTHPMDQCAYYAFCGANSMCDTSNNPICDCLEGFTPKFQAQWNSLDWTGGCVPIKNLSCQNGDGFPKHTGVQFPDTSSSWYGNSKSLDECGTICLQNCSCTAYAYLDNVGGRSVCLNWFGDILDMSEHPDPDQGQEIYLRVVASELDHRRNKKSINIKKLAGSLAGSIAFIICITILGLATVTCIRRKKNEREDEGGIETSIINHWKDKRGDEDIDLATIFDFSTISSTTNHFSESNKLGEGGFGPVYKGVLANGQEIAVKRLSNTSGQGMEEFKNEVKLIARLQHRNLVKLLGCSIHHDEMLLIYEFMHNRSLDYFIFDSRLRIIHRDLKTSNILLDSEMNPKISDFGLARIFTGDQVEAKTKRVMGTYGYMSPEYAVHGSFSVKSDVFSFGVIVLEIISGKKIGRFCDPHHHRNLLSHSSNFAVFLIKALRICMFENVKNRKAWRLWIEERPLELVDELLDGLAIPTEILRYIHIALLCVQQRPEYRPDMLSVVLMLNGEKELPKPSLPAFYTGNDDLLWPESTSKNCERVIKHVILNGFMVPTANLHFCKFLGGRDRDDPMTFKPEGHEQP

SEQ ID NO: 12238 - protein, 353 aa, Triticum aestivum
MMAGASGSVEEEGGLRAEESPSGGVDVWSDAVSSHAPEHLLVMVHGILGSTNDWQYAANEFVKQLPDDVIVHCSEKNMNTLTLDGVDVMGERLADEVLDVISRKPELTKISFLAHSVGGLVARYAIAKLYRHPNSTFDSKAEGTVCGLEAVNFITVATPHLGSRGNKQVPLLFGFITIEKVASRVIHWIFRRTGRHLFLTDSAEGEPPLLQRMVEDYGDLYFISAVRAFKRRVAYANADCDHIVGWRTSSIRRNTELPKWEESVCEKYPHIVHEVYSEEISDEKCQDLAADCDFDLLEEKMVTGLRRVSWEKVDVSFHTSMRSFAAHSIIQVKYAFMNEGADVIQHIIDHFQL

SEQ ID NO: 12239 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPLNFTGLSKAVKKGDTIFIGKYLFTGSETASVWLEVSEVEGEDVTCLVKNTATLSGSLFTVHVSQIHIDLPTLADKDKEVISTWGVQNNIDFLSLYTRHVEDIRHAREFLSKLGDLKQTHIYAKIENIEGMKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPTMPVISVVIPQLKTNQLRWTFTGAFEARQSLIVRGLFPMLADPRHPAESRSGTNESILKVALDHGKAFGIIKPHDRVVVCQKVADSSVVKILELED

SEQ ID NO: 12240 - protein, 333 aa, Aspergillus nidulans FGSC A4
MGGLFGQLFTKLTLPPASAVDGKTILITGGNTGLGREAARHALALGAATVILGVRTLSKGEEAKADIESSTGNSGRNKVLVWPIDLESFASVQAFAERARNYVAGENGRLDLAIMNAGIASVMWAVTPDGWERHLQINVLSTALLSLKLLPLLRHTAEQHPQDWQRPHLVIVTSDSHESVKFPERTADRIFPVLNDQGQWAKSQRLGGPIERYGVSKLMAILMTEDIARLVPRSTQGDPLVVVNSVAPGFCKSELLTRESVPWFLKVIEALVARSAQEGSKTLLDSATRGIASHGKWLENQAITTPGKLVTDPNEAAYKKKEARHSQSTSEHS

SEQ ID NO: 12241 - protein, 850 aa, Neurospora crassa
MASKRKASAMATEPEEPVDPADELMFLNLGGGNEVGRSCHIIQYKGKTVMLDAGQHPAYDGLAALPFFDDFDLSTVDVLLISHFHIDHAASLPYVLAKTNFRGRVFMTHATKAIYKWLIQDSVRVGNTSSNPQSSLVYTEEDHLKTFPMIEAIDYNTTHTISSIRITPYPAGHVLGAAMFLIEIAGLKIFFTGDYSREEDRHLISAKVPKGVKIDVLITESTYGIASHIPRPEREQALMKSITGILNRGGRVLMPVFALGRAQELLLILDEYWGKHAEYQKYPIYYASNLARKCMLVYQTYVGSMNDNIKRLFRERLAESESSGDGAGKGGPWDFRFIRSLKSLDRFEDVGGCVMLASPGMLQNGVSRELLERWAPSEKNGVIITGYSVEGTMAKQLLQEPEQIQAVMSRNIAGARRGPGGDAEKVMIPRRCTVQEFSFAAHVDGVENREFIEEVAAPVVILVHGEVHNMMRLKSKLLSLNATKEHKVKVFSPRNCEELRIPFKTDKVAKVVGKLASIPPSLKEAKTGHDGPLPSSTEPQLITGVLVQNDFKMSLMAPEDLREYAGLTTTTIACKQRLKLSAAGIDLIKWGLEGTFGAVEELPEVKPKLEIVKSENGDTKMEEADEELPHGDDVVAAYLVMGCVTVRYRASGEVELEWEGNMLNDGIADAVMAVLLGIESSPAAVKRSATKNPHTHSPLPADKNPHSHLTPEDRFFRLCMFLEAQFGQDNVSPIVEPKLPPLSPTTKAITSPSEETAKSSDVKSDADADASMDVSEEDEDEQQLKARERAEVERLERMGIPKPGVRIKVDKMEAKVWLEDLEVECANKIFRERVRAVVERAVEVVAPLWG

SEQ ID NO: 12242 - protein, 276 aa, Kineococcus radiotolerans SRS30216
MTYATEPPPPVPGRRRTRVHHFQQWKDAGEKWAMLTSYDAMTAAVFDEAGIPALLVGDSAANTVFGMPTTLPVTLDHLLPLVRAVVAGAPHAFVVADLPFGSYEVSDDLAVASAVRVMKEGGAHAVKFEGGARRAGRVRAVVEAGIPVMAHIGFTPQSEHALGGYRVQGRGEAGEQVLADARALAEAGAFAVLMEMVPADVAAQVTRTLAVPTVGIGAGSGTDGQVLVWQDFAGLSERTAKFVKRFADVRTALSDAARQYAEEVRGGSFPGPEHSF

SEQ ID NO: 12243 - protein, 447 aa, Kineococcus radiotolerans SRS30216
MDRQQEFVLRTLEERDIRFVRLWFTDVIGTLKSVAIAPAELEGAFGEGIGFDGSAIEGLSRVSESDMLLKPEPSTFQVLPWRASDEHQGTARIFCDILTPDGQPARSDPRFVLKRALDRAAQRGYTFYTHPEIEFYLFKTPLERGAVPEPVDYVGYFDNHPGSTTTDFRRTAISTLESMGISVEFSHHEGGPGQNEIDLRYADALTTADNIMTFRTVLKEVARDQDVYASFMPKPLAGEPGSGMHTHLSLFDGDANAFYEAGAEYQLSRTGRQFIAGILRHAAEITAVTNQFINSYKRLWSGGEAPSYVCWGHNNRSALVRVPMYKPSKGQSVRIEYRALDSAANPYLAFALLLSAGLKGIEEGYDLPDGAEDDVWSLTDAERRSMGIEPLPQSLEHAIAVMERSELVAETLGEGVFDYFLRNKRQEWADYRAQVTPFELQRYLPLL

SEQ ID NO: 12244 - protein, 117 aa, Lycium andersonii
IQGTVLNNCDSQAKYTTVTDDKFDKRDKHWPDLKLSKADALKHQDFWEYQFKKHGTCCADLFNEEKYFDLALGLKDRFDLLTTFRSHGIIPRSTHLLIKSLKPSGQSLGVIPNLYCT

SEQ ID NO: 12245 - protein, 949 aa, Bacteroides thetaiotaomicron VPI-5482
MKTDLLASRHIGINEEDTAVMLRKIGVDSLDELINKTIPANIRLKEPLALAKPLTEYEFGKHIADLASKNKLYTTYIGLGWYNTITPAVIQRNVFENPVWYTSYTPYQTEVSQGRLEALMNFQTAVCDLTAMPLANCSLLDEATAAAEAVTMMYALRSRTQQKAGANVVFVDENIFPQTLAVMTTRAIPQGIELRVGKYKEFEPSPEIFACILQYPNSSGNVEDYADFTKKAHEADCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYAVYHGQEGIKTIASRIHSITVFLDKQLKKFGYTQVNAQYFDTLRFELPEHVSAQQIRTIALSKEVNLRYYENGDVGFSIDETTDIAATNVLLSIFAIAAGKDYQKVEDVPEKSNIDKALKRTTPFLTHEVFSNYHTETEMMRYIKRLDRKDISLAQSMISLGSCTMKLNAAAEMLPLSRPEFMSMHPLVPEDQAEGYRELISNLSEDLKVITGFAGVSLQPNSGAAGEYAGLRVIRAYLESIGQGHRNKILIPASAHGTNPASAIQAGFETVTCACDEQGNVDMGDLRAKAEENKEALAALMITYPSTHGIFETEIKEICEIIHACGAQVYMDGANMNAQVGLTNPGFIGADVCHLNLHKTFASPHGGGGPGVGPICVAEHLVPFLPGHSIFGSTQNQVSAAPFGSAGILPITYGYIRMMGTEGLTQATKIAILNANYLAACLKDTYGIVYRGATGFVGHEMILECRKVHEETGISENDIAKRLMDYGYHAPTLSFPVHGTLMIEPTESESLAELDNFVDVMLNIWKEIQEVKNEEADKNDNVLINAPHPEYEIVNDNWEHSYTREKAAYPIESVRENKFWVNVARVDNTLGDRKLLPTRYGTFE

SEQ ID NO: 12246 - protein, 474 aa, Kineococcus radiotolerans SRS30216
MFSNAEEVLAFIAQEDVKFVDIRFCDLPGVMQHFTIPAKSLDLDALSEGQMFDGSSIRGFQAIHESDMKLIADPTSAFLDPFRKEKTLVINHSIVDPFTNEAYSRDPRNIAAKAESYLKTTGIADTVFFGPEAEFYIFDDVRFETNQRESYYHIDSIEAAWNTGRKEEGGNLGYKTRYKGGYFPVAPIDHFSDLRDEMVVELEKAGLQVERAHHEVGTAGQAEINYKFDTLKNAGDQLLLFKYIIKNVALRNGHTVTFMPKPLFGDNGSGMHCHQSLWKDGEPLFYDEKGYGGLSDLARWYIGGLLHHAPSLLAFTNPTVNSYHRLVPGYEAPVNLVYSARNRSACIRIPITGSSPKAKRIEFRVPDPSANPYLAFAAQLMAGLDGIKNRIEPADPVDKDLYELPPEEHANIKTVPYDLGSVLDALEADHDYLLEGGVFTPDLIETWIDYKRTNEIDPIRLRPHPHEFELYYDI

SEQ ID NO: 12247 - protein, 182 aa, Mesembryanthemum crystallinum
MASSMVSSAAVATVNRTPAQASMVVPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELREAKKAYPEAFIRIIGFDNVRQVQCISFIAYKPASYDA

SEQ ID NO: 12248 - protein, 307 aa, Erythrobacter sp. NAP1
MTTSGITDWTPDELPDLTDKRFLITGGNSGIGFEAAKILASKNGDVVIACRSEEKGKQALAKLVNEGEGRCELLRMDLADMSSIRAAADEAKDRFGAIWGLVNNAGVMQTPKFKTKDGFELQLGTNHLGHFLWTALMMDQVDGRGGRVVTVASIAHKFGRIDFDNLMMERGYDRSRAYLRSKLANLLFAMELHRRLDAAGSKVKSVACHPGYSSTPLLSKTQNPLSRIVNGVSSAVFAQSPVRGSWPTALAAADDRAESGGYYGPTGFFDARGPVGDSDVEARALDETVAKRLWGVSEELVGETFSI

SEQ ID NO: 12249 - protein, 669 aa, Saccharomyces cerevisiae
MNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 12250 - protein, 474 aa, Frankia sp. EAN1pec
MSIDRLPTAGHTGAQAPGPGRATPAFLRELLADPLRLFTRLRTSYGPIVRVPVGRGGFHLVCGPEAVEQVLVGEQRAYAKGLRRRTMPPGEGIQPLSLLLGSGLLTSGGDLHRTRRRLIQPMFHRERIAGYGAAISELSRATALGWADGSRREVHTDMSELTLAIVARTVFGVDVDSEVVRRVRRAVAANMRLSQLAVLPGAIRLQQHLPIGPLRAARDARDDLTAVVMEMIEQRRSLDAAGSDLLSTLLATRDADTGAPLDDTSIRDEALTILLAGHETTANAMAWAYHLLATNPQARDRMHTELDDVLNGRKPTTADLAELPYTRAVFSETLRLYPPAWILLRRTTRDVTLTGYHLPADTNVLLSQWVIHRDPTWWPAPEEFRPQRWLTPDPTRPKYAYFPFGGGTRQCIGNTFAEMEGALALAAISSIRTLTPTPGRPVTPIPRVTLRPQPLQMTAHPRTPHPTPATHKPH

SEQ ID NO: 12251 - protein, 259 aa, Neisseria meningitidis Z2491
MKEHKARKRFGQNFLQDTRIISDIVNAVRPQADDVVIEIGPGLAAITEPLAKKLNRLHVVEIDRDIVCRLKTLPFADKLVIHEGDVLQFDFNGIAGKKKIVGNLPYNISTPLLFKLAEVADDVVDMHFMLQKEVVDRMVAAPKSNDYGRLGVMLQYFFDMEMLIDVPPESFDPAPKVDSAVVRMIPVKHRIGKADDFEHFAKLVKLAFHQRRKTIRNNLKELAGDDDLQAVGINPQDRAEHIAPEKYVALSNYLAGKAV

SEQ ID NO: 12252 - protein, 450 aa, Zea mays
  misc_feature (135)..(135): Xaa can be any naturally occurring amino acid
  unsure (1)..(450): unsure at all Xaa locations
MRRVGTGVRMLCGAALSVLLLLAGGAAASHSRSSCPATPPDAGNTLQVSHAFGPCSPLGPGTAAPSWAGFLADQASRDASRLLYLDSLAVRGRARAYAPIASGRQLLQTPTYVVRASLGTPPQQLLLAVDTSNDXSWIPCAGCAGCPTSSAAPFDPASSASYRTVPCGSPLCAQAPNAACPPGGKACGFSLTYADSSLQAALSQDSLAVAGNAVKAYTFGCLQRATGTAAPPQGLLGLGRGPLSFLSQTKDMYEATFSYCLPSFKSLNFSGTLRLGRNGQPQRIKTTPLLANPHRSSLYYVNMTGIRVGRKVVPIPAFDPATGAGTVLDSGTMFTRLVAPAYVAVRDEVRRRVGAPVSSLGGFDTCFNTTAVAWPPVTLLFDGMQVTLPEENVVIHSTYGTISCLAMAAAPDGVNTVLNVIASMQQQNHRVLFDVPNGRVGFARERCTAA

SEQ ID NO: 12253 - protein, 484 aa, Legionella pneumophila subsp. pneumophila str. Philadelphia 1
MLIFELSKTGRQAKAQIPRAVSKNYSIPEEFQRKSPPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIASLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPDRRASHEFILTLNSEKKNYDVTAMDFAKRLLDYGVHAPTTYFPLLVPECLLIEPPETESKEELDAFVAVMKIIREEASKQPDILKAAPHTLPVKRLDDVKAARELDLNYFATHE

SEQ ID NO: 12254 - protein, 429 aa, Listeria monocytogenes
MQNYSKSEKAFKEAKKVLPGGVNSPVRAFNSVDASPVFMDHGKGAYITDVDGNEYIDYVLSWGPLILGHTDPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 12255 - protein, 202 aa, Zea mays
MLTRRHGGFRLGRKLLSVWRWALCRRRRRRVRGRGYLRLQPCQRGGGTTKSPSPSPMAAHAVVSIKMMQQQQQKHDDSAGSPRMLTWGRSLARRVRLLRRRGGGGGKDRLLEDAAADATTPKGQVAVYVGGGGESMRYVVPVVYFNHPLFGELLREAEEEFGFQHPGGITIPCAASRFERAAAVAAAGGGAAAGKKVPSVWW

SEQ ID NO: 12256 - protein, 181 aa, Triticum aestivum
MAPTVMASSATSVAPFQGLKSTAGLPVSRRSNGASLGSVSNGGRIRCMQVWPIEGIKRFETLSYLPPVSTEALLKQVDYLIRSKWVPCLEYSKVGFIFREHNASPGYYDGRYWTMWKLPMSGCTDATQVINEVEEVKKEYPDAYVRIIGYENMRQVQCVSFIAFKPPGCEESGKAYTAHSR

SEQ ID NO: 12257 - protein, 456 aa, Legionella pneumophila subsp. pneumophila str. Philadelphia 1
MPYIPHTPDDTKEMLEAIGAQDIQDLFDEIPASLQYAGFQNIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLIAGTVHPFYRETIETIVRNQHIEVITLPFDEQQGITNLGSLNQYTGEDITALVIAQPNFFGCLEQVDKMTSWAHHNKTISVACVNPTSLALLKPPGSWGEHGVDIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVELAFKAPFFHEALIKLNQPVQSVLQQLADAGIAGGYAPEQHYPQLANTLLVCATEVRTAEDIAKYAKTLKTIMSKRGA

SEQ ID NO: 12258 - protein, 279 aa, Bacillus clausii KSM-K16
MKTTKTFKQMKRDGEPIAMLTAYDAPSARLAERAGVDMILVGDSLGMVVLGYDSTVPVSVDDMVLHTKAVKRGAPNTFVVTDMPFLTYHSSFSETAGHVRRLLQEAGADAVKLEGGTDIASTVQRLTAAGVPVVGHIGLTPQSVGVLGGYRVQGKAQEEGEQLLADAQALEQAGAFAIVVECVPKQLGALLAKEINVPIIGIGAGAETDGQVLVYHDVIGYESERVAKFVKQYTAVSPIIEEGLASYVTDVKQRAFPEEAHTYTTNDTGWLAVYGGDKK

SEQ ID NO: 12259 - protein, 321 aa, Bacillus clausii KSM-K16
MKGQLLALLQSGVYISGEEMSRKLGVSRTAVWKQLSALREQGYELESAPKKGYRLLSSPDTLLAHDIEAHLQTKTLGRNIHSYDSVASTQPLAHEEAAREAREGTLIVANEQQGARGRLGRQWQSTKGTSLSMSLLLRPDISVSQAPQLTLLAAVAVTRAIEAVSGLVCDIKWPNDILYGGKKLVGILTEMAADPDRVNYCIVGIGINCNQESNDFAETLAGIATSIKLETGNPVQRAKLVAAVMNEFEWLYDEYIKNGFAAIRPLWEARSVSLHTKLSARTPSRIVQGYSLGITDDGRLRIQDEDGQEHLIYSADIELDN

SEQ ID NO: 12260 - protein, 63 aa, Arabidopsis thaliana
  misc_feature (10)..(10): Xaa can be any naturally occurring amino acid
  misc_feature (16)..(16): Xaa can be any naturally occurring amino acid
  misc_feature (21)..(21): Xaa can be any naturally occurring amino acid
  misc_feature (37)..(38): Xaa can be any naturally occurring amino acid
  misc_feature (47)..(47): Xaa can be any naturally occurring amino acid
  misc_feature (50)..(50): Xaa can be any naturally occurring amino acid
  misc_feature (53)..(53): Xaa can be any naturally occurring amino acid
  misc_feature (59)..(62): Xaa can be any naturally occurring amino acid
  unsure (1)..(63): unsure at all Xaa locations
MASSMLSSTXVVTSPXQATMXAPFTGLKSSASFPGTXXANNDITSFXSKXGRXSCMKVXXXXL

SEQ ID NO: 12261 - protein, 357 aa, Aspergillus nidulans FGSC A4
MPGQIMRAVVFKGPYKVAVEERPIPKIQNPEDIIIKATYTALCGSDLHVYRGIEPAGTGFVMGHEVTGEVVEVGDAVKTVQRGDLVVSAFTTSWISGTCFYCEQGFSSRCDENTLLGCDDLDGAQAEYVRIPHADGTVVKAPSGVSPQYLVLMGDIFPTGYFAAQNAFKNATAAQIAEQTVVIIGCGPVGLCALINALEYKPKHLLAVDCVPSRLDLAKSLGAEPWDFKNDREALDRRVSELTNGRGADAVIEVVGMSPALRMGFELLRPWGVISSVGVHNGEIPWTGSEAYGKNVTVQMGRCPVRSVSDAALEVLKKNQHLLGFMTENIMPLSQAAEAYDLFNAMKVQKVIFEAGK

SEQ ID NO: 12262 - protein, 397 aa, Nitrosomonas europaea ATCC 19718
MKLSQRVQAIKPSPTLAVTAKAARLKAEGKNIIGLGAGEPDFDTPLHIKDAAITAIRNGFTKYTAVGGTASLKQAIISKFKRENSLEFMPGEILVSSGGKQSFFNLVLATIDPGDEVIIPAPYWVSYPDIVLIAEGKPVFIDTGIEEKFKISPDQLEKAITPRTRMFVVNSPSNPSGSVYSLEELQALGAVLRKYPDILIATDDMYEHILLSGDGFVNILNACPDLKARTVVLNGVSKAYAMTGWRIGYCGGPAAIITAMENIQSQSTSNPNSIAQVAAEAALNGDQSCMVPMIEAFRERNQFLTNALNSIAGIHCLLSEGAFYAFVDVRQAISRLNTQQILQNSSDIAFCNYVLEKAEVAAVPGSAFGCEGYMRLSFATSMDNLQEAVKRIASLLS

SEQ ID NO: 12263 - protein, 411 aa, Haloquadratum walsbyi
MTTIKDSVHDHIEIQGVAAALLDTPPIQRLRRVTQLGTVHLVYPAANHTRFEHSLGVYHLMNRALSHLDLDGPRAERLRAAALLHDVGHSPYSHNLEPVIHRYTGKYHDDVTNLLVDSAVGDTLSDRGYDPERIAALIRGDGKYGQLISGELDVDRMDYLVRDAHHTGVPYGTIDHERLIRALTFVDGELVLAAGNVQTAESLLLARALMNPTVYRHHVARISKTMLRRAAEQLITTDTTAITASQLRRMDDHDLHVALRSTKATTHIASRLDTRDLYKRAVWAELDTVPESVINADHDTIRSFERTVADRVGLDSEEVIIDIPGHPSMTESSSRVVVSGEVRRLADQSPLVSALRTAQKQQWRLGVYVPATATDRAGIDAVETMGLDISGAPVSDIQHKTVTATLDEFSD

SEQ ID NO: 12264 - protein, 560 aa, Zea mays
  misc_feature (55)..(55): Xaa can be any naturally occurring amino acid
  unsure (1)..(560): unsure at all Xaa locations
MGSSGFSWTLPDHPKLPKGKPVAVVVLDGWGEANPDQYNCIHVAQTPVMDSLKNXGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 12265 - protein, 514 aa, Zea mays
SSSATDDSQDSAGASVHHGRVRVKVRQSGKSYKELSGLFMNQEIQAHNGSIWSIRFSPDGRYLASAGEDCVIHVWEVSEFERKREENGACNPFVAMVCNGSPEPTLALASSLDGSNREKKRRARFLEGRRSVSSDRLMVPEHVFALSEKPIRTFVGHSEDVLDLCWSKSQYLLSSSMDKTVKLWHISSASCLKTFSHSDYVTCIQFNPVDDRYFISGSLDEKVRIWSIQNREIVDWKDLHEMVTAACYTPDGQSALIGSHKGSCHIYDTSDNKLLQKKQIDLQNKKKKSSQKKITGFQFLPGSTSRVLITSADSRIRVFDGLNLVHKYKGFRNTNSQISACLAANGRYVISASEDSHVYIWRNDGSLEKGRSKANVTVTSSYEHFHCQDVTVAVAPPSNGSAVVSRSNSTKHDERDSVLEHPLLHAVPEKLQDSSDLQPQSGNILSTSSNHSGDRATWPEELMTPTKQSPQSSASLLSGADQAPCWSAWGTVIVTAGRGGQIRAFQNFGFPARV

SEQ ID NO: 12266 - protein, 235 aa, Streptomyces coelicolor A3(2)
MTTTLITGANKGLGFETARRLLAAGHTVYAAARDPERGRRAAEELGARPLVLDVTDDASVAAAVRTVTAGGGLDVLVNNAGIEQRGEHNSVTGAEGTTADLLRTVFETNVFGVVRVTHAFLPLLRRSAAPVVVNVSSGLASLTGLTSPRSPGYGYPGLAYPASKTAVNALTVQYAKAFPGMRINAVEPGFTATDLNGNTGTQTVAEGAEVIVRMARLGPDGPTGGYFDAAGPLAW

SEQ ID NO: 12267 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 12268 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 12269 - protein, 467 aa, Wigglesworthia glossinidia endosymbiont of Glossina brevipalpis
MSINEIINIIEKNNIKFIDFRFTDMVGKEQHITVPFLKKEKINKILKNGKIFDGSSILGWKKIQNSDVLLIPDLTTAVLDPFYNDSTLIIKCDIFESNKSESYNKDPRSIAKNAEKYLQYSKIGDKMYFGPELEFFLFDDIRFYTAIHGSQVIINDIESSWNSGKYYSQGNKGYRPSVKSGYLPVPPVDSSQNIRSSMCLFMEKMGIEVEAHHHEVATSGQNEISTKYNTLTKKADEVQIYKYIVHNTAYFFKKTATFMPKPIRGDNGSGMHCHISIEKEGKNIFFGKEYGNLSKYALFSIGGIIKHAKSINAFANPTTNSYKRLIPGFEAPVSLSYSLNNRSAAIRIPTFNDDKSCRFEIRFPDSSSNPYLLFSAILMASIDGINNKIFPGNPIEKNLYKFKEKNLNKMSSSLEESIYHLDKDREFLTKNNVFTNDFIDSYIELKQKEINIVKSTPHPVEFELYYM

SEQ ID NO: 12270 - protein, 336 aa, Symbiobacterium thermophilum IAM 14863
MTIRIGINGFGSIGRRVFRIALSRPDIEIVAINDLTPPATSAHLLKYDSNYGILDAEVSATENSIIVNGKEIRVYAEKDPAQIPWKEHGVDIVMECTGRFTDKQQAEVHITSGGAKKVIISAPAKNEDITIVMGVNHEQYDPANHHVISNASCTTNCLAPVVKVLHDKFGVVKGMMNTIHSYTNDQVILDYPHKDLRRARAGALSIIPTTTGAAKAVALVIPELKGKLTGFAMRVPTPVVSVVDFTAELATPTTKEEINAALKAAAEGPMKGILAFEEAPLVSVDFKGNPNSSIVDGPSTLVLDGNLVKVVSWYDNEWGYSNRMVDLAAYIASKGL

SEQ ID NO: 12271 - protein, 600 aa, Erwinia rhapontici
MSSQGLKTAVAIFLATTFSATSYQACSAGPDTAPSLTVQQSNALPTWWKQAVFYQVYPRSFKDTNGDGIGDLNGIIENLDYLKKLGIDAIWINPHYDSPNTDNGYDIRDYRKIMKEYGTMEDFDRLISEMKKRNMRLMIDIVINHTSDQHAWFVQSKSGKNNPYRDYYFWRDGKDGHAPNNYPSFFGGSAWEKDDKSGQYYLHYFAKQQPDLNWDNPKVRQDLYDMLRFWLDKGVSGLRFDTVATYSKIPNFPDLSQQQLKNFAEEYTKGPKIHDYVNEMNREVLSHYDIATAGEIFGVPLDKSIKFFDRRRNELNIAFTFDLIRLDRDADERWRRKDWTLSQFRKIVDKVDQTAGEYGWNAFFLDNHDNPRAVSHFGDDRPQWREHAAKALATLTLTQRATPFIYQGSELGMTNYPFKKIDDFDDVEVKGFWQDYVETGKVKAEEFLQNVRQTSRDNSRTPFQWDASKNAGFTSGTPWLKINPNYKEINSADQINNPNSVFNYYRKLINIRHDIPALTYGSYIDLDPDNNSVYAYTRTLGAEKYLVVINFKEEVMHYTLPGDLSINKVITENNSHTIVNKNDRQLRLEPWQSGIYKLNP

SEQ ID NO: 12272 - protein, 546 aa, Staphylococcus aureus subsp. aureus Mu50
MSKEIDWRKSVVYQIYPKSFNDTTGNGIGDINGIIEKLDYIKLLGVDYIWLTPVYESPMNDNGYDISNYLEINEAFGTMDDFEKLIKVAHQKDLKVMLDIVINHTSTEHEWFKEARKSKDNPYRDYYFFRSSEDGPPTNWHSKFGGNAWKYDSETDEYYLHLFDVSQADLNWDNPEVRQSLYRIVNHWIDFGVDGFRFDVINLISKGEFKDSDKIGKEFYTDGPRVHEFLHELNRQTFGNTDMMTVGEMSSTTIENCIKYTQPERQELNSVFNFHHLKVDYVDGEKWTNAKLDFHKLKEILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLAILGQKSRDNSRTPMQWSDDVNAGFTAGKPWIDISENYHQVNVRQALQNKESIFYTYQKLIQLRHTHDIITYGDIVPRFMDHDHLFVYERHYKNQQWLVIANFSASAVDLPEGLAREGCVVIQTGTVENNTISGFGAIVIETNA

SEQ ID NO: 12273 - protein, 535 aa, Rhodotorula sp. CBS 8446
MLALVCVGLFLYLLCKYRSHAIATSDRTDLAGPKGWPLMGVFKFPLPTLSVTYVVVDVTEKTLSGNLIFYATQSSTRGLEWGVRFVKTYGHAWTLSVPGLRLIDISTRPDWIEYVQKTNYHNYVKGSAFRNRLSDIIGNGIFVTDGRVWQFQRKVTSHIFTGRSFQDAICPAIAEELRSLNKLLDNYADTGETVDLQDVFYRFTFQAFGRFAFNLDLRNLEIDHKPVPFTTAFDQCQKPSLDASSTRSGAFASALPLPAVEYQTPPSCFRLCLRNDDKRAALLAKKDAKVPSDLLTMFMTARYDDSRPLSRVEIRDAIINLLLAGRDTTAQSLTWALYRLVDNPAHQRLVREEICGQLAGGTEPVTLENVKNLVQTQAAHLESLRLHPPVPRIVKQAVKDDALPNGGPLIKAGEFIRLSDWALGRNEEVWGADAKEWKPSRWIDDEGRPIQYSQWKAHFFNGGPRICLGKSLATLEGVAVIANLLHRYNIAFAPGWWENVEKTGRIAGDLEETPLYGPALTLPMKSPFWVTISRR

SEQ ID NO: 12274 - protein, 551 aa, Erwinia rhapontici
MRSTPHWKEAVVYQVYPRSFMDSNGDGTGDLNGIISKLDYLQQLGITLLWLSPVYRSPMDDNGYDISDYEEIADIFGSMSDMERLIAEAKARDIGILMDLVVNHTSDEHPWFIDALSSKNSAYRDFYIWRAPAADGGPPDDSRSNFGGSAWTLDEASGEYYLHQFSTRQPDLNWENPRVREAIHAMMNRWLDKGIGGFRMDVIDLIGKEVDPQIMANGRHPHLYLQQMNRATFGPRGSVTVGETWSATPEDALLYSAEERQERQELTMVFQFEHIKLFWDEQYGKWCNQPFDLLRFKAVIDKWQTALADHGWNSLFWSNHDLPRAVSKFGDDGEYRVVSAKMLATALHCLKGTPYIYQGEEIGMTNVNFADIDDYRDIESLNLYQERIAEGMSHEAMMRGIHANGPDNARTPMQWTAVHMPGLPPVSPGLRLILTSGQWNVAAALDDPDSVFYHYQKLVALRKQLPLLVHGDFRQIVVEHPQVFAWLRTLGEQTLVVINNFTRDAVMLAIPDNLQSQQGRCLINNYAPREQLEPIMELQPYESFALLIERL

SEQ ID NO: 12275 - protein, 252 aa, Lactococcus lactis subsp. lactis Il1403
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 12276 - protein, 500 aa, Streptococcus agalactiae A909
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 12277 - protein, 280 aa, Leifsonia xyli subsp. xyli str. CTCB07
MNELRLLGPAEIRDLAELIGVAPTKRLGQNFVIDANTVRRIVRVAGVEAGEVVVEVGPGLGSLTLGLLEAGARVVAVEIDGRLAERLPLTVAQLAPEAAGRLTVVHSDALAVTELPERPGRLVANLPYNVSVPVLLHLLERVPSLRSGVVMVQAEVGQRIAAGPGSKVYGAPSVKAAWYGVWRTAGTVSRQIFWPVPNVDSILVGFERHATEPGDDELRKRTFALVDAAFQQRRKTLRQSLAPVYGDPAAAGAALEAAGVAPRRRGEQLTLADFVRLAAR

SEQ ID NO: 12278 - protein, 674 aa, Oryza sativa (japonica cultivar-group)
MLVLLLLLAAAAAVSSPAPVAGDGGGALPVLNPISSFCNTTAARRTYLPNSTFEANLNGLFAVLSRNASASGYAAGAFGAAPDTAYGLLLCRGDFTGNDCSAARLASSFQQAASSCLYSKDVAVYYDQYQLRYSDQDFLAGAGAGAANEPETAAFNMNNVSDAGDVAAFDALVAELVNAVADRASNATRRYAAGKAGFAPEAMTVYAIAQCTPDLSPPQCRGCLAGIIDQMPKWFSGRVGGRILGVRCDFRYEKDPFFKIPNDMVVLSPLPDPSSQGSSSSGGLWIVAIVVPVAVLLLGFLGCFLWIRRRRRRGTVSVPTMSMEMEQVLKLWRIEESGSEFSLYDFDQIADATDNFSDACKLGQGGFGPVYKGQLPDGLEIAIKRLSSCSVQGLMEFKTEIQLIAKLQHTNLVRLLGCCVQADEKMLIYEYMHNKSLDCFIFDTEKGAMLNWDKRFRIIDGIAQGLLYLHKHSRLRVIHRDLKASNILLDREMNPKISDFGMARIFCSNVTEANTTRVVGTHGYIAPEYASEGLFSIKSDVFSFGVLLLEIISGKRTAGFYQYGKFFNLTGYAYQLWQEGQWHELVDQALGEDFPAMEVMKCVQVALLCVQDSADDRPNMSDVIAMLGSEGVTMPEPRQPAYFNVRISSLAVSSSSFGESYCMSNVTLMEEDGR

SEQ ID NO: 12279 - protein, 304 aa, Anabaena
MTQAKAKHADVPVNLYRPNAPFIGKVISNEPLVKEGGIGIVQHIKFDLTGGNLKYIEGQSIGIIPPGVDKNGKPERLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 12280 - protein, 304 aa, Anabaena
MTQAKAKHADVPVNLYRPNAPFIGKVISNEPLVKEGGIGIVQHIKFDLTGGNLKYIEGQSIGIIPPGVDKNGKPESLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 12281 - protein, 304 aa, Anabaena
MTQAKAKHADVPVNLYRPNAPFIGKVISNEPLVKEGGIGIVQHIKFDLTGGNLKYIEGQSIGIIPPGVDKNGKPEQLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 12282 - protein, 481 aa, Helicobacter pylori J99
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 12283 - protein, 252 aa, Bacillus subtilis
MRKPIIAGNWKMNKTLGEAVSFVEEVKSSIPAADKAEAVVSPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 12284 - protein, 1057 aa, Glycine max
  misc_feature (356)..(356): Xaa can be any naturally occurring amino acid
  unsure (1)..(1057): unsure at all Xaa locations
MERARRLANRAILRRLVSEAKQHQKNESVLHSSTTPILLYSSSRCMSSVSSPVLRSRGSKTETLLGRNMNISRSVVAGAGSARSISVEALRPSDTFPRRHNSATPEEQSKMAESCGFGSLDSLVDATLPKSIRLKDMKFGKFDAGLTENQMIEHMKDLASKNKVFKSYIGMGYYNTHVPPVILRNIMENPAWYTQYTPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQXRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGKVDINNNVLKGAPHPPSLLMADAWTKPYSREYAAFPAPWLRTAKFWPTTGRVDNVYGDRNLICTLLPASQAVEEQAAATA

SEQ ID NO: 12285 - protein, 319 aa, Oryza sativa
MAFMSMERSTWAFTFGILGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRLVIRTKSVEFMPFSLSFFLVLSAVIWFLYGLLKKDVFVALPNVLGFVFGVAQMALYMAYRSKKPLVASSSSAVVAAGLEIKLPEHVKEVQAVAKGAVAAAPEGRISCGAEVHPIDDVMPSEVVEVKVDDEETNRTDEMAGDGDHAMVRTEQIIKPDMAIVVEV

SEQ ID NO: 12286 - protein, 511 aa, Bacillus subtilis
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFCIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAMVAKGGHAIITADDGNADILITESGEPHTAHTTNPVPVIVTKEGITLREGGILGDLAPTLLDLLGVEKPKEMTGTSLIQK

SEQ ID NO: 12287 - protein, 498 aa, Bradyrhizobium sp. BTAi1
MTPTAATRTTPSATASLRERLKDGSLLREQCYIDGSWVGVPVFPVNNPATGAELAKVAQLGAAETTQAVEAAARAFPAWAKLTAKQRSNLLRKWFELIVANREDLALILTSEQGKPLNEALGEVDIGAAYIEFFAEEARRVYGETIPTQKPDARLLALKQPIGVCGAITPWNFPNSMITRKVSPALAAGCTVVLKPANETPLSALALAVLAERAGIPKGVLNIITGDAPPIGKVLCEHPAVRFVGFTGSTEVGKILYRQSAGTVKKLGLELGGNAPFVVFDDADVDAAVEGAIVSKYRNMGQTCVCANRLYAQDGIYDAFVEKLAARVAAMKIGDGTEAGVVQGPLINEEAVEKVERHIADAVKGGATIVTGGKRHALGRTFFEPTVLSNVKADALVAHEETFGPLAPVIRFQSEADVIAMCNASPFGLASYFYARDLGRVWRVAEALESGMVGVNTGLITTEVAPFGGVKESGLGREGSHHGIEEYLEIKYVMMAGV

SEQ ID NO: 12288 - protein, 585 aa, Listeria monocytogenes
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEILPAFEKSAAVVVEEGGLTSHAAVVGINLGIPVIVGAKDATSLVKDGEIITVDSRQGVVYNGKTATH

SEQ ID NO: 12289 - protein, 333 aa, Bradyrhizobium sp. BTAi1
MTDAKYDVLGIGNAIFDVLVHADEAFLAKHAMTKGSMALIDEARAAAIYRDMGPATEMSGGSGANTIVGLASLGARAAYVGKVRDDQIGRMYSHDIRAAGVTFDTAPATDGPATGCCYILVTPDGERTMNTYLGAAQNLTAADIDPAQIAAARIVYLEGYLWDPKEAKEAFVKAATVAHDAGREVALTLSDSFCVDRYREEFLDLMRGGTVDIVFANEAELHSLYQTSDFDGALKQLREDATLGIVTRSDKGCVVVSNDGVIAVPAHPIETLVDTTGAGDLFAAGFLFGLVRKTGYEMAGRLGGLAAAEVIQHIGARPQVSLKELAAQNGLKA

SEQ ID NO: 12290 - protein, 366 aa, Sorghum bicolor
RPLEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 12291 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 12292 - protein, 119 aa, Lycium andersonii
HSVMLNNCPVNPPLHYNKFTDAIKRTELDKRWPQLKYEYYFSRDKQYLWKNEFLKHGSCSIKRYKQPAYFDLAMNLKDKFDLLSTLRNNGITPGSTYQLDDIEKAIKTVSIKVPSLKCV

SEQ ID NO: 12293 - protein, 552 aa, Erwinia rhapontici
MANWWKEAVAYQIYPRSFNDSNNDGIGDLNGITEKLDYLEDLGIDLIWICPMYQSPNDDNGYDISDYQKIMAEFGTMDDFDRLLEQVHARGMRLIIDLVVNHTSDEHPWFLASSASRDNPKRDWYIWRDGKAGAEPNNWESIFNGSAWKYSAATGQYFLHLFSEKQPDLNWENPEVRSAVYAMMRWWLDKGVDGFRIDAICHMKKEPTFSDMPNPLALPYVPSFERHLNYDGLLDYVDDMCEQVFSHYDIVTIGEMNGASAEQGEEWVGEQRGRLNMIFQFEHVKLWQDGQKDTLEASLDLPGLKEIFTRWQTLLENKGWNALYVENHDLPRVVSGWGDDKNYQRESATAIAAMFFLMKGTPFIYQGQELGMTNTHFASLEDFDDVAAKKLAVEMRRQGREEPEILAFLSRTGRENSRTPMQSDQSAHGGFSNATPWFPANSNYPVINVADQRADSGSVLNFYRALIRLRRQMPVLIEGAYQLLLPTHPQIYAYTRRLNEQQVLVIVNFSAHQQEIDPQQLLLDGWQPLLSNYQEQGKRQILRAYEAQIYQR

SEQ ID NO: 12294 - protein, 334 aa, Xylella fastidiosa Ann-1
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 12295 - protein, 392 aa, Marchantia polymorpha
MMILTKNKPMIVSMGPHHPSMHGVLRLIVTLDGEDVLDCEPVLGYLHRGMEKIAENRTIVQYLPYVTRWDYLATMFTEAITVNAPEKLTNIQVPKRASYIRIIMLELSRIASHLLWLGPFMADIGAQTPFFYIFREREMIYDLFESATGMRMMHNYFRIGGVAVDLPYGWIDKCLDFCDYFLPKINEYERLITNNPIFLKRVEGIGTVTREEAINWGLSGPMLRASGVQWDLRKVDHYECYDELDWKIQWQKEGDSLARYLVRIGEMKESVKIIQQALKAIPGGPFENLEARRLNQGKNSEWNLFEYQFISKKPSPTFKLPKQEHYVRVEAPKGELGIFLIGDDSVFPWRLKIRSPGFINLQILPQLVKGMKLADIMTILGSIDIIMGEVDR

SEQ ID NO: 12296 - protein, 393 aa, Huperzia lucidula
MTMLATEKNPMIVSMGPHHPSMHGVLRLIVTLDGENVTNCEPILGYLHRGMEKIAENRTIIQYLPYVTRWDYLATMFTEAITVNAPEKLANIQVPKRASYIRVIMPELSRIASHLLWLGPFMADIGAQTPFFYIFRERETIYDLFEAATGMRMMHNYFRIGGVAVDSPYGWVDKCSDFCNYSLPKVNEYERLITRNPIFLKRVEGVGTIGGEEAINWGLSGPMLRASGVQWDLRKVDHYECYDESDWQIQRQEEGDSLARYSVRIGETKESVKIVQQALKVIPGGPYENLEARRLNRGKNSEWNDFEYQFISRKPSPTFKLPKQEHYVRVEAPKGELGIFLMGDDSAFPWRWKIRPPGFINLQILPQLVEGVKLADIMTILGSIDITMGEVDR

SEQ ID NO: 12297 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 12298 - protein, 502 aa, Eremothecium gossypii
MGTAKKEQQRRIREGNTKDGNLRVKGENFYRDGKRVKFLNMYKGGKSIRNAKGDLIRAAPLQSTDVPTARVQPDRRWFGNTRVISQDALQHFRDALGDKKNDSYQVLLRRNKLPMSLLEEKDTSESPTAKIIDTEPYGATFGPKAQRKKPRVAAASLEDLAKATDSDSQKYEEKKELDSTLGLMAATEQEDGWSQVAKEAIFHKGQSKRIWNELYKVIDSSDVVIHVLDARDPLGTRCKSVEEYMKKETPHKHLIYVLNKCDLVPTWLAAAWVKHLSKDRPTLAFHASITNSFGKGSLIQLLRQFSQLHKDRQQISVGFIGYPNTGKSSIINTLRKKKVCQVAPIPGETKVWQYITLMKRIFLIDCPGIVPPSAKDTEEDILFRGVVRVEHVSHPEQYIPAVLRRCKRHHLERTYEISGWADATEFIEMLARKQGRLLKGGEPDETGVAKQVLNDFNRGKIPWFVSPPDRDPQPETSKRPADSEPETAQEAPEPPANKRLRV

SEQ ID NO: 12299 - protein, 105 aa, Brassica napus
  misc_feature (16)..(17): Xaa can be any naturally occurring amino acid
  misc_feature (19)..(20): Xaa can be any naturally occurring amino acid
  misc_feature (22)..(23): Xaa can be any naturally occurring amino acid
  misc_feature (27)..(27): Xaa can be any naturally occurring amino acid
  misc_feature (31)..(31): Xaa can be any naturally occurring amino acid
  misc_feature (33)..(35): Xaa can be any naturally occurring amino acid
  misc_feature (40)..(41): Xaa can be any naturally occurring amino acid
  misc_feature (47)..(47): Xaa can be any naturally occurring amino acid
  misc_feature (53)..(53): Xaa can be any naturally occurring amino acid
  misc_feature (56)..(57): Xaa can be any naturally occurring amino acid
  misc_feature (59)..(59): Xaa can be any naturally occurring amino acid
  misc_feature (61)..(61): Xaa can be any naturally occurring amino acid
  misc_feature (63)..(63): Xaa can be any naturally occurring amino acid
  misc_feature (68)..(68): Xaa can be any naturally occurring amino acid
  unsure (1)..(105): unsure at all Xaa locations
MEQTFIMIKPDGVQRXXVXXIXXRFEXKGFXLXXXKLITXXRPFADXYYQDLXAKXXFXGXAXYINLXPLGDVSPSTPLFSPQPPIALPFISSNHDPTLPSYNSQ

SEQ ID NO: 12300 - protein, 232 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYENGIYDEF

SEQ ID NO: 12301 - protein, 452 aa, Saccharomyces cerevisiae
MIQTQSTAIKRRNSVHKNLFDPSLYQIPEPPRGFQHQKKEYSKETFSNQVFGYDITSLKKRFTQLFPSNIQGYLPEVDLRITIICSIWYVTSSISSNLSKAILRTFNHPIALTELQFLVSAVLCVGFASIVNLFRLPRLKHTKFSKALNSFPDGILPEYLDGNFRSSILHKFLVPSKLVLMTTFPMGIFQFIGHITSHKAVSMIPVSLVHSVKALSPIITVGYYKFFEHRYYNSMTYYTLLLLIFGVMTTCWSTHGSKRASDNKSGSSLIGLLFAFISMIIFVAQNIFAKNILTIRRKVGILPSSSTDDVTSKEGQPSLDKTRFSPLQVDKITILFYSSCIGFSLTLLPFLTGELMHGGSVINDLTLETVALVAIHGIAHFFQAMLAFQLIGLLSSINYSVANIMKRIVVISVALFWETKLNFFQVFGVILTIAGLYGYDKWGLSKKDGRQA

SEQ ID NO: 12302 - protein, 472 aa, Bacteroides fragilis NCTC 9343
MARKKKELPLLEKVTITDVAAEGKAIAKVDDLVVFVPYVVPGDVVDLQVKRKKNKYAEAEAVKFHELSPVRAVPFCQHYGVCGGCKWQVLPYAEQIKYKQKQVEDNLRRIGKIELPEISPILGSAKTEFYRNKLEFTFSNKRWLTAEEVKQDVKYDQMNAVGFHIPGAFDKVLAIEKCWLQDDISNRIRNTIRDYAYEHNYSFINLRSQEGMLRNMIVRTSSTGELMVILICKITEEHEMDLFKQLLQYVADQFPEITSLLYIINNKCNDTINDLDVHVFRGNDHIFEEMEGLRFKVGPKSFYQTNSEQAYNLYKVARDFAGLTGDELVYDLYTGTGTIANFVSRQARKVIGIEYVPEAIEDAKVNAEINGIENTLFFAGDMKDILTQDFINQYGRPDVIITDPPRAGMHQDVVDVILFAEPKRIVYVSCNPATQARDLQLLDVKYRVKAVQPVDMFPHTHHVENVVLLELK

SEQ ID NO: 12303 - protein, 475 aa, Erythrobacter sp. NAP1
MATLAKSPEDNTTQEAASEEAAPKHWSEGVPEDDALDHIPGEKGWPLVGNTFRTLADPHAFTSYMVENYGKVYKTHAFGGWNVALIGAEANELVLFNKDKIFSSEQGWGPVLDQLFPRGLMLLDFDHHRIDRRALSIAFKPGPMRHYAGSLNSGISREVAKWEGEMKFYPAIKSLTLDLAADSFLGIPWGPEADAINTAFVDMVQASVAPVRSPLPFTKMKKGVDGRKFMVEFLTAETIRRRKEGGGQDMFSQFATATREDGELLPVDEVVDHMSFLLMAAHDTITSSATSLIYYLAINPEWQEKLREEIVAVTGGPDGDGNPRPLDYDDLGKLELTDMAFKEALRMMPPVPSMPRRALKSFEFGGYRIPAGTHVGINIYWTHYSDEYWDDPQTFDPMRFTPEKVKARHKYAWVPFGGGAHMCLGLHFAYMQVKVLMAQLLQRYRIEAPEGYAPDWQPWPIPQPKDGLKVTFKPL

SEQ ID NO: 12304 - protein, 212 aa, Methanopyrus kandleri AV19
MSGKRNAARKAAEEVCRRGYEVIGVGAGTTVEAFLEELVKREADVLVFTTIPGTIDACRRIGLNVTTIPPEELPVAIDGADAVDPDGNLLKGGGACHSLEKAIDYTADEFWVVVDESKLVENLWELPVPVEVLRGCYELTVRTLEEFGEVRPRTCDEKYGPVVSDSGNPIVDLHVDDWDPAELERELNSVPGVVECGVFPGDKVDRIIVGRS

SEQ ID NO: 12305 - protein, 316 aa, Triticum aestivum
  misc_feature (241)..(241): Xaa can be any naturally occurring amino acid
  misc_feature (255)..(255): Xaa can be any naturally occurring amino acid
  misc_feature (259)..(259): Xaa can be any naturally occurring amino acid
  misc_feature (279)..(279): Xaa can be any naturally occurring amino acid
  misc_feature (304)..(304): Xaa can be any naturally occurring amino acid
  misc_feature (311)..(311): Xaa can be any naturally occurring amino acid
  misc_feature (313)..(314): Xaa can be any naturally occurring amino acid
  unsure (1)..(316): unsure at all Xaa locations
MLPWIFSRKGASGFSWASTADQVTAGISAAGLTAIVTGASSGIGAETARVLAARGAHVVMAVRNLAAAETVRQAVLAETPGASVEVMELELLPSSSSYSSPPPAGRRLPLNILINNAGVMATPFSLSKDGIEMQFATNHVGHFLLTHLLLETMKKTSHESNVEGRIVNVSSEGHRVAYKEGIRFAKLNDEEEYSTIAAYGQSKLANILHANELARRFKEEGVNITANSLHPGSIITNLLRXHHSIIDVMSRTLGXLVLXNVQQGAATQCYVALHPGAKXVSGKYWSDSNLYEPSAKAKDAELGXKLWDYTXDXXAA

SEQ ID NO: 12306 - protein, 279 aa, Dehalococcoides sp. CBDB1
MRTTISQLKEMKQNKQKIAILTAYDYPTAQILDKAGIPAILVGDSLGMVVLGYDSTVSVTMEDMLHHLKAVVRGSQKALIIADMPFMTYHLSPEQALLNAGRFIQEGGAQAVKLEGGVNVADKVKRIVDCGIPVMGHIGLTPQSVNQLSGFKVQGKTLATALSLIEDAKALEKAGAFAIVLETMPAELAAIITAGISIPTIGIGAGEECDGQVQVISDMLGMFTDFVPKHTKRYADLNGSITKAVSEYAAEVTKGAFPTLKESFTLDKKVLEELKKCVL

SEQ ID NO: 12307 - protein, 402 aa, Bordetella parapertussis
MQEIEQRIYLAATYDTKGEEAEYLRQLLRRDGVMVVTVDVATSGQGSPAMVSAQEVAACYPQGAQAVFTGERGSAIVAMALAFERYLAGQRDVGAVLGIGGSGGTALVTPAMRALPVGVPKLMVSTMASGNVAPYVGPSDIAMMYSVTDVAGLNRISRRVLANAAGAIAGAFRQARQPIADDGRPAVGITMFGVTTPCVQHVTAALHDRYDCLVFHATGTGGQSMEKLADSGLLAGVLDLTTTEVCDFLFGGVLACTDDRFGAIARSGVPYVGSCGALDMVNFGALDTVPAACRERLLYPHNPQVTLMRTTAQENARQGAWIAERLNRCEGQVRFLIPEGGVSALDAPGQAFYDEAADAALFQALYDHVRQTDRRRLVRVPCHINDPLFARAAVEQFHEISQ

SEQ ID NO: 12308 - protein, 108 aa, Lycium andersonii
KKKYLLNNCRVDAYNTITDVREQYKLDKRWPDLTTSKAMTMSGQKFWEYEYNKHGTCCEPLYNQEQYFNLTMKLKDKFDLLTTLSNHGIVPGSTSTIKKFGSAIETVT

SEQ ID NO: 12309 - protein, 392 aa, Kineococcus radiotolerans SRS30216
MRLAQRARTVQPFHALAFGQQAADLEARGEHVVRLSIGEPDFGAPPAVREAMREVMDGRPLPYTPSTGAPALRRAIAGFYRDRHGVEVDPERIVVTSGASSALLLVLAATVDPGSEVVVADPSYPCNRQLVETFGGVVAAVATTAASRYQLDPASVERAWSERTAAVMVATPSNPTGTSVPPGQLAEICALARARGAWRIVDEIYLDLADPSPGGAAPRTVLAVDPDAVVVNSFSKYFGMTGWRLGWAVLPAELVPAVEKLAMNYFLCASAPAQQAALACFTPESLALCEERRVELAARRRAVLDGLAGLGLPVPVEPDGAFYVYFDVSGTGLGSWEFCERALREAHVALTPGRDFGVDTAETHVRLSYAASRAEIAEGLRRLGAFLAGLRP

SEQ ID NO: 12310 - protein, 276 aa, Bordetella parapertussis
MPRFERSALLDKFQDMVRRRQPIVGGGAGTGLSAKCEEAGGVDLIVIYNSGRYRMAGRGSLAGLLAYGNANDIVLDMAREVLPVVRHTPVLAGVNGTDPFCNFDAFLDELARVGFSGVQNFPTVGLIDGTFRANLEETGMGYGLEVEMIRLAHAKGLLTTPYVFDPDQARAMTAAGADIVVAHMGLTTGGNIGAETALSLDDCVARIDAIAVAALAERGDVIVLCHGGPIATPQDAAHVLQRCRHCHGFYGASSMERLPAEQALTATTRAFKQLSF

SEQ ID NO: 12311 - protein, 445 aa, Burkholderia vietnamiensis G4
MQDIEDFLKQHRITEIEAIIPDMAGIARGKITPRNKFTSGESMRLPQAVMVQTVTGEYPEDGSLTGVTDPDMVCVPDTSTIRLIPWAVDPTAQVIHDCVHFDGSPVEISPRYVLRRVLELYKAKGWKPVVAPELEFYLVDMNKDPDLPLRPPVGRTGRPETGRQSYSIEAVNEFDPLFEDIYEYCEMQNLDIDTLIHEVGAAQMEINFMHGDALSLADQVFLFKRTVREAALRHSMYATFMAKPMEGEPGSAMHVHQSIVDEETGRNLFTSPETGGATSLFYNYLAGLQKYTPALMPIFAPYINSYRRLSRFMAAPINVQWGYDNRTVGFRIPHSGPAARRIENRIPGVDCNPYLALAATLAAGYLGMTQRLEPTEPLVSDGYSLPYQLPRNLEEGLTLMAACEPLAGILGDKFLKAYFALKETEYEAFFRVISSWERRHLLLHV

SEQ ID NO: 12312 - protein, 87 aa, Glycine max
AVPKGHLAVYVGEEDGQFRPVLIPVIYFNHPLFSDLLREAEKKFGFEHPGGITIPCRLTEFERVKTRIASGSGQRGRTRRLGWRLHY

SEQ ID NO: 12313 - protein, 534 aa, Gibberella zeae PH-1
MGNNNSSQGGSGSKGSGSAGPDGPLQSYPSFSRSDTKDSSRSFRTLGSKIRSSSKSDSPRNSKVLSNGENPVESKSDDRRSSRHGRSSSSRLSRSELPPLNTAGTDISTSESALADSAVGEDQPPPSPVHGNAKGGNHDVSAAQASGEVDHVSDQPPSVNAGANAHMQAPGQSILVKRENTINPVNNGPSDESRADGNSNVAMSEIKDIDLDDFIKRLLDAGYAGKVTKSVCLKNAEIVAICQRAREVFLSQPALLELDAPVKVVGDVHGQYTDVIRMFEMCGFPPNSNYLFLGDYVDRGKQSLETILLLLCYKLKFPENFFLLRGNHECANVTRVYGFYDECKRRCNVKIWKTFIDCFNTLPIAAIVAGKIFCVHGGLSPALVHMDDIRNIARPTDVPDYGLLNDLLWSDPADMEQDWEANERGVSYCFGKRVITEFLAVHDFDLICRAHMVVEDGYEFFNDRVLVTVFSAPNYCGEFDNWGAVMSVSAELLCSFELLKPLDSSALKSHIKKSRNKRQHMLNSPPAMIQPQSM

SEQ ID NO: 12314 - protein, 765 aa, Zea mays
MEGNHQNLSLEQVPQVGLTFESEDAAYNFYNSYARKIGFSIRKCHVKYRADGTLASKYMVCSNEGHKNSNPTQPPKKERASTRSECKARVQFYISREGIWKMQKVELAHTHPFTSPDKTHMLRSQRRLLPADEHIISKMREAGVKSTEIFEFFQVWSGGAENVQFLQMDCNNFISRERKKYLETQDAKTLLEYLENKQAEDPSFFYSVELDPDNGGQICNFFWTDGQAIADYACFGDVICFDTTFQTNKSEMPFAPIIGTNHHRQTIVFGAALLFNESSESFAWLFKAFLKAMSGKKPKTIFTDQCAAIAKAIMMVFPSSCHRLCIWHIYQNAGKHLSHVIANNQEFLKDFKNCVYEEKSVEHFNLRWQELIATYSLQDNAWIQNLYDLREQWATIYRHDSFCADMTSTQRSEEILVEYDKCIARLRRNELYEDHKSRNSEPILCITSLPLLKTAAKSYTRNMFSAFQDEFQKQFTLSSTLINCEGTISLYKVVAMGNSENEARVIFNSDDLNISCSCKKYISLGILCKHILRVFNQNDIVDLPPQYILNRWTKYAKRGVYGCRTQNQSGNLASQSTNLCRKMISVTLKCAVSEEVMQHLENGFDKLTLEVENLLSNITLVENKSPECFLECTEEVAKERISFKAPPHKKGALEKRSRSVLERRKKNHRTKTARKGAESKQSSDARLSKVSQIIEQETNVTSTDTTILPMTNINLPFGENREMPMFFPPIQGEFTNLLLGTHFEVATTTSRRLEFDEDFPTKSTT

SEQ ID NO: 12315 - protein, 464 aa, Carboxydothermus hydrogenoformans Z-2901
MVETEKELKRGLEARHIELIALGGTIGVGLFMGSASTLKWAGPSVILAYIIAGIFIFFIMRTIGEMLYIEPITGSFATYAHKYIGPLWGYLTAWSYWFMWVAVGMSEVTAVGIYMKFWFPTLPQWVPGLIAILIVGTANLAAVKYYGEFEFWFALIKVVTIVVMIILGIGMIFFGFGNHGRPIGLENLYIHGGFFPNGIKGFLFALCLVVAAFQGVELVGVTAGEAKDPQRTLRRAVQNITWRILIFYIGAIFVIVALYPWNKLGTIGSPFVLTFAKVGIPAAASIINFVVLTAALSGCNSGIYSSARMLYTLSQNGQAPKFLAKVSPSGVPVNSLLVTIACLLIGVALNYIAPQKLFVYIYSASVLPGMMPWFVILISQLKFRKLKDNEIKDHPFKAPLSPYSNYLTIIFLVLVLVGMWLNSDTRLSLIIGAAFMALIIISYYVFGIDKKQVPEVKKIKEEAI

SEQ ID NO: 12316 - protein, 278 aa, Ralstonia metallidurans CH34
MRSNVHQGHVARKRFGQNFLVDDGIIHGIVSAIDPQPNDIVVEIGPGLGALTDPLLERLPGMQVVELDRDLVERLRRRYGDRLVVHAGDALAFDFGKLREPGRALRIVGNLPYNISSPLLFHLVDFADDVRDQHFMLQKEVVERMVADPGSKSYGRLSIMLQVRYHMEHVLDVPPASFNPPPKVDSAVVRMIPWPRAEDGTLRSPYAACDAGVLGDVVTAAFSQRRKVLRNTLSFLRDQVDFDALGFDLTRRAEEVPVAEYVELARIVGGAEPPARVA

SEQ ID NO: 12317 - protein, 670 aa, Oryza sativa (japonica cultivar-group)
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPDMATATCRSCLGGIVGMMPKYFSGKQGGRVLGLRCNYRYEIYPFFDGVSLLQLPAASLGAPPAPSPAAVNVTPPATTTGTRRRGNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 12318 - protein, 962 aa, Mesorhizobium sp. BNC1
MKPPIWQWWDEHKQMSYTPTGYAPYDFANRRHIGPSPREMAEMLETVGAESLDAFIDAIVPADIRQTRPLAWGKALSERGVLERLRNVAKKNKPNASFIGQGYHGTFTPPAIQRNIFENPAWYTAYTPYQPEISQGRLEALLNYQTMMTNLTGLDIANASLLDEGTAAAEAMALCERASRTKARAFFVDHHCHPQTIAVVATRAEPLGWEVIVGDPFTYLDPSRVFGALFQYPGTYGHVHDFTAPIAALKDAGALAVVAADPLALTLLKPPGEMGADIAIGSSQRFGVPLGYGGPHAAYMTVRANLARSMPGRIVGVSIDARGNRAYRLSLQTREQHIRREKATSNVCTAQALLAVMASMYGVFHGPDGLRAIAERIHRKIVRLVKGLETLGFPIEPVSFFDTVTVECGPRRDAILASALREGINLRPIGETRIGITFDETVRRSHTEAIWRAFGGGMADDDMTPDYRLPEALLRTSSFMTHPVFHMNRAEAEMTRYMRRLADRDLALDRAMIPLGSCTMKLNATAEMMALSWPEFANMHPYAPADQAQGYAEMLSDLEAKLCQITGYDAFSMQPNSGAQGEYAGLLTIRRYHEVQGDGHRNICLIPTSAHGTNPASAQMAGMKVVVVGVAADGNIDVADFRAKAEAHAENLAACMITYPSTHGVFETTVREICDITHANGGQVYIDGANMNAMVGLARPGDIGGDVSHLNLHKTFAIPHGGGGPGMGPIGVKAHLVPHLPGNPPAGKFAISAAPFGSASILLISWAYCLLMGGEGLTQATKTAILSANYIARRLASAYPILYSSAAGHVAHECILDTRVLKERAGVTVDDIAKRLVDCGFHAPTMSWPVAGTLMVEPTESEPKAELDRFIEAMLGIAAEAEAIAAGTLDAQDNPLKRAPHTVEDLVGEWDRLYSREAACFPAGSFRTDKYWPPVNRIDNVHGDRNLVCTCPPLESYAEAAE

SEQ ID NO: 12319 - protein, 450 aa, Streptococcus agalactiae A909
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVNIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILLIGSLLSNFFTVLIFQCFCLLFCLICHYIYQKNNPKTHE

SEQ ID NO: 12320 - protein, 598 aa, Candidatus Protochlamydia amoebophila UWE25
MALIRTKIVCTIGPACNSLEKIIELINVGMNVARLNFSHGTQEEHLRTINLLKEARCQLNLPLAIMLDTKGPEIRLGKIRDGQIFLTVGQKWRLVKKEVLGDESQVSIFPLNILDQLPVGTTILFDDGYIASRVIENSSEGVLVEINNSGMIRSSKGVNIPNTSLNLPAVTEKDIDDIRFGCSQDIDLIAASFVRSAEHVLEIKRLLADEKKTDILVIAKIENSEGVQNFDSIVQAADGIMIARGDLGVEVPLSHVPRLQKMMIRKSYLAGKPVVTATQMLESMINNPRPTRAETSDVANAIYDSTSAIMLSGETAIGRYPVETVNVMRSIVEEAEADFNYSTFFDQHAPLVYHDVPSAVTLATVKTAYSSSAKAIFAFTKAGTTARLLSRLRPKMPIIAMTAKEKIFHQLAFNWGVIPFLSEPCNSLDKSLKKISDFALGSQHVSYGDLVVITAGTPFGFSGTTNMMIVENIGDVLVRGHSGYGIRVHGNVVIVLAPQSKAPYAVKDQVLVIAKCDESYLSLMKEASAIILQNHINDFASEKYAKKIALSLGKPILLRADAACQILKEGQLVTLDPEKALVYKGVVLDQLLASGEFS

SEQ ID NO: 12321 - protein, 283 aa, Streptococcus agalactiae A909
MATIQWFPGHMSKARRQVQENIKHVDFVTILVDARLPLSSQNPMLTKIVGDKPKLMILNKADLADPIRTKEWRDFYESQGLKTLAINSKEQSTVKKVTDIAKILMSDKIAKLRERGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTYYPDRLKERFKSINLEDEAPEIIMTLTQKLGYRDDYDRFYNLFVKEVRDGKLGRYTLDIVGEHDGNN

SEQ ID NO: 12322 - protein, 283 aa, Lactobacillus sakei subsp. sakei 23K
MTTLTTTYTLANGVQIPVLGFGTWQTPDGDTAIKSVKAALEAGYRHIDTAQAYQNEASVGTAIQESGVARQDLFLTTKIWNANHSYDLTMQSFEESLQKLQTDYVDLLLIHWPNPIDFRDNWETANAETWRAMEELYNAGKAKAIGVSNFRAHHLEALKKTAKVQPMVNQIFLAPGELEAETVQYSRDNGLLLEAYSPLGTGKIFDVPEMKTLAAKYQRSIPQIASRWSLQHGFLPLPKSVHANYIQENTQLFDFELTPEDMQTIDQLDGVVGKAKDPDTATF

SEQ ID NO: 12323 - protein, 263 aa, Nocardioides sp. JS614
MRRTSLDPRPLAALAPDLVVEVLESATSSNAVASDRAREGADEGLVIVAEHQSAGRGRLDRAWEAPARSALTFSLLVRPTAPAADWPWLPLLTGYTVMKTLRAEGYDVGVKWPNDVLVGDRKLVGILVERVETPSGPAAVLGVGLNVSLTADELPVPTATSLTLESGAEPDRTHLLVELLRSLREAYDVWQAGGAEATARLRSSYAAACVTVGREVRVDLPGGQLLTGRATGVDGAGRLVVLGADGETVVGAGDVVHVRAADQ

SEQ ID NO: 12324 - protein, 154 aa, Glycine max
  misc_feature (93)..(93): Xaa can be any naturally occurring amino acid
  misc_feature (110)..(110): Xaa can be any naturally occurring amino acid
  misc_feature (120)..(120): Xaa can be any naturally occurring amino acid
  misc_feature (131)..(131): Xaa can be any naturally occurring amino acid
  unsure (1)..(154): unsure at all Xaa locations
MASEQTFIMIKPDGVQRGLIGEVISRFEKKGFYLKGLKLQNVEKSFAEQHYADLSSKPFFAGLVEYIVSGPVVAMVWEGKSVVSTGRKIIGAXTTPLASEPGTIRGDFAXDIGRNVIHGXSDSVESARKEXSALWFPLEGHCKGEGAPSHTWIQ

SEQ ID NO: 12325 - protein, 498 aa, Bifidobacterium adolescentis
MEGEIMTAVQTSNPVHDAEGAVEAGIHEVGATIDAVEREVGRGVSTRFPLNSAFIFTFGALGGMLFGFDTGIISGASPLIESDFGLSVAQTGFITSSVLIGSCAGALSIGALSDRFGRKKLLILAAILFLLGSGMCAGSTGFLMMVVARIILGLAVGAASSLTPAYLAELAPKERRGSLSTLFQLMITFGILLAYASNLGFLGHNIAGIRDWRWMLGSALVPAALLLIGGLLLPESPRYLVSRGRDREAFKVLTLIRKDVDQTQVQLELDEIKAVAAQNTKGGVRELFRIARPALVAAIGIMLFQQLVGINSVIYFLPQVFIKGFGFPENHAIWVSVGIGVVNFVATIAATLIMDKFPRKKLLIFGSVTMTIALAVLAVLNFTGDVATLAVPTMVLIACYILGFALSWGPIAWVLIGEIFPLSVRGIGSSFGSAANWLGNFVVSQFFLMLLAMFGNNVGGPFTIFGVFSALSIPFVLRFVPETKGKSLEQIEEEMVRR

SEQ ID NO: 12326 - protein, 221 aa, Tropheryma whipplei TW08/27
MDNLVLLRHGNSLWNQENLFTGWVDVRLSELGEKEAKTAGQLLREANRYPDVLFTSLLTRSIQTAHIALMEIDRVWLPTFRSWRLNERHYGSLQGKNKAQVLEEFGEEQFNSWRRGYDTPPPPLHSQADDPRYEEPPPLSESLKDVQNRLLPYWQGVILPHLVAGKVVLVVAHGNSLRALVKHLECISDTDVCQLNIPTGIPLVYSIDPSGCATHPGRYLP

SEQ ID NO: 12327 - protein, 337 aa, Lyophyllum shimeji
MVNVGINGFGRIGRIVFRNALLNPKIQVVAINDPFINLEYMVYMFKYDSVHGRFKGTVEAKDGKLWIQGKPVIVYGEKNPSDIKWGAAGRDYVVESTGVFTTVEKAEGHLKGGAKKVIISAPSADAPMFVMGCNLDQYDPKYTVISNASCTTNCLAPLTKVIHDKYGIIEGLMSTIHATTATQKTVDGPSNKDWRGGRAVVNNIIPSSTGAAKAVGKVIPSLNGKLTGLSFRVPTIDVSVIDLVVRLEKPASYEDIKKTVKEASEGAYKGIIEYTEEQVVSADFIGHHASSIFDAQAGIQLNPNFVKLIVWYDNEWGYSARVCDLLVFAAEQDAKQQ

SEQ ID NO: 12328 - protein, 858 aa, Gibberella zeae PH-1
MALLQRFVAPSARGALRQSPAITLMITRKASNASPPKLKDPSLFKQDVCYVNGKWVKAKSGKTFKVNDPSTGDLIGTCPEFDSKDAQLAIRAAADAFPSFRNKTGRERSKLLRAWYEQMTANAEDIAKLITWENGKPMADAKGETTYAANFLEWFSEEAPRVYGDTIPSSVPGNRVWTLKEPVGVCGLITPWNFPAAMITRKIGPALAAGCTVVAKAPAETPFTSLALAELAHRAGIPKGVVNVVTSHENTPELGELLTSDPTIRKVSFTGSTNVGKLLMKQSAGTLKKLSMELGGNAPFIVFDDADADAAVAGAITSKFRSSGQTCVCANRIYVQRGIYDEFVSKFTEKVKSFNVGHGFDQGVTHGPLIHDKAIEKVEAHVKDAEKKGGKVTIGGKRLSDLGSNFYAPTVIRDMTPEMDMASQETFGPVAGLFPFETEEEVVKMANNTEVGLAGYFFSRDLERVHRIAEALEVGMVGVNTGLISDAAAPFGGVKESGFGREGSLYGISEYQITKMITYGVYYGEGSNEYNIHTLNHENVVVITFALQIIERAKCRRFEPCHDQRNFDLYLDPRNAQNRFNHNTLFEMAFSLANAPLRTCLRQLVRSKGPAPLRSIAASPRAFSTSHVLLKKRKISAPANSPNTATAKAAAGSMNKAEYDTAKVPAPDPEDPLDFTAVIAAYAPIDAHFKTQLAGMIHGGRFNPTNLGSLPVTIKDEEGADATFPLRELAQVVPRSGRAISLLVNDKEYIKPIMSAVQSSREFNQQPQRSEDNELELLLKVELERKDDVERRVKEAVQQWKDRIRNARSRHEKTLKDWKKNGTVLPDIVKKAEKELQKVQDKKMKEIDQEEAQTIRQL

SEQ ID NO: 12329 - protein, 341 aa, Glycine max
MSPSSLCSLQASPPISHALLNRHHKPAHDSTAGVRNRTPYVVSSERSSTASTRSADDYHATLKALNSKGRFPRKSLGQHYMLNADINDQLAGAAGVEQGDVVLEIGPGTGSLTNVLLNSGAFVLAVEKDKHMAALVSERFSSTGKLKVLTEDIVKCHVRSHMSSLVGSINPESRKAKVVANIPFNISTDVIKLLLPMGDIFSEVVLLLQEETAVRLVVSSLRTPEYRPINVFVNFYSDPEYKLKVPRSNFFPQPNVDAAVVSFKLKLPSEYPQVSSTKSFFSMVNSAFNEKRKMLRKSLQHICTSLEIEEALTSIGLLATSRPEELTLDDFVKLHNLIAKE

SEQ ID NO: 12330 - protein, 330 aa, Bordetella parapertussis
MRTSTMKCLIVQPIHEEGLALLREAGVECIAPASAAMADVAAAIADCDAAITRNAGLDTRAIEAGRRLRVIGNHGTGTNMIDLAAAERLGIPVVNTPGANARSVAELALAMAMALLKRTVPLNQAVRQGNWNIRYEAGLRELSGMSLGIVGFGQIGRALAAMAIGGFGMRVHVYSPSVAPQDIAAAGCQRADSLPALAREADIVSLHRPARPGAGPLVDDALLQAMKPGALLINTARADLVDEAALARHLEAGRLGGAGLDVFSSEPPPADHPLLRLPQVVLAPHAGGSTDQALARTARAVAEQVIEVLRDARPAHLIAPHAWPRRRGAR

SEQ ID NO: 12331 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQKTKQDYQMELGVNCIGPQLLQTLLDPLFIKTAEKNPPNLSRIVWVSSTAHMLSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 12332 - protein, 637 aa, Mycobacterium bovis AF2122/97
MLSVGRGIADITGEAADCGMLGYGKSDQRTAGIHQRLRSRAFVFRDDSQDGDARLLLIVAELPLPMQNVNEEVLRRLADLYGDTYSEQNTLITATHTHAGPGGYCGYLLYNLTTSGFRPATFAAIVDGIVESVEHAHADVAPAEVPLSHGELYGASINRSPSAFDRNPPADKAFFPKRVDPHTTLVRIDRGEATVGVIHFFATHGTSMTNRNHLISGDNKGFAAYHWERTVGGADYLAGQPDFIAAFAQTNPGDMSPNVDGPLSPEAPPDREFDNTRRTGLCQFEDAFTQLSGATPIGAGIDARFTYVDLGSVLVRGEYTPDGEERRTGRPMFGAGAMAGTDEGPGFHGFRQGRNPFWDRLSRAMYRLARPTAAAQAPKGIVMPARLPNRIHPFVQEIVPVQLVRIGRLYLIGIPGEPTIVAGLRLRRMVASIVGADLADVLCVGYTNAYIHYVTTPEEYLEQRYEGGSTLFGRWELCALMQTVAELAEAMRDGRPVTLGRRPRPTRELSWVRGAPADAGSFGAVIAEPSATYRPGQAVEAVFVSALPNNDLRRGGTYLEVVRREGASWVRIADDGDWATSFRWQRQGRAGSHVSIRWDVPGDTTPGQYRIVHHGTARDRNGMLTAFSATTREFTVV

SEQ ID NO: 12333 - protein, 370 aa, Thermoplasma volcanium GSS1
MTIIMVKIIQDPVFGPIKADGVILDLIDSPEFQRLRRIKNLGLCSLVFPGANHTRFEHSIGTYYLASLYNEHLRTMSDELKIAALLHDIGHFPYSHTIEEFYMETEKIDHLQAGINLIEGKAESEIPAILEKHGIDPHWVSSILKGISNVLSEIISGPLDADELDYLRRDSFYCGVSIGYVNPLRIIDVSSVYEGQIVSEEKGLSDIESLLISRFLMYQAVYFHKTCRIANKMLGIAARLAEAIGTSRMVDEELMALLLSKKRSERIARDIINRRLMKVIFKEKYGEELYRDITDRIGEDAIVDVIPPLSFSGRERLKTDVSVKIQGRIVAGEEISPLVNSLNQAIERRYVYVYGYKEDEEKIKSDLRGL

SEQ ID NO: 12334 - protein, 530 aa, Burkholderia xenovorans LB400
MNRIVEPGNPLAATASVTGTATRLSVQPVILAGGSGTRLWPLSRERNPKQLIGLMGDESLLERTLRRLDASFAAVEHETPAAGTRLIAAPLVVCCEDLRLQTLERLQRLERPGRPVRMVLEPVPRNTAPALTVAALAARAAAVEGDDPVIVALPADHLIGDHVAFGKALAEALEHAAAGAIVTLGVPPKRAETGYGYIRTGTALGTRGARVIERFVEKPDPELAERYVASGDYWWNSGMFVVRASVWLAAIELCQPAIAAACADAFEQATVDGDGALHLARKAFALCPSDSIDYAVMERVATDARLVGVAVPLVAGWSDVGAWDSVWEASAKDADGNVARGRVMFAGSTDSFAHSEGRLVACVGVSGVMVVETADAVLVVAKDRVQDVKAVVSRLKLEHGAEAQEHRKVGRPWGYYDSLERGARFQVKRIVVKPGGRLSLQMHHHRAEHWIVVRGTARVTRGEECFFLTENQSTYIPLGVTHRLENPGKTSLEMIEVQSGGYLGEDDIVRFDDQYGRDQESGHAGKGTSR

SEQ ID NO: 12335 - protein, 313 aa, Neisseria meningitidis Z2491
MAIQWFPGHMNKAKKAIAERAKSVDMVIEMLDARMPASSENPLLAQLSKGKPKLKILNKQDLADPERTKIWLEHYNSRPDTCAIALDSSETGAHGKITQACRAMIPHRQGIDKPLRVLICGIPNVGKSTLINGMIGKKSAKTGNEPGITKAEQRLFLADDFWLYDTPGMLWPKIIVEESGYNLAAGGSVGRNALDEEEVALELLDYLRRHYLPMLQERYQADKDPSSHWDENVWLEWIAKKRGAVLSGGRINYQKAAENILTDFREGKIGRITLETPNQWETWLKKARQKEAELKAIREARKAERKGQKPSEA

SEQ ID NO: 12336 - protein, 705 aa, Populus alba x Populus tremula
MDAYGATRIVFSRIQNLDPENASKIMGLLLIQDHGEKEMIRLAFGPEALVHSVILKARKELGLSSPTNLSTSPSSPSPLYSSNPVAISRQNNSSTSRLGFNIPPSLAIPNPSSNNSSSWSDLPNPDDLMISPNDSSLNPASVPSYANGVRGGGESDLMDEFHLQDQLSFLMIIHKSRSKSSDLFYPQLDALSSPTGASDSMMFPSYWGGSVHRRSCSVSDVLGSEDPNSGFGWRPCLYFARGYCKNGSNCRFVHGGLGELDGAGVVGSPNSNNKIDMMDQCHELLRSKSAHQQRLAAASQLMSGSAASFPYSPKSMNFLLQQQQNDSQRAAATALMMGEDMHKFGRSRLDRNDLVNPASRQIYLTFPADSTFREEDVSNYFSIYGPVQDVRIPYQQKRMFGFVTFVYPETVKIILAKGNPHFVCDARVLVKPYKEKGKVPDKKQQQQQVERGEFSPCGTPTGLDSRDPFDLQLGAGMFYNTQDMLWRRKLEGQADLQQALELQSRRLMSLQLLDVKKHHHRALSNGSPCPLTYSLSQYFNHSLAFPPLHSSTEAPQENCSSSMPATSVTARLKNKISNATSGKEYTSSEENGSGKESSHGEDSDLQESLEHNLPDSPFASPAKGTGDYYSAFINGLTEAHEKDASIPTSTSANNNLVPSSLISPNSSLEMASFKSFNCQIPRFSSGHGAIGMYASTDGPTCPVGI

SEQ ID NO: 12337 - protein, 765 aa, Ashbya gossypii ATCC 10895
MRASSICDIVLAVWLLPLSQTVAQVVQRENDWQSIEASRAGMFGNSVQGGCDGVCEPQEGPVTAIMNMWENVDASPIPERPEMTDIDLVPPGKQTGNAFSFTSRGSAEAGVGAPTVWSPQLTGCGDHSRSYSQAVASEPVSAESSQLASQAPEVLEEFSLREADEEGDLHNETEFLPFDEWKRIKLDEEKRASVHSETHTRTRIPVDYNRADALGDEMEIDVGMFTSMEDDEPEGKLYHEKFNYASLDCAASIVKTNSEAQGASSILYENKDKYLLNPCSAVNKFVVIELCQDILVEEIEMANYEFFSSTFQNVRFSVSDRFPVPKNGWKVLGEFTAVNSRDIQKFGIPNPKIWARYLRVEILSHYGNEFYCPISVVRTHGKTMMEEFKLAQSVGNSQESEVLQPAPDRILNSTLHNASFLCTGSHHNNNGGPLSFSSNNVSVELFADDMASQCRAALPPLRFEEFIDGFDDISCGQKHSKSMNFTGTISNSATEESIFKNIMKRLTTLETNATLSILYIEEQSRLLSKSFYSLEKNHAKKFDSLVSIFNETMMHNLETLNVFAKQLKDSSMHLLEEQKLSTDQFTSMTIQRLDMMERDARFQKRMVYLILVAVAALLVYVLLTREAYIDDYMEDDGWYLDSPPLQKAKDKLMRKAARAVSTPTIFKNFQDDIAPMKIRRNPSFSSSSSISDVSQYLIDNDDDSVFLGRPRTYSKLLAADENEIDIDEIMTHSSDNSDVSHGMDRLLDADGTEVSSRESSDGEPK

SEQ ID NO: 12338 - protein, 240 aa, Bacillus clausii
KRLLKEIVDKADVSVRDTVLELGAGKGALTTILSERADRVLAVEYDQKCIEALQWKLVGSKNVSVLHQDIMKVALPTEPFVVVSNIPYAITTAIMKMLLNNPKNKLQRGAIVMEKGAAKRFTSVSPKDAYVMAWHMWFDIHYERGISRSSFSPPPKVDSALVRIVRKQHPLFPYKEAKTMHDFLSYALNNPRAPLDQVLRGIFTAPQAKKVRQAIGVKPETPVAMLHARQWAIVCDAMVR

SEQ ID NO: 12339 - protein, 392 aa, Bacillus subtilis
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGLDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 12340 - protein, 256 aa, Oryza sativa
MKLAVVAVAALLLAAGVASADEFDFFYLVQQWPGSFCDTQAGCCFPDTGKPAAEFGIHGLWPNYAKCRPAAGAVADDDDGVVEMVVDGGAAVERHHRRRQKCWPEYCDDGNKLRPWEIKDLVAELDANWPTLSCKGGKSFEFWSYEWKKHGTCSGMGQHGYFAAALELKKRHDLAAVLAGAGIVPSDDESYSLGSIRDAIAAATGAVPNLECNRDAAGETQLFQVYQCVDRSGKKLVDCQLPMQGKCRDKVKLPTF

SEQ ID NO: 12341 - protein, 350 aa, Arabidopsis thaliana
MQGGSSGIGYGLKYQARCISDVKADRDHTSFLTGTLSLKEENEVHLLRLSSGGSELLCEGLFSHPNEIWDLASSPFDQRIFSTVFSTGDSYGAAIWQIPEPYGQSNSSTLECVASLDAHVGKINCVLWCPSGNSDKLISMDEQNLVFWSLDSSKKSAEVLSKESAGMRHSLSGGAWNPHDVNSVAATSESSIQFWDLRTMKKNNSIERAHVRNVDYNLKREHILVSADDESGIHLWDLRKTKFPVQELPGHTHWTWAVRCNPEYEELILSVGTDSAVNLWFASASSEHKTSESPVEASRQRVNPLLNSYTDYEDSVYGLAWSSREPWIFASLSYDGRVVIESVKPFLPRR

SEQ ID NO: 12342 - protein, 1474 aa, Aspergillus nidulans FGSC A4
MAFLFKSKKNQQTSGLPPATRNVHTSEGAPAGSGATLNGSKDGVVTSQTPTPSGSYNNSLNSVTSTNSPEQQRMRQRAESESQAQRPQQSTSPVSSPGSSLYPWSQRRLNFSSPQANPFPRYGAAINAVASKEGDIYMMGGLIDGSTVKGDLWMLESSSGNLSCFPIATVSEGPGPRVGHASLLVGNAFIVFGGDTKVDENDTLDDTLYLLNTSSRQWSRSIPPGPRPTGRYGHTLNILGSRLYVFGGQVEGYFFNDLVAFDLNQLQNPGNKWEFLIQNSHEGGPPPGQIPPARTNHTIVSFNDKLYLFGGTNGLQWFNDVWSYDPRTNSWTQLDCVGFIPTPREGHAAALVNDVMYVFGGRTDEGIDLGDLAAFRISTRRWYSFQNMGPAPSPRSGHSMTAFGRQIIVLAGEPSSAPRDPVELSMAYMLDTSKIRYPTENPNGEKAMFPGPTKTGAGEKPPSGRVSREAQNQPSDQFRRAQGPRESVVSPTGRPTELGPGPGSRLPRASIANAPAGPPPPGQAPTPGPRGNPPRDGNNFRSKTPTKQERGYGGPPIDTTRAIAGDREREPAPRDSPKDPRFAQESTGQRTPTQQSQRMSARAMEAGEAAPLVAPARQRSLRQRQRSSMDSADESILGRHASIDGSVDSRTHRNSRTGDEPRSPRLTAHQEALFKELEALKSRNAWYASELALAKKAGYTPNISANSALDERTSDAFTDEDRPLIEAFLAMRAELAKMQATVDRQAAIASKRVAEVEQQRDVAVNEAAYARAKLAAHGGSQQSTPSLDGQSHDLDKAASDRTTDLSRRLALALASQNELKSKLEALSTDLEQEKRGRELAEETSEATRRRLAELEMQNNPLETESLRAQLHQVEASFREESMLRSEAESSLKQLALDKEELSRKLEDSTNRLRDFGDNIGGLKQAVTASVEKASILEKKLDEERERREGLERKLLQLRSEHEERTAELENATRRLRDAEELAESHAREAEAHKNAFILGLERASSFDSETSIRSLVDQRVATSEAQVERANKLARASQAAADEAAEKLRRAEERIAGLEAYQEQASREGLQLRRQLQAALKDCQTYTAENRELKAQIENHQREAGALAVQHAALKDLLGERGYTDSRRSPRGESPGSRFGTPEQNRLRELEQQLSASLKAHDELKASFETREQETDRAYKEKLEQLENDYQSAVHYVKGTEKMLKRMKDELTRYKMQNAKIQSELEAAQSREGSVAPSGWEAERSQLQQSLTDLQQDTSRSITNLEEQITSLKESLASAEAEKEKSVAEYETMRQELLAVSEKTSSELEQLKHENSLLEARAMDAEQKVSMLLDQVEASVGHYRRQSQHGQGVNGISRTHSNASSGTIGAGTRRSRANSAVSQDDTFLDNRGSMALDSLANELEALRSHWESTNSNYRLSTQSDFDRTPTKDSGLSDSLAEWRRRLDEEEARAGSPEKGKPRTAAEGQAAANMI

SEQ ID NO: 12343 - protein, 179 aa, Arabidopsis thaliana
  misc_feature (107)..(107): Xaa can be any naturally occurring amino acid
  misc_feature (135)..(135): Xaa can be any naturally occurring amino acid
  misc_feature (144)..(144): Xaa can be any naturally occurring amino acid
  misc_feature (149)..(150): Xaa can be any naturally occurring amino acid
  misc_feature (156)..(156): Xaa can be any naturally occurring amino acid
  misc_feature (160)..(160): Xaa can be any naturally occurring amino acid
  unsure (1)..(179): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVXREHGNTPGILTMEGNWTMWKLPLFGCTXSGQVLKGVXKSKRXXGGLIRXIGFXNRKPGVYKPMPFGFMGAIF

SEQ ID NO: 12344 - protein, 397 aa, Symbiobacterium thermophilum IAM 14863
MRLSARARALTPSPTMAIDAMSKQMVAEGIDVVNFSVGEPDFDTPESIKAAGIAAIQQGETKYTPAAGTLELRKAICEKLERDNGLQYRPEEIVVSNGGKQSLYNAYQVLLDPGEEVIIQAPYWVSYPEIVRLAGGVPVVVETDESTGFRLTADMIREKLTNRTRVINLNSPSNPTGAVLSRRELEEIAALAVEHDLMIVTDEIYEKLLYDGAEHVSIASLGEEVKRRTITVNGLSKAYAMTGWRMGYTASERIYAKAMADLQSQSTSGPSSISQAAAVAALRGSQESVEQMRQEFDRRRRHMLERLNRLPGFSVKVAPAGAFYLFPNVSALFGETIAGRKITSSDDLAEVILEQAHVAVVPGTGFGAPHHIRFSYATSMERIDEGLDRIARLLARG

SEQ ID NO: 12345 - protein, 178 aa, Arabidopsis thaliana
  misc_feature (147)..(148): Xaa can be any naturally occurring amino acid
  misc_feature (150)..(150): Xaa can be any naturally occurring amino acid
  misc_feature (157)..(157): Xaa can be any naturally occurring amino acid
  unsure (1)..(178): unsure at all Xaa locations
MASSTATMLKASPVKSDWVKGQSLLLRQPSSVSAIRSHVAPSALTVRAASAYADELVKTAVINSIIQKTIASPGHGIMAMDESNATCGKRLASIGLENTEANRQAYRTLLVSAPGLGQYISGLSCSRRLLTIPPLDGKKMVDVLVDXXIXPGIKVDXGLVPLLGLTNEVWCQGFDGYL

SEQ ID NO: 12346 - protein, 485 aa, Ginkgo biloba
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 12347 - protein, 586 aa, Ginkgo biloba
MITVRSIPCSFSKDTVQFIGFRKVLTVRNVVSCGVSSSFRLPGSKFFPRCESSSTERATKSNRTLLDNASNFLTNLLSGGQLGTMPIAEGAVSDLFGKPLFFSLYDWFIEHGSVYKLAFGPKSFVVVSDPIVVRHILRENAFAYDKGVLADILEPIMGKGLIPADLGTWKPRRKAIVPGFHAAFLEAMVKVFGDCSERTINKLQSLLLAAEADKTMHIDVDMEAEFSNLALDIIGLSVFNYDFGSVTRESPVIKAVYGTLFEAEHRSTFYIPYWKFPLARWLVPRQRKFHEDLKIINECLDSLIQGAKETRQEDDIEALQGRDYSKVKDASLLRFLVDMKGVDVDNGQLRDDLMTMLIAGHETTAAVLTWALFLLAQNTDKLVKAQAEIDTILDQRKPTFEDIKRLQYIRLIIAEALRLYPQPPLLIRRALRQDTIPGGYRGDKDGYLIPKGTDIFISVYNLHRSPYFWDQPHEFRPERFLIPKDNKGIEGWAGFDPYRSQGALYPNEVLADFAFLPFGGGPRKCVGDQFALMESTVGLAMLLQKFEVELKDPPESLRIVTGATIHTQNGLWCKIKRRKHYSESLQ

SEQ ID NO: 12348 - protein, 323 aa, Oryza sativa
MAGSAASAATDDNKEAVAMATIPEVPASELIQTMPRVGMGTAAFPFTSSEDTTAAMLRAIELGYRHFDTARIYATEGCVGEAVAEAVRRGLIASRADVFVTSKIWCSDLHAGRVVPAARETLRNLGMDYVDLLLVHWPVSLTPGNYDFPFPKEVILPSFDMEGVWRGMEECHRLGLARAIGVSNFSAKKLEQLLSLAAVRPAVNQVEVNPMWQQRTLREVCRREGVQLCGYSPLGAKGTPWGSAAVMDSGVLQEIAGAKGKTLAQTYNEKRMKENLDIFNWELTDEERERISQLPQLRGLPGLEFISDHGPYKSVEDLWDGDV

SEQ ID NO: 12349 - protein, 272 aa, Bacillus cereus ATCC 10987
MDKQIGFIGCGNMGMAIIGGMLNKKIVSSNKIMCSDLNTTNLENASEKYGITITTDNNEVAKNADILILSIKPDLYPLVINEIKEVIKNDAIIVTIAAGKSIESTENAFNKKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 12350 - protein, 297 aa, Prosthecochloris aestuarii DSM 271
MQASRRRSEAPSSRSATIFSTQWYRSGSMKQGVACITGSTDGIGRAAAFELAAAGHTVVLHGRSFERLEHTRREIEEQTGNHSIHTVLADFTDLCQVRRMADQLEKLCSVIDILINNAGVYMPRCQITTAGIETTFAVNHLAHFCLTTLLEPLLIESRTRVVNVSSVDHHSAGFSANSITGGTRYTGYQAYAFSKLCNVAFTLEHADRLRRTGVTVNTLDPGILATKLLHAGWSLQGDDVSCGAPPLLYLACSSKVADITGTYFENNHPAICSPIAHDPEIRRELWEISEEIVERNS

SEQ ID NO: 12351 - protein, 377 aa, Solanum tuberosum
MDSSNPKVITCKAAVVGKEGEMIKIEEIQVDPPKSNEVRIKMLFASLCHTDILASNGYPYSLFPRVLGHEGVGMIESVGENVTNLKEGDIVMPLYLGECKECPNCKSGKSNLCHKYHLTFSGLMLDDTSRISIHGGQVLYHSFSCSTWSEYIVINANYVIKVDPQKIPLQHASLLCCGFTTGYGATWREVHVEKGSTVAVLGLGVVGLGAIEGARSQGASKIIGVDINESKQGKGELFGMTDFINPKESMTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNELITHQISLTEINQSFELLKDPHCVKIIIKF

SEQ ID NO: 12352 - protein, 427 aa, Thermus thermophilus HB27
MEGMERPISEAYFQEAKRHIPGGVSSPVRAFKAVGGTPPFLVRGEGAYVWDADGNRYLDYVMSWGPLILGHAHPKVLARVRETLERGLTFGAPSPLEVALAKKVKRAYPFVDLVRFVNSGTEATMSALRLARGYTNRPYIVKFRGNYHGHADGLLVEAGSGALTLGVPSSAGVPEEYAKLTLVLEYNDPEGLREVLRRRGEEIAAIIFEPVVGNAGVLVPTEDFLKALHEAREFGVLLIADEVMTGFRLAFGGATELLGLKPDLVTLGKVLGGGLPAAAYAGRREIMEKVAPLGPVYQAGTLSGNPLAMAAGLATLELLEENPGYYRYLEDLGARLERGLKEVLAQKGIPHAVNRVGSMVTVFFTEGPVVTFQDAKRTDTELFKRFFHGLLDRGIYWPPSNFEAAFLSVAHTEEDVEKTLEALGEAL

SEQ ID NO: 12353 - protein, 296 aa, Bacillus cereus ATCC 14579
MVIQWFPGHMAKARRQVTEKLKLIDVVIELVDARLPLSSRNPMIDEIITHKPRLVVLNKADMADDRLTKQWIAYFKEKGHMAISINAQAGQGMKEIAAACKVLVKEKFDKMVAKGIRPRAIRALIVGIPNVGKSTLINKLAKKNIAKTGDRPGVTTAQQWIKVGKEMELLDTPGILWPKFEDQLVGLRLATTGAIKDSILNLQDVAVYALRFMEKHYPERLKERYNLNEIPEDIVELFDAIGKNRGCLMGGGMIDYDKTSELVLRELRGGKLGKMTFETPEEFGEQVEDVEKIEEV

SEQ ID NO: 12354 - protein, 487 aa, Nocardioides sp. JS614
MAELLMPWAAGREVNARDRTGTNLVNGNRTFAVEDPATLELIAEVADHGETEARAAVDRAHEAFAGWSGTSPRQRSDVLRRAYELMLRDEGRLSALIARENGKSLADAASEVVYAAEFFRWYAEEVVRTEGSYGEAPAGGVRTIVHHKPVGVAALVIPWNFPAAMATRKIAPALAAGCTVVLKPAAETPLTAIAIADLLAEAGLPAGVVELVTTTHAGAVVTAWLEDDRVRKVSFTGSTGIGRLLLHQAADRVVNTSMELGGNAAFIVTEDADLVDAVAGAMIAKFRNGGQACTAANRIYVHRDVADAFVALVGAQVEKLSVGAANDGNMIGPLISAAAVSRVGAAVDRAIEEGARVAARAQLPDAPGYFYPPTVLTDVPSTSSILAEEIFGPVAPIATWDDEQELLRQVNGTEYGLAAYVYTGHLERGLRLGERIEAGMVGINRGIVSDPSAPFGGVKQSGLGREGAREGLREFQETQYLSISWDD

SEQ ID NO: 12355 - protein, 473 aa, Prochlorococcus marinus str. MIT 9312
MSKSPQDVLSQIKDEGIELIDLKFTDIHGKWQHLTLTSDMIEEDSFTEGLAFDGSSIRGWKAINASDMSMVPDSSTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLIKAADNVMTYKYVVRNVAKKYGKTATFMPKPVFNDNGTGMHVHQSLWKSGQPLFFGESAYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPAEELAKIDTVPSSLNDSLNALKADKDYLLAGGVFTEDFIDNFIDIKYEEVQQLRQRPHPHEFFMYYDA

SEQ ID NO: 12356 - protein, 431 aa, Arabidopsis thaliana
  misc_feature (75)..(75): Xaa can be any naturally occurring amino acid
  misc_feature (349)..(349): Xaa can be any naturally occurring amino acid
  unsure (1)..(431): unsure at all Xaa locations
MSEDKDYMSEPFIVKKIDDEESLLDDYNPQGNTSFSKTCFHGINALSGVGILSVPYALASGGWLSLIILFTVAIXTFYCAILIKRCMEMDPLLRSYPDIGYKAFGNTGRVIVSIFMNLELYLVATSFLILEGDNLNKLFSNVGLNFMGLEFQGKQMFIIMVALIILPSVWLDNMRILSYVSASGVFASGVILASISSVGAFEGVGFKNNDSEVFRLNGVATSVSLYAFCYCAHPVFPTLYTSMKHKRQFSNVMIICFTICTFIYASVAVLGYLMYGSDVESQITLNLPTDKLSSKVAIWTTLVNPIAKFALMVTPIIDAMRSRFSRVLPNKRASGFLLSTILVTSNVIXALLLPFFGHLMSLVGAFLSASASVILPCLCYLKISGKYQRLGFETLVLIGITLTGIVVVITGTYQAVKDIFLVDFEIPIGEV

SEQ ID NO: 12357 - protein, 129 aa, Triticum aestivum
  misc_feature (84)..(84): Xaa can be any naturally occurring amino acid
  unsure (1)..(129): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSXKWVPCLEFSKVGFIFREHNASPGYYDGRYWTMLELLSSDPTPPGD

SEQ ID NO: 12358 - protein, 404 aa, Moorella thermoacetica ATCC 39073
MTIAHGFEARRFITPVVRDLPPSGIRRFFELVASTKGVISLGVGEPDFVTPWHIREACVQSLERGYTMYTSNYGLPELRRAIADYLAWRFGLTYDPMKQIMVTIGASEAVDLALRTVLNPGDEVLIPEPCYVSYQPITQLAGGIPVPIPTTMTDGFALTAARLEHYITPRSKVLILCFPNNPTGAVLSREEMQAIARLVEKYNLLVISDEIYAELRYEGQPLSFASLPGMQERTILVSGFSKAFAMTGWRIGYVAAHPDFLAAMVKIHQYTILCAPVMGQMAALEALRHGRQDVERMVEQYDQRRRLVYSRLREMGLDCFEPRGAFYIFPSIAATGLDSVTFAEELLKEEKVAVVPGTAFGASGEGFIRCSYAASLADLTEAMNRMERFVARRLAFNQRAVAQA

SEQ ID NO: 12359 - protein, 971 aa, Spinacia oleracea
MATLPLSSTTPSTGRTENCFSSYYSSSISRVMEFGLKNGCNSKLLFSSVNYKPMIMRGSRRCIVIRNVFSESKPKSEEPIIEQETPSILNPLSNLSPDSASRQSSIKYHAEFTPLFAPNDFSLPKAFFAAAQSVRDSLIINWNATYAHYEKMNMKQAYYLSMEFLQGRALLNAIGNLELTDAYGDALKKLGHNLEAVACQERDAALGNGGLGRLASCFLDSLATLNYPAWGYGLRYKYGLFKQMITKDGQEEVAENWLEIANPWELVRNDVSYSIKFYGKVVSGSDGRSHWTGGEDIRAVAYDVPIPGYQTKTTINLRLWCTTVSSEDFDLSAFNAGEHAKANEARANAEKICSVLYPGDESMEGKILRLKQQYTLCSASLQDIISQFERRSGEHVNWEEFPEKVAVQMNDTHPTLCIPELMRILIDVKGLAWKEAWNITQRTVAYTNHTVLPEALEKWSFELMQSLLPRHVEIIEKIDEELVDTIVSEYGTDDPKLLMGKLNELRILENFHLPSSVASIIKDKITCQVDEDKKIEISDEVDGLVVVEESEEGDIEKQAVEEPVPKPAKLVRMANLCIVGGHAVNGVAEIHSQIVKEQVFRDFFELWPEKFQNKTNGVTPRRWIRFCNPELSSILTKWIGSDDWVLNTEKLAELRKFADNKDLHTEWMEAKRNNKQKVVSLIKERTGYTVSPDAMFDIQIKRIHEYKRQLMNILGIVYRYKKMKEMSAAERKEKYVPRVCIFGGKAFATYVQAKRIVKFITDVGATINHDPEIGDLLKVVFIPDYNVSVAELLIPASELSQHISTAGMEASGTSNMKFSMNGCILIGTLDGANVEIREEVGEDNFFLFGARAHDIAGLRKERAEGKYVPDPCFEEVKEYVRSGVFGSNSYDELLGSLEGNEGFGRADYFLVGKDFPSYVECQEQVDQAYRDQQKWTRMSILNTAGSFKFSSDRTIHQYAKDIWNIHPVNLP

SEQ ID NO: 12360 - protein, 232 aa, Nicotiana tabacum
MGCLSVVGASPCVSSSALSSPTSRLSCAPSCKLILNPIKKNHHLAAFQPAVHLFASNQSRSHASKRNHTTRIFLPHLVASMEEVEETYIMIKPDGVQRGLVGEIISRFEKKGFKLTGLKLFHCPKELAEEHYKDLQSKPFFPKLIDYITSGPVVCMAWEGVGVVASARKLIGATNPLNAEPGTIRGDLAVQTGRNVVHGSDSPDNGKREIALWFGEGELCSWTPVQEPWLIE

SEQ ID NO: 12361 - protein, 265 aa, Salinibacter ruber DSM 13855
MPRVTTKTVQEMKEEGVPIAALTAYDYTSARLLDRAGADVLLVGDSAANVMAGHETTLPMTLDQMIYHAQCVVRGIDRSLVVVDLPFGAYQGDPTEALDSAIRVMKEAGAHAVKLEGGAPVVEAVERMVTAGIPVMGHLGLTPQSIYDYGTYQVRARDEEEADELRADAKRLEEAGCFAVVLEKIPAELAAEVTASLSIPTIGIGAGDQTDGQVLVSHDALGLSTDFEPRFVRRYARLDETIIDAIGAYVSDVRDRSFPDEDESY

SEQ ID NO: 12362 - protein, 442 aa, Oryza sativa (japonica cultivar-group)
MPPPPALPVCLLLLLLLLLAVPRPAAAAAAAAATRPLLFELRARQVPAGALPRPASKLRFHHNVSLTVSLAVGTPPQNVTMVLDTGSELSWLLCAPGGGGGGGGRSALSFRPRASLTFASVPCDSAQCRSRDLPSPPACDGASKQCRVSLSYADGSSSDGALATEVFTVGQGPPLRAAFGCMATAFDTSPDGVATAGLLGMNRGALSFVSQASTRRFSYCISDRDDAGVLLLGHSDLPFLPLNYTPLYQPAMPLPYFDRVAYSVQLLGIRVGGKPLPIPASVLAPDHTGAGQTMVDSGTQFTFLLGDAYSALKAEFSRQTKPWLPALNDPNFAFQEAFDTCFRVPQGRAPPARLPAVTLLFNGAQMTVAGDRLLYKVPGERRGGDGVWCLTFGNADMVPITAYVIGHHHQMNVWVEYDLERGRVGLAPIRCDVASERLGLML

SEQ ID NO: 12363 - protein, 170 aa, Zea mays
  misc_feature (122)..(122): Xaa can be any naturally occurring amino acid
  misc_feature (133)..(133): Xaa can be any naturally occurring amino acid
  misc_feature (145)..(145): Xaa can be any naturally occurring amino acid
  misc_feature (151)..(151): Xaa can be any naturally occurring amino acid
  misc_feature (158)..(158): Xaa can be any naturally occurring amino acid
  misc_feature (166)..(166): Xaa can be any naturally occurring amino acid
  unsure (1)..(170): unsure at all Xaa locations
MTFSMLSSGTVNISPARASMSAPFTGLETSTAYPDSSKTDSDMTSMTRNGGRVNCMKAGAQVSKKKIETVSYLPDLTDGEASNEVDYHLLNKRIPCVKLEEEHEFVYREQINTPTYYDVHNXQMRKFPLDACXDSAHVISQLHEXKNEYPXSFIRIIXFDNNRLVXCINF

SEQ ID NO: 12364 - protein, 99 aa, Zea mays
MAWRASLSRSLKEIRVLFCQSSPASAAAREFVKKNYGDIKARNPSLPFLVRECSGVPPQLWARYDMGVERCVNLDGLTEAQIDKKLEELAKAGESLKTK

SEQ ID NO: 12365 - protein, 344 aa, Haloarcula marismortui ATCC 43049
MRASTLTDVGEITVEDRDRPDPADDEVLVQVGACSVCMTDYHMYHGTFAAETPLVLGHEGAGTVAEVGADVDRFAVGDRVAINPTVPCNACSYCKKGETHLCENNTSIGGAGDTILDGAFAEYVRVPAINVEDIGEMSFERAALAEPLACCVHGVEQADIKPGDSVGIIGAGPIGLLLLQAFRNAGAAPIVVSELDDERRELAADLGADAVIDPNEEDPEEAIPAAAGGPVNVGAEAIGLVPTIKQANAVTAPGGSTLIFGVPDQEATMEVSPFDVFFDEVDYRGSFSLTTEDFERAITLLRHERIDAETLITERIGLDDLPAAFERMGNAEGLKKVVVPGDSE

SEQ ID NO: 12366 - protein, 425 aa, Arabidopsis thaliana
  misc_feature (166)..(166): Xaa can be any naturally occurring amino acid
  unsure (1)..(425): unsure at all Xaa locations
MGNALVKKEPPPPVVLVPPLFDYPPLSARTRMLESSYNLLFGKLALRCLFEDYFEEANRFTAKFLLKPTDDPHVDLVASVSGAVDGRVEGDFVGNAEFRWQSDVDDPHTFVDLSVSTSNPVLLMRSSAYYPKYGIGAFAVYPLISKITGKSSEEYRIMGLRYGSTXLSVGATVTPFSANNELPKHAWLVSKMGSLTVGVQYEPLHGSKDLAKYTDPRNWSCAAGYGVGSQSPLTPSFNMGIELARSSQFIASFYQHVVVQRKVQNPFEENQVVGITNYIDFGFELQSRVDDSKTPPNAPDSLLQVAASWQANKNFLLKGKVGAHSSTLSLAFKSWWKPSFAFNISATTNHRTGNVQCGFGLRVDNLREASYQRADPNFVMLTPNKEHLAEGIVWKMGKRPMYQADVDAENFSELPKELRPSQKIL

SEQ ID NO: 12367 - protein, 513 aa, Bacillus cereus ATCC 10987
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 12368 - protein, 767 aa, Yarrowia lipolytica CLIB122
MYSDDVASVTSSDNEQVENDSIRRALRRSALLRSASSRHGSSAVNRSGASSPTSSSSNSIQSAETDSDIDMDEVAEADGVEPDKDAPVHQLPSELLTVIFTMLPERRDVHSCLLVSKTWFMSCVDLVWFRPHLPKDLTRLQQLLRTLKQPVSSQTVPYSTYIRRLNLTNLTGEMTDELLSGVAVCTRLERLTLANCTALSDASLVPVLQQNSGLQSVDVTNVSHITDATIKALLPSKRRLQGLYATGCANITNAAIVALATECRLLKRIKVNSCPNVEDEAAMALVDNCPQLVELDLHENSALSGSVATEALRKLPNLRELRVGQVTGVNDACFLGFPARPQFDRLRIIDLTACNAITDAAVDRLVTCAPKLRHVVLAKCTRVTDRSIRSLLRLGKSLHYLHLGHCASITDAGIAQLVRACQRIQYIDVANCSQLTDAAVEDLASLTKLRRIGLVKCVNITDAAIYALASRSGFEASLERVHLSYCAGISIPAVLRLVNVCPRLSHLSLTGVTAFLRSDFRQFCREPPPEFTQHHQALFCVFSGDGVKRLRTHLNQLAEADMGYLLGGGGFAGGLGPGIGGGLGGGVGTATLEELIAAQRRVRHIVNEVFPDGRPHGGLDGLGMDGIDPLAQLEHVHHIERVMARLEMERQEGLEQRHQQEQRQLREGFRQADQRQLREGFGQPEIQQPGPPTALPVLPEGGVPVVAQPVAGIPPAAARGLERQTQQYNEALQQLQMLEGRPEVDQQLVAELRRQVEQHGREMGQGE

SEQ ID NO: 12369 - protein, 292 aa, Polaromonas sp. JS666
MTSSPTAAPASPLLWPAEAIWEAVAPTLPGFTVEVLPEIDSTNSELMRRFRGSAGAPPRPEPLLLVAEQQTAGRGRSGRSWESRRSDSLTFSLGLPLQPADWSGLSLAVGISLAESLDPRTAGPPAIGLKWPNDLWLRSQAGESERKLAGILVETASWGGIRYVVIGVGINILPVQLSAPTSGSPATMAPGCLQELLPGVDAGEALLRALPPLVQAVQAFEQFGFAPFQARFAARDVLAGRAVKLSDGTEGTAHGVSESGALLVHTAAGMKEITSSEVSVRPVSAAQDSRPC

SEQ ID NO: 12370 - protein, 458 aa, Streptococcus agalactiae A909
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 12371 - protein, 76 aa, Brassica napus
MIGRRAGTNRAGMRRDDSILTRFVDSVFSLFRLAEFEILFVLFFVIAYVIFKDLTARPEYNRILVEKPRGYDVWPF

SEQ ID NO: 12372 - protein, 248 aa, Candida albicans SC5314
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 12373 - protein, 133 aa, Brassica napus
  misc_feature (7)..(7): Xaa can be any naturally occurring amino acid
  misc_feature (9)..(9): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(32): Xaa can be any naturally occurring amino acid
  misc_feature (39)..(39): Xaa can be any naturally occurring amino acid
  misc_feature (42)..(42): Xaa can be any naturally occurring amino acid
  misc_feature (45)..(46): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (61)..(62): Xaa can be any naturally occurring amino acid
  misc_feature (67)..(67): Xaa can be any naturally occurring amino acid
  misc_feature (70)..(70): Xaa can be any naturally occurring amino acid
  misc_feature (88)..(88): Xaa can be any naturally occurring amino acid
  misc_feature (90)..(90): Xaa can be any naturally occurring amino acid
  misc_feature (106)..(106): Xaa can be any naturally occurring amino acid
  misc_feature (118)..(118): Xaa can be any naturally occurring amino acid
  misc_feature (124)..(126): Xaa can be any naturally occurring amino acid
  misc_feature (129)..(129): Xaa can be any naturally occurring amino acid
  misc_feature (132)..(132): Xaa can be any naturally occurring amino acid
  unsure (1)..(133): unsure at all Xaa locations
MSAFTSXFXDEXIXNXAYIGXPGKGILXADEXTGTIGKXLAXINXXDVXTIRXALREXLFXXPGALXCLXGVILFEETLYQKSSDGKXFXDILKEGGVLPGIKVDXGTAELGGTNGEXTTQGLXXXGEXCKXT

SEQ ID NO: 12374 - protein, 406 aa, Eremothecium gossypii
MSSRGFGLLRGVFRARTARHLVYHVTGPRLHMGMPGDTAKFASASRLSAVTRTSTSGYRSVERTAKAGMSESFKLVCLGNPLLDISATVDPEYLERYSLKSNDAILVDAAGDDGRMKIFDEMLEFPGMRYVAGGAAQNTARGAAYVLGRDQVAYFGCVGRDQFSEKLMSANKAAGVSTFYQEEPEISTGKCAVMITGHDRSMVTDLGAANHFKPEHLDKHWNVVESAKMFYVGGFHLTVSPEAIVKLGKHAQENGKPFVLNFSAPFIPQFFRSALEQVLPYTTHIIANESEAASYAESFGLDCDREDLVSIAKHVIGDSSRTVVFTHGLEPTIVVSPAGEAAYPVHPVDKEKIVDTNGAGDAFAGGFVAALVQGRDLPTAVDMGQWLAALSIQEFGPCYPTEKLQY

SEQ ID NO: 12375 - protein, 454 aa, Candidatus Kuenenia stuttgartiensis
MIPAFQDFSFRDKNLYLYTKIRLYMSKIITEKSKKAFLDAQSVIPGGVNSPVRAFGGVGGTPIFIKSGSGCCLTDIDGNRYVDYVGSWGPLILGHADPRIVKRVNEAVANGTSYGAPTELEIQLAKLVKEAMPSIEKIRMVNSGTEATMSAIRLARGHTKRDEVIKFEGCYHGHVDSLLVQAGSGATTLGMPNSPGIPGDFVKHTISLPYNNIDAVNEVCSRRGNEIACIIVEAVAGNMGVVPPAKNYLAGLREITKKYGIVLIFDEVMTGFRVAHGGVQALYNITPDLTTLGKIIGGGLPVGAYGGKKEIMDGISPVGPVYQAGTLSGNPVAMTAGIATLEILKDNAVYKGLEERSKQLAAGMEKVCNDANIPAYHTRVGSMLCTFFTSKPVVDYATAKLCDTGRYAKFFHGMLERGFYFAPSQFEAAFVSTVHGEKEINDTIAAFGEVVKTL

SEQ ID NO: 12376 - protein, 327 aa, Synechocystis sp. PCC 6803
MQSFNRINSMKYFPLSNGEQIPALGLGTWKSSPQVVGQAVEQALDLGYRHLDCAAIYGNEAEIGATLANAFTKGVVKREELWITSKLWSNAHHPDAVLPALEKTLQDLGLDYLDLYLIHWPVVIQPDVGFPESGDQLLPFTPASLEGTWQALEKAVDLGLCHHIGVSNFSLKKLEMVLSMARIPPAVNQVELHPYLQQSDLLTFANSQNILLTAYSPLGSGDRPAAFQQAAEPKLLTDPVINGIAAEQGCSAAQVLLAWAIQRGTVTIPKSVNPERLEQNLRAADITLTDSEMAKIALLDRHYRYVSGDFWTMPGSPYTLQNLWDEI

SEQ ID NO: 12377 - protein, 1142 aa, Ashbya gossypii ATCC 10895
MGDKNNNVTSLRGDRIGPWKLGETLGAGSTGKVLLAQNTETGQIAAVKVISKSVFNAQGSTFVGSNDPDVLPYGIEREIIIMKLLNHPNVLRLYDVWETAQDLYMVLEYVEKGELFNLLVQRGPLPENEAVRFFRQIIIGISYCHALGIVHRDLKPENLLLDHKFNIKLADFGMAALESKDKLLETSCGSPHYAAPEIVSGLPYHGFESDVWSCGVILYALLTGRLPFDEEDGNIRNLLLKVQSGKYEIPGEDEISPEARDLIVQILTVEPEQRIKTREILKHPLLQKYPSIKDSKSIRNLPREDTYLNPLDHNDGTIDQAILQNLVVLWHGRDKNEITMKLKEPGANLEKTFYALLHRFKFENEQQQLKQQQIAKRISSTSSSPQQNIVKSSSRRSINNILSTPKKKRSSAINVSSAHKRPVSIQKLNDCGTLNPTSPSKKRSLSNRKLSAVLAGSNSSSPSRKRMSVGQDAPPVPTAVLRDYNKRASRASKRLSFLPSKRGSITTKIIATYAKLSEDNDWEYIDREAKRTSSDFATLIDNIFEHEKYEQIRREKEELERKVREAKEREERERRARAEAERRKREEEERRRRREVEELIRQRELQKSLEEQVARLKAEVAATKQEKRISLAQEQHVRSISEPMERKGTRPSKRDSFLALQNNINSLLKRRTLSLETRPISRLDPGIRLSEENTILEDDLECNEDRLRVEKNILETIRRSKFLGSQYDIDKELQRVRREKLEKVNMRKSQDRKLEPGLHSRQEQRFVSDGTTVTSSHEDSESIILPKNVTAIGVLKDEESEPRKLSEVKIPQFTRRSKHFSASSKRLSVLSMYSTKVSYTNLADYLNNDVQLKSLQPSAPTSIKIPQEPEFMFESAGQENRYQAAAPTDTYLERPKVGVEGDHEPGEPVELIELDDSEDRSKQYSEEDIAKVKLPILPPLDHLNKPNGLGIYQAPAPPKEPLGQPVMKSMIPDDIKIKCVPNQLSPRRRATERAPEKKLTKTVPERVIAAETFPPPNTKKKPSFFKKFSREKMHSDCDVQLDTTVGDSKMFRALNKLLNGWTSYGLKEVRSMPASYTITGKLSSDNILSLRSTAFEIVILSVADTGSSVKFTKKSGSKKTFTRLVNEIEKILEKESVLVLAS

SEQ ID NO: 12378 - protein, 260 aa, Caulobacter crescentus CB15
MTPILLLGAGRMGGALIQGWQAAGAFDAADLIIRDPHVDAAAFAGAVVNPPLETLGAAKTVLLAVKPQIWREAIADVVPHLAPDAVIVSIAAGVRAADISQAFGGRRVARVMPTTAVAIGQGAASLYADDAEALARARALFAPLAAVAELASEDLMHAATAVSGSAPAYLYAFIEALEAAGAAQGLDPAQSARLARATIIGAAALMAQSGEEPAELRKQVTSPGGTTAAALSVLMGAGGFGDLLPKALDAAVARSKELGG

SEQ ID NO: 12379 - protein, 530 aa, Triticum aestivum
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRAPMPVLAVVFPREGSDPSKWRSYGTTQARQCFSVRGVYPLMGSTDDAETGGLTKEEYGIKLALNYGRSVGIIKPYDRVIIFEKIGDSSVVKIIECDDSER

SEQ ID NO: 12380 - protein, 259 aa, Brassica napus
MGSASNPLVTSSVVDDSPLPSNLTQDDLKKLAAYKAVEYVKSGMVVGLGTGSTAKHAVARISELLRQGKLRDIIGIPTSTTTHEQAVSLGIPLSDLDSHPVVDLSIDGADEVDPALNLVKGRGGSLLREKMVEGASKKFVVIVDESKLVKHIGGSGLAVPVEVVPFCCDFTRGKLEELFREAGCKAKLRVKSGGEAAAVTDNGNYVVDLYLERDMGDLEAASEKILRLPGVVEHGMFLGIATTLIVAGKSGVTVKDRFG

SEQ ID NO: 12381 - protein, 283 aa, Eremothecium gossypii
MGYTLTILGCGVMGQAVLSAIYNAPKADDESRAMYPSRIITCNNNAQSAKQVTELVRGFGTSPNGIEVESTSGDNAKAVAEARVVVLGTKPYLVEEVLQDVRTQVADKLLISLAAGWTLDQLVDYTARVARVMTNTPAKYGYGAAAVSHSPDVTADERALVSRLVGHLGLCVELPEKNMDAATALIGSGPAFALLMLESMMEAGVKLGIPLDVSRRCAAKVLEGTARMAEETGSHPAALKHQVCTPGGTTIAGLCVMEDSGVRSGIVKGIEEAANVAARLGRK

SEQ ID NO: 12382 - protein, 597 aa, Prochlorococcus marinus str. MIT 9312
MSNIDLKRRTKIVATIGPATQSEEIITNLIKAGVTTFRLNFSHGDHNDHAERIKTIREVSQKLDIDIGILQDLQGPKIRLGRFKDGPVKVKKGDKFTLTSNEVECSNTIANVTYENLSQEVSEGKRILLDDGKIEMIVEKVDTKANLLECLVTVGGVLSNNKGVNFPDVQLSVKALTEKDKEDLKFGLSEGVDWIALSFVRNPSDINEIKDLINKNGHSTPVVAKIEKFEAIDQIDAVLPLCDGVMVARGDLGVEMPAEEVPLLQKDLIRKANSLGIPIITATQMLDSMASNPRPTRAEVSDVANAILDGTDAVMLSNETAVGDYPVEAVQTMATIARRIERDYPLKAIESHLPSTIPNAISGAVSNIARQLDAGAIIPLTKSGSTARNVSKFRPPTPILATTTERSVARRLQLVWGVTPIVVNNDERTAKTFSLAMQIAQEMGILKQGDLVVQTAGTLTGISGSTDLIKVGLVRKILSRGISIGEIGVTGKARKINTKLDLSLICPGEILFVNKELLENVPLSKNIAGIVTNQNVDDVYAFFNKNNKKISTICNVENIDNNQIINGDLVTLQLNEGVIYMGQIEDDEEAIDKYKYV

SEQ ID NO: 12383 - protein, 266 aa, Dehalococcoides sp. CBDB1
MEKYMNTACISLNDIQNNLRTCFMGREIIYLPETASTQIVAMEMARKGAGDGTVIITERQTDGHGRLKRLWVSPQGNIYMSFILRPSQTEISRLIMAASLAISFAIQDTTGIMTELKWPNDILINGKKVCGMLVENDIRDGQVNFSVVGLGINVNADMQDYPELKDIATSLINHTGKPVSREKLILSFLHEFERLYLDLNEHGKCVFEMWKKRLITLGKEVDVTSGKDIYSGIVETVASDGSLKIRLADGNLVHIVAGDVSLRHAE

SEQ ID NO: 12384 - protein, 405 aa, Kineococcus radiotolerans SRS30216
MKLEQSDKLADVLYDVRGPALRRAQQLEEAGHRILKLNIGNPAPFGFEAPEELLQDMVANLPVAQGYSDSKGVPSARRAVVQSSQLKGVPGVDVNDVYMGNGVSELIVMTMQALLNDGDEVLVPAPDYPLWTAATSLAGGRAVHYLCDESAGWEPDLDHLRAQVTPRTKAMVVINPNNPTGAVYGKAVLEGMLQVAREHGLLVLSDEIYDKILYDDAVHVSTASLAPDLLCITFNGLSKAYRVAGFRSGWMYLSGPKGHAAGFVEGLDLLANMRLCANVPAQHVVQAALSGHQSINDLVLPGGRLAEQSHRTWELLNQIPGVSCVKPRGALYCFPRLDPEVHRVEDDYQLIVDLLESQHVLVVQGTGFNWPKPDHFRIVTLPRVEDLESAVGRIGTFLTGRLAGR

SEQ ID NO: 12385 - protein, 250 aa, Thermus thermophilus HB27
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQEIRKALSERYGEAFASRVRILYGGSVNPKNFADLLSMPNVDGGLVGGASLELESFLALLRIAG

SEQ ID NO: 12386 - protein, 350 aa, Bacteroides thetaiotaomicron VPI-5482
MSMDNHIVIMAGGIGSRFWPMSTPECPKQFIDVMGCGRTLIQLTADRFDGVCPRENVWVVTSEKYIDIVREQLPEIPESNILAEPCARNTAPCIAYACWKIKKKHPNANVVVTPSDALVINTGEFRRVVEKALRFTDNSSAIVTLGIKPTRPETGYGYIAAGDQIMTDKEIFTVDAFKEKPDRETADRYLAEGNYFWNAGIFVWNVRTITSVMRVYAPGIAQIFDRIFPDFYTEKENETIKKLFPTCEAISIDYAVMEKAQEIYVLPASFGWSDLGTWGALRGLLPQDKSGNATVGADVRLYESKNCIVHTSEEKRVVIQGLDGYIIAEKDNTLLICKLDEEQRIKEFSK

SEQ ID NO: 12387 - protein, 215 aa, Tropheryma whipplei TW08/27
MRHIPDALNALRAGRPVVVLDDKNRENEADVIMAAQFATQEWVAWIIRHTSGFLCVPLSNQRADKLQLPSMVAANEDRFKTAYTISVDAADAAITTGISAADRSLTIRTLAARDSSAKHLVRPGHILPLRARDGGLLERRGHTEAAIELMRQAQLEPVAVIAELVSDTGELLRGRALDEFIRKNNLVLVEISQIIEYMKMSDLKDISMNLNRDCL

SEQ ID NO: 12388 - protein, 387 aa, Xanthomonas axonopodis pv. citri str. 306
MLALNYHGSRDVRVETVPGPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLAVPDALHDEQVLFLSDILPTGYQAVVNAGVKQGSTVAIFGAGPVGLMAAACCRMLGAERVFMVDRHAYRLDFASRTYGVIPINFDEVDDPADVIVSQTNGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSAIISHRMSLADAARGYDLFDKKQDDCRKVVLTP

SEQ ID NO: 12389 - protein, 110 aa, Sisymbrium irio
MFFEIIQAIFTAAAALALFVFAGITLGGSAVGLAVSTPLFVIFSPILVPATIATTLLATGFTASGSFGATALSILMWLYKKYTGKEPPKIPGMTPAAPKSKPADSGGKTE

SEQ ID NO: 12390 - protein, 593 aa, Triticum aestivum
  misc_feature (568)..(568): Xaa can be any naturally occurring amino acid
  unsure (1)..(593): unsure at all Xaa locations
MRSPSLEPAAAASPVPRAAAFGRVRVAHGARGLRGVAGAGVPGTAGRLRVLVAALPEPLLHRLMPAQEGAAALSPEADEVHGDMASAEISSPAARAVPGSTLRVRFVLKERCNFGQSFQMVGDDPALGLWEPARAVALDWSEGHNWTVEKDLPANRLIEFKFLLQDSLGKFHWQNGPNRTLQTGETTKTLVVYEDWGNAKNQKVAEEGDAPVQMMEAVLDGDHGRNGVVSAHELQVCDNQEMKEPDAPMPIPWGGAFGRVRVTYGGQGLRRVGSDGLAGTAGRLSVLVTALPKPLEQLVPTQEGGIALAPEADEVQGGVASAEISSPPAPAVPGSTVRVRFVLKEQCTFGQSFHLVGDVPALGLWEPTNAVAMDWLEGHDWTVEKDLPANRLIEFKFLLQDSLGKFHWQNGPNRSLQTGETTKTLVVYEDWGNAKNQKVAEEGHTPVQMMETVVNDDHGRNGVVSAHELQVCDNQEIKEDESTISDDDNSMAAAIASVGEETMKACEADQPELLMGEQKIQDELRYEIDTAPQNGRATTYADADGEYDETTDDDSILPKNGALVKHGXAGAFERELLWGWKALQQLVGFKADT

SEQ ID NO: 12391 - protein, 106 aa, Sisymbrium irio
MFEIIQAVFTAAGALALLVFAGITLGGSAVVLAVTTPLFVIFSPVLVPATIATTLLATGFTASGSFGAMAVTIFMWLYKRYTGKDPPKIPGLTPSNPAASGGKKDD

SEQ ID NO: 12392 - protein, 319 aa, Yarrowia lipolytica CLIB122
MDVEMTDVKEPASTLYTGTLDQWIEQLKECKPLTEAEVATMCDMAQEILQQESNVQGVHTPVTVCGDVHGQFHDLMELFCIGGPCPDTNYLFMGDYVDRGYYSVETISLLVAMKIRYPNRITILRGNHESRQITQVYGFYDECLRKYGHANVWKRFTDLFDYLPLTALIENKIFCLHGGLSPTIDTLDNIRTLDRIQEVPHEGPMCDLLWSDPDERCGWGISPRGAGYTFGHDISEAFNHANGLELIARAHQLVMEGFSWGQDKQVVTIFSAPNYCYRCGNQAAIMELDEQLNKKFIQIDPSPREGEPTISRRTPDYFL

SEQ ID NO: 12393 - protein, 474 aa, Anabaena variabilis ATCC 29413
MTTSQEVLKRIQDEKIELIDLKFIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 12394 - protein, 907 aa, Xanthomonas oryzae pv. oryzae KACC10331
MGAGPARSRHRCRGRSVGRASLRVARQIPTHPSRGEAAVRVMAHPRRRGRMNAVASLQADAEPSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARTAPAGSPGRDFYVWSDTDQEYEGTRIIFCDTEKSNWTWDPVAGQYFWHRFYSHQPDLNFDNPAVLEAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFELVSEGTLPDWHVPSPVPLPDYRTLVLRSDADGSAALLPHLPTLEGEILPAWLSARRWFSAKDQALRSVRIARRTPLPGDQPMTLLELEVELEDGRRERYMLPVGIVWEREQPSTLAEQLALARVRQGREVGYLTDAFALKPMVRGVIDALCSNAALKFCDGEEASQQGQVRFEATPALAMLDIPHDPEIRWLSAEQSNSSLVIADKAVFKLLRHVAVGANPEIEIGRRLTEMGYANAAPLLGSISRVDGQGTVTTIALLQGFIRNQGDAWRWTLDHLARSFDEYVDRADRRSARRSRRWL

SEQ ID NO: 12395 - protein, 470 aa, Erwinia carotovora subsp. atroseptica SCRI1043
MVEKLKETADLAPEQGEGLQRNLTNRHIQLIAIGGAIGTGLFMGSGKTISMAGPSIIFVYMIIGFMLFFVMRAMGELLLSNLNYKSFSDFAADLLGPWAGFFTGWTYWFCWVVTGIADVVAISAYSQFWFPDLSQWVSSLLCVLLLLTLNLATVKLFGEMEFWFAMIKIVAIVALIVVGVALVMMQFSSPSGNVASFNNLWNDGGMFPKGISGFFAGFQIAVFAFVGIELVGTTAAETKNPKVVLPRAINAIPIRIIMFYVFALIMIMSVTPWGAITADRSPFVEMFVLVGLPAAASMINFVVLTSAASSANSGVFSTSRMLFGLAKQGDAPKSFGMLSKRAVPSTGLMFSCICLLSGVVLIYLIPNVMTVFTLVTTVSAILFMFIWSIILCSYLTYRKKRPQLHAESSYKMPLGVFMCRVCLAFFAFVIVLLTLQPDTRQALVVTPLWFIVLAIAYQFVRRKKQVVDVK

SEQ ID NO: 12396 - protein, 209 aa, Rhizobium etli
MSTLVIVRHGQSEGNARGEFTGTSDVPLTQEGWSESRRAGSLLANLGISFDIAFSSALLRTVDTCRAILNETNGDLLEPIRRTELNERDYGQLTGINKNVARERWGQDVVQVWRRSYSTPPPGGESIRDISARVLPFLISEVFPPLLRGKSVLVVAHGNTIRSLKQGIERLTIQDTLAIESPTAAPTVYRIASDLSIIEKTNVLVGTVC

SEQ ID NO: 12397 - protein, 380 aa, Neurospora crassa
MASTVGKTITCKAAIAWGAGQELSYEDVEVAPPKAHEVRIQIKHTGVCHTDAYTLSGKDPEGAFPVILGHEGAGIVESVGEGVTNVKPGDHVIALYTPECKECKFCKSGKTNLCGKIRATQGRGVMPDGTSRFRARGQDILHFMGTSTFSQYTVVADISVVAVNPEAPMDRTCLLGCGITTGYGAATITANVEKGSTVAIFGAGCVGLSVIQGAVANGASKIIAVDVNPSKEEWSRKFGATDFVNPSTLPEGQSVVDKLIELTDGGCDYTFDCTGNVKVMRAALEACHKGWGQSIIIGVAAAGQEISTRPFMLVTGRVWRGSAFGGVKGRSQLPGLVEDYLNGKIKVDELITHRKKLAEINNAFEVMHQGDCVRAVVDMS

SEQ ID NO: 12398 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 12399 - protein, 368 aa, Rhizobium etli
MKQAYAAVSREKAKPLILECIGIEEPRADEILVRIVASGVCHTDLVVRDQGYDVPQPVVLGHEGSGVVEAVGSAVKDLVPGDHVALSYAYCGKCEKCLSGTPFYCEDFFGRNFRGTRPDGTCPIHDSHGKQISGCFFEQSSFATYAIASERNAVKVAKDVPLELIGPLGCGLQTGAGAVLNCLKPKPGSSIAVFGAGAVGMAATMAAKIAGCATIIVIDLNDERLELSRELGATHTINARKLDSVAAIRKIVPAGVDFSLECTSSPRVFRQAVDCLGTPGTCGLVGSSALGTEGTIDIGNFLFGRTLIGVVEGQSVPSEFVPQLIEYWQQGLFPFDKLVQFYDLDQINEAMADSESGKVIKPILRMKH

SEQ ID NO: 12400 - protein, 821 aa, Haemophilus influenzae Rd KW20
MIMDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHNSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSDLMVTSTFADFARIFPERFTNVTNGITPRRWLAVANPQLAALFDKYIGSEWRCDLSQIEKLKPFAQEKAFKEAVADIKFANKVKLAEYVKSELGVELDPHALFDVQVKRIHEYKRQMLNVLHIIARYNEMLTNPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGEDNIFIFGNTVEQVEQLRREGYRSFEYYQNDAQLRTVVDQIIEGKFSPEDPQRYHQLLQGLQYHDYYQAFADFRSYVETQKAVDEKYKQRDQWIESTIQNIVNMGFFSSDRTIKEYAERIWKVEPVQLGD

SEQ ID NO: 12401 - protein, 521 aa, Thermus thermophilus HB27
MWRVLVSDDMRLGEVRYPGVILDYRPGIGREELLEIIPAYDALITRSRTRVDAELLQRGKRLKVVGRGGVGVDNVDLEAASRLGILVVNVPEANTRSAAELAFGLLLAAARGIALSDRKLRQGEWDRKFLGLELKGKTLGIVGLGRIGSQVARFAKAFEMRVLAYDPYIPKARAESLGVELLENLEDLLRQSHFLTVHTPLTEETRGMIGRRELYLLPRGAVVVNAARGGIIDEKALLEVLEEGHLFAAGLDVFAEEPPPKDHPLIHHPRVVHTAHLGANTLEAQERVGEAILERVVRTLEGDLSYALNTGFDPEALEALKGFLPLGEALGKLLAQITRGRPEALEVRFLGQFEKDPEPIASAVAKGLLARVLGEGAVNLVSARPLLKDRGIHLTTLRSEEAGEYTRLVEARLSTDQEERRARGVVIGGRPRLVGIDDYALEVVPEGYMLVCVNYDRPGVVGQVGTLLGEAGVNIAGMQLGRDVPGGRALFVLTVDQKPSPEVLEALRALPVLERVDLVEL

SEQ ID NO: 12402 - protein, 262 aa, Schizosaccharomyces pombe
MSIVNILSVNVLNNPAKFSDPYKFEITFECLEPLKSDLEWKLTYVGSATSQSYDQILDTLLVGPIPIGINKFVFEADPPNIDLLPQLSDVLGVTVILLSCAYEDNEFVRVGYYVNNEMEGLNLQEMDDAEIKKVKVDISKVWRSILAEKPRVTRFNIQWDNPDFDDAPPVQPDADEEEEEEEADEMEEEFDEEGEGDEEEEEEDDGDGDGEGDGDGEGENDGKGSEEEEEEEIDIEEEEEESALANASAAEEKPEEKPETSQ

SEQ ID NO: 12403 - protein, 624 aa, Zea mays
MAASRALLPSPQVSPASARVRLAAAVPSSLTLAARGGAGAGARLRVRCAILSSPAPVAPTESRPARRISPSAPDGALRPKPAVLVAEKLSEAGLAVLRQFADVECAYGMSPAELLAKAAQFDALIVRSGTKVTREVLEAGQGRLRVVGRAGVGIDNVDLQAATEVGCLVVNAPTANTIAAAEHGIALLASMARNVSQADAALKAGKWQRNKYVGVSLVGKTLAVMGFGKVGSEVARRAKGLGMHVIAHDPYAPADRARALGVELVSFDEAIARADFISLHMPLIPTTSKIFNDESFAKMKNGVRIINVARGGVIDEDALVRALDSGKVAQAALDVFTVEPPPKDSKLVLHENVTVTPHLGASTVEAQEGVAIEIAEAVVGALRGELAATAVNAPMVPAEILSELAPYVSLAEKLGRLAVQLVAGESGIKGVKVVYTTARGPDDLDTRLLRAMVTKGLVEPVSSTFVNLVNADYTAKQRGLRLTEERVAHDSPAAEAPLESVQVRLSHVQSKFAGAISDGGDDIVLEGRVKYGVPHLTLVGPYEVDVSLEGNLILCRQIDQPGMIGKVGNILGDTNVNINFMSVGRTFRGKQAIMAIGVDEEPDKDTLEKIGAIPAIEEFVFLEL

SEQ ID NO: 12404 - protein, 534 aa, Ustilago maydis 521
MPGVYGGDEINALVIDAGHSSSRVGWAGEDAPRVVLPSYYGHTSITDDAIAELESQAAFATSSSSTVEPTERAEPVDGDETMADGQALSTSNGNGGAAATQEASDHRLRQARAKSASKTLRFSVDREKKRRRFVGDNELNLYRTNLEIAPIFDDDGMLADASAFAQLCSFGLDSLSCDASEHPLLLTEPAWNSRESREKLTELAFETLGSPAFYLANRSVLSSFAAGKPSSLVIDVGSTNVSTIPIVDGFILRKGIYRHNNGGEAINRALLYSLHHGRGATFAGVTPQYVIKSRSSVDPGTPANVVLRQERVQGASSSFRSYHINRVVNDFKESVAQVLEVPWDDQQAQFRSGRMYEFPDGYNDAFGVERLRAAEVLFTPALWNGVSSSESFGAVLHASSQPSSEAGAVNGGSVSAAGATSVAGGKAAIGLADMVLSSINAVDVDSRPSLYGNIVLVGGSSLIQGLSDRLSYELGVKAPNQKIKIHSPGNTTERRHSSWLGASILASLGTFHQLWISKQEYEEHGAAIVHARCK

SEQ ID NO: 12405 - protein, 705 aa, Arabidopsis thaliana
MTRWSMSMHCTLFLLFLLRLTCIFSDSDYLMGLGSYDITGPAADVNMMGYANMEQVASGVHFRLRARAFIVAEPYKENVAISGTHTHAGPGGYLQYILYLVTSLGFVHQSFNALVDGIEQSIIQAHENLRPGSILINKGELLDAGVNRSPSAYLNNPAHERSKYEYDVDKEMTLVKFVDDQWGPVGSFNCGDNKGTAARIMEDWFERENGCRSVDVESPRRVSSIISDPYGEHQDLMEMASSLLSTGGKTVTRMSSVARRVRSRFRHADKPRFVSAFCQTNCGDVSPNVLGAFCIDTGLPCEFNQSTCGGKNEQCYGRGPGYPDEFESTRIIGERQFKKAADLFTKASEEIQGKVDYRHAYVDFSQLEVTINGQNGGSEVVKTCPAAMGFGFAAGTTDGPGAFDFKQGDDQGNPFWRLVRNLLKNPTEEQVRCQRPKPILLDTGEMKQPYDWAILRIGQLVILCVPGEFTTMAGRRLRDAVKTVLKEGSNGREFSVVIAGLTNSYSQYIATFEEYQVQRYEGASTLYGPHTLSGYIQEFKKLANDLLSAQTTDPGPQPPDLLHKQISLLTPVVADMTPIGTAFGDVTSDVPRLSKFRKGADIVRVQFRSANPRNDLMTEGTFALVERWLEGRETWVPVYDDDDFCLRFKWSRPFKLSTQSTATIEWRIPETASPGVYRITHFGSAKTPISSIHHFSGSSSAFVVY

SEQ ID NO: 12406 - protein, 413 aa, Archaeoglobus fulgidus DSM 4304
MMNMEEYALDIPVEPPRELRSLFIPIPPEYVEDTYRSDDFLVLVGPQHPGSGHMRLIVRVRGDIIQEVIPDPGYVHRSMEKLAENRLYIQNIPLVERPAIMDAPNFNLGYVRAIEEALDIEVPERAKFLRTMLAELGRVGTHLYDAAILAVFLGHTTGFMYPFGLRELICEALVRLTGARFTSSFIIPGGVRRDADDATLKWIYDMTLAMERRLKSFERIFINNPTVIARLQDVGVLSKEEAIKYGVVGPFLRASGVEYDVRKVEPYEAYDDLTWEMPVSDAGDGYARFLVRVNEVGQSLSIIRQCIKEMPEGRVISEQVAENEKDIRGSFFDSLSNIVLPSGEYTTLTEGARGTIIYSIISDGESNVPYRLRIVSPGWLYLRGFMESMKGERLADLQAIYGSFGYFPPEADR

SEQ ID NO: 12407 - protein, 239 aa, Blastopirellula marina DSM 3645
MNSTRAEGIALVEGIAKGLAADCSVEVAVCPPALYLDAIVAAAGDSPIGVGAQNIYFEASGAFTGEISAAMLKDIGCQYVILGHSERRHVFGESSSLINKKVHAALAAGLVPIVCVGELLEERETGKTADVVAEQFYGSLAGVSAEQMESIVLAYEPVWAIGTGKVATPEQAEAVHADLRKVIEARYNSAVAEKVRIQYGGSVKPDNAAELLSQPNIDGALVGGAALKADSFLGIIAGA

SEQ ID NO: 12408 - protein, 344 aa, Triticum aestivum
  misc_feature (275)..(275): Xaa can be any naturally occurring amino acid
  unsure (1)..(344): unsure at all Xaa locations
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPXGKLRVMYEVFPMSFLMEEAGGQSFTGKGRSLDLIPTDIHERSPIFLGSSDDVEEIKALYAEEAKKEGSA

SEQ ID NO: 12409 - protein, 436 aa, Magnetospirillum magneticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTLLQIAGSVGTALLLRHGLGWSLGLAVVLGCAVAVSSTAVVIKVLESSGELETPVGRTTLGILIAQDMAVVPMMLVLESFETKALLPADMARVVLSVLFLVLLFWWLSKRRIDLPVTARLSRDSDLATLSTLAWCFGTAAISGVLDLSPAYGAFLGGVVLGNSAQRDMLLKRAQPIGSVLLMVFFLSIGLLLDFKFIWKNLGTVLTLLAMVTLFKTAFNVTALRLAGQDWPSAFLAGVALAQIGAFPFLLAKTGKAVGRITAQKTKLVVGVTVLSLVLPPFWLFTMRRIHRVAAVHVHSFRDLVTRLYGDEARALVRTARRARMLARRGSWRDDPNAGPGSGIST

SEQ ID NO: 12410 - protein, 345 aa, Medicago truncatula
MQGFPGENEHALSVVGSKPMEWSTVPYNAPRAPGPNGKQRTSSLESPIMLLTGHQSAVYTMKFNPTGSVVASGSHDKEIFLWNVHGDCKNFMVLKGHKNAVLDLHWTSDGTQIISASPDKTLRLWDTETGKQIKKMVEHLSYVNSCCPTRRGPPLVVSGSDDGTAKLWDMRQRGSIQTFPDKYQITAVSFSDASDKIYTGGIDNDVKIWDLRKGEVTMTLQGHQDMITSMQLSPDGSYLLTNGMDCKLCIWDMRPYAPQNRCVKILEGHQHNFEKNLLKCGWSPDGSKVTAGSSDRMVYIWDTTSRRILYKLPGHNGSVNECVFHPNEPIVGSCSSDKQIYLGEI

SEQ ID NO: 12411 - protein, 432 aa, Magnetospirillum magnetotacticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSAAYGAFLGGVVLGNSAQRDMLLKRAQPIGSVLLMVFFLSIGLLLDFKFIWKNLGTVLTLLAMVTVFKTALNVAALRLARQDLASAFLAGVALAQIGEFSFLLAETGKAVKLINAKETNLVVAVTVLSLVLSPFWLFTMRRMHRVAAVHVHSFRELVSRLYGDEARNARRARTLVRRGSWRDDHNAGPGSGIST

SEQ ID NO: 12412 - protein, 389 aa, Rhodopseudomonas palustris CGA009
MKALTWHGKNDIRCENVPDPKIQHGRDAIIKVTACAICGSDLHLMDGVMPSMQSGDVLGHETMGEVVEVGSENTKLKVGDRVVVPFTISCGECFFCQRGFYSGCERSNPNAKMAEKMWGHSPAGLFGYSHMLGGYAGGQAEYLRIPYADVGPIKVPDGLTDEQVLFLSDIFPTGFMAADFCNLKGGETVAVWGCGPVGQMAIKSAFLLGAERVIAIDTVPERMELARQSGAIVINFMDDDVYDKIQDLTNGRGADACIDAVGTEAAATASLDSMIDRVKVATFMGTDRPHVLRQAIHCCRNFGTVSIVGVYGGLLDKIPMGSAINRGLTMRMAQTPVQQYLPQLLGRIQQGEIDPSFVITHRATLDEGPELYKTFRDKKDGCIKVVMRP

SEQ ID NO: 12413 - protein, 480 aa, Salinibacter ruber DSM 13855
MTTPDWAKHAVFYQIFPDRFARSGAVEAQEAVQLTPWGTPPAEQGFQGGDLYGIVDRLDYLDALGVTALYLNPIFASAANHRYHTYDYYEVDPLLGGTDALRALLDAAHARDMRVVLDGVFNHASRGFWPFHHVLENGPDSPYVDWFKIEDWPLRPYASDQPHNYAAWYDIPALPELNTDHPPVQDFLLDVARHWIAFGIDGWRLDVPREIETDGFWEAFRTVVKDANPEAYLVGEIWDEAPAWLQGDRFDGLMNYPLLDATLGFFGAGSLRDYSKAHLTFDPIDAPAFADELDRLLALYEWEATCAQLNLLDSHDMARAQWILNNNPAAFRQAVLFLMTMPGAPCIYYGDEIGLSAAGDPHCREAFPRDDADWDTDLLSFYQAATALRHRHEVLRTGRIEVLHASGRTLVLRRTLADATALVAFNAGADAVQVALEAAALPTKPLSSAWPPSANAPLSASSSPLPLSLPPRATRVWTTD

SEQ ID NO: 12414 - protein, 852 aa, Arabidopsis thaliana
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPVWDLDSFTKTFVERLNSLVPEIVALKTIAAYRSGLDIDTYVSKEVAENGLVEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVYLDFGLAVPKLSVHGMVSSVKELLDLASIKKVMFSTDGYASPETYYLGAKKAREVIFLVLTYACACGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 12415 - protein, 459 aa, Haloarcula marismortui ATCC 43049
MSTATIRNVLRGDGDRFVYIVSALAALNGLLFGFDTGIISGAFLFIQDSFVMSPLVEGIIVSGAMAGAAAGAAVGGQLADRLGRRRLILIAAIVFFVGSFTMAVAPTVPVLVAGRLIDGVAIGFASIVGPLYISEIAPPEIRGGLTSLNQLMVTTGILLSYFVNYAFADAGAWRWMLGAGMVPAVVLAIGILKMPESPRWLFEHGRTDEARAVLKRTRSGGVEQELDEIQETVETQSETGIWDLLAPWLRPALVVGLGLAVFQQITGINAVIYYAPTILESTGLGNVASILATVGIGTINVVMTVVAIMLVDRVGRRRLLLVGVGGMVATLAVLGTVFYLPGLEGGLGIIATISLMLFVSFFAIGLGPVFWLLISEIYPLSVRGSAMGLVTVANWGANLLVSLTFPVLTDGVGTSATFWLFGLCSLAGLVFVYRYVPETKGRTLEAIEDDLRQNISLAD

SEQ ID NO: 12416 - protein, 106 aa, Arabidopsis arenosa
MFEIIQAVFAAGAALALLTFSAITLGGSVVAFVISTPLFVVFSPVLVPATIATTLLASGFTASGSFGATAFSILAWIYKKRTGRDLPKIPGLTPPAPASSPAGSGV

SEQ ID NO: 12417 - protein, 310 aa, Frankia sp. CcI3
MPPSKEPAPAGPSPEQPASGKLPSGKPSPASPRARPAGEGRFSSVGTREPLDAARLAARAAAVGLDLTVVEETDSTNAALARIARGEDTARGEDTARGRGRVLVAERQTAGRGRLDRSWESRPGAGLTVSLLLQPRLPMSLFGWLPMVVGTSLLATLREVAAVPAVLKWPNDVLVDDAKLAGILVEVVQVPLSSPSVIIGFGLNVMAERDELPERSTSLLLSGALPAALDRTELLGVVLADLVGAITGWEADPQAARAEYLRVCATIGRRVRVELPDGSAVLGTATDVDPDGRLVVNGRPYSAADIVHLR

SEQ ID NO: 12418 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 12419 - protein, 131 aa, Clostridium difficile
EVKYKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 12420 - protein, 124 aa, Zea mays
TPSVPGRSLYLNLIIVLALFASITMAESTGEASSEAKVHIIYTEKPTDEEPKDYHLRTLSSALGSEKAAKDALIYSYKEAASGFSAKLTPEQVTEISKQPGVIQVVPSQTYHLHKPVGAGFKLT

SEQ ID NO: 12421 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 12422 - protein, 1037 aa, Flaveria pringlei
MDRARRLANKAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMVTDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFAAGLKKLGTVQVQDLPFFDTVKVTCVDSKAIAEEAYKHKMNLRIVDKNTITVAFDETITIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVATGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDLNNNVIKGAPHPPQLLMADKWTKPYSREYAAYPAPWLRAAKFWPTTCRVDNVYGDRNLICTLQPPQEYEEKAEATA

SEQ ID NO: 12423 - protein, 384 aa, Flavobacteria bacterium BBFL7
MTASTAIKKNTSFQLDSIEDAIEDIKNGKVIIVVDDENRENEGDFLASAQSVTPEMINFMATHGRGLICMPITESRCQELELDMMVTNNSDPMETAFTVSVDLRGHGVTTGISASDRAKTIQAMIHKDTRGHDLSKPGHIFPLRARDGGVLRRTGHTEAAIDFARLAGHEPAGVIVEIMNEDGTMARLPQLIEVAKKFDVKLVSIEDLVAYRMKNDSLILKKEDFNLRTRFGEYRLRAYQQTTNQQIHLALTLGDWDEEEEILTRMNSTQVNNDLFSTLTSEADRKLDAMFERLNKEGKGAIVFINQQFQPENMLSRLEQLKELQENGEVKAPRKNLDNRDYGIGAQILHDLKISKLKLLTNSEQSKRIGMIGYGLEITETISY

SEQ ID NO: 12424 - protein, 339 aa, Salmonella typhimurium LT2
MKSIVIEKPNTLTIETRALPQPAPGEVRIKVKLAGICGSDSHIYRGHNPFAKYPRVIGHEFFGVIDAVGDNVNHDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWTLNNGQHSLAEFLQQKALKPTLIVDAACHPAILQEAITLASPAARIVLMGFSSDPCEIVQQGITGKELAIYSSRLNANKFPVVIDWLNKGLIDPDKLITHTFDYQHVTDAIELFEKDQRQCCKVLLTFAK

SEQ ID NO: 12425 - protein, 434 aa, Fusobacterium nucleatum subsp. vincentii ATCC 49256
MVFKNSIDLYKKAVELVPGGVNSPVRAFKSVNREAPIFVKKGQGAKIWDEDNNEYIDYICSWGPLILGHNHPKVIEEVKKIIENGSSYGLPTKYEVDLAELIVEIVPSVEKVRLTTSGTEATMSAVRLARAYTQRNKILKFEGCYHGHSDALLVKSGSGLLTEGYQDSNGITDGVLKDTLTLPFGDIEKVKEVLKSKDVACVIVEPIPANMGVIETHKRFLQELRKITEETGTILIFDEVISGFRLALGGAQEFFGITPDLTTLGKIIGGGYPVGAFGGKKEIMDLVAPVGRVYHAGTLSGNPIASKAGFATISYLKKNPNIYKELEEKTNYLIDNIEILAKKYSINVCVNSMGSLFTIFFIDIDKVENLKDSLKSNTKNFSIYFNTMLENGIVVPPSQFEAHFLSMAHTKKELNRTLEVIEMAFKKIGEKSGK

SEQ ID NO: 12426 - protein, 592 aa, Oryza sativa
  misc_feature (545)..(545): Xaa can be any naturally occurring amino acid
  misc_feature (548)..(548): Xaa can be any naturally occurring amino acid
  unsure (1)..(592): unsure at all Xaa locations
MGEGINGDAGDLAAAPYDQWLPFSPAGGSPRPSARYKGTHVKNKRMRVVDAVVSILRERTLRTNECENVTNRVPNPVALEMPSLRIVGQCRGIGIRTEMADRSSLERILVSDTRHAAEVVREKLYVVGGSRNGRYLSDIQVFDFRTLKWSALSAARDSSQLNIENNTTDPSFPALAGHSLVNWKKYIVVVAGNTRTSTSNKVSVWLINVETNSWSSVDTYGKVPISRGGQSVSLVGSRLIMFGGEDNKRRLLNDLHILDLETMMWEEVKTGKGGPAPRYDHSAAVYADQYLLIFGGSSHSTCFSDIYLLDLQTMEWSQPDTQGAHINPRSGHAGTMIDENWYIVGGGDNASGSTDTIMMNASKFVWSVVTSVPARDPLACEGLTLCSTTVDGEKFLVAFGGYNGQYNNEIFVMKLKPRNLVQPRLLQSPAAAAAAASVTAAYAVITDEKTRDIVATDDLDVKRVQPSGSSKQITTELDALNGEKGKLESRLAEVRDENSKVKDRLDIESYRMELKSVQHQLAAEGSRCQKLESQIAAAHKRLESXTDXLENELEVLRQQISLVEQTMTTAQRQKSGGVWKWVAGSAEISDDE

SEQ ID NO: 12427 - protein, 254 aa, Candidatus Kuenenia stuttgartiensis
MMEVIFLGTGTSHGVPMIACNCKVCTSDNPKNKRMRTSVLVCENGCDILIDATPEMRLQCIKNNVTRLDAVLITHIHADHIFGLDDLRRFNIVQRKDIPIYGTPDTLEGIKRIFAYAFDIRAKNDGYVPRFSLNAIDGNVKIGGFSIVPIDAIHGNGLVTGYRFERFAYITDVSEIPDHSLAKLMNLDVLVLGALRYTPHAKHFNIDQALDIVSKVRPQKTYFTHICHDIEHESTNSRLPENVELAYDGLRIKL

SEQ ID NO: 12428 - protein, 436 aa, Neurospora crassa
MADYIGGNIEADHLCVLVHGLWGNPNHMASVAKALRAQYPRDKLNILVAKRNAGSFTYDGIELGGERVCNEIEEELQAVESKGGKIKKISIAGYSLGGLVARYAIGLLYARGVLDNLECMTFTAFASPFLGVRTPLRGWPNHVWNVLGARTLCMSGRQLFGIDHFRDTGKPLLAVLADPKSIFMCGLAKFKRRILYTNIVNDRSAVYYTTGIAKTDPYTDLDKVKVNYVKGYEPVILDPTNPVSPAPPKPKEPLVANLKKWINRVPFILAVAVFVPLGLVAFFINSAVQTVRSSKRVKLHEKGLAGIDVESYRVDLWIKEMREAVEHAYEDLNSSQNQEYLGLSDGDLDEETDDSSNQEILALERKQSHPHQPTLALAPYQFAAINALDALGWRKYPVWIHNDRHSHAAIIVRMEKPTFEEGKVVLSHWVNEEFLI

SEQ ID NO: 12429 - protein, 249 aa, Leifsonia xyli subsp. xyli str. CTCB07
MSASHALILLRHGNSEWNRQNLFTGWVDVRLSEQGVAEAKRAGELLAESGLVPDILYTSLLTRAIQTANHALDAADRLWIPVVRSWRLNERHYGALQGLDKAETLEKYGPEQFQLWRRSFDVPPPPLADDSEWSQADDPRYADLGADLPRTECLKDVIARMLPFWESDITTSLSAGKTVLVTAHGNSLRALVKHLDGISDDDIAELNIPTGVPLVYKLDDSFKPVEPAAYLDPEAAAVGAAAVAAQGKK

SEQ ID NO: 12430 - protein, 534 aa, Cryptococcus neoformans var. neoformans JEC21
MPDPAPFWLCHECGAQMRPVTIDGTPHCASCNGEFIEILDPEVNPDPDYELPPPPPTRPGQQTPSRFDPHFLSNFPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTPNVGTEHTRNAEEERPATPTIPAAVSNFFRNLFGGSESQPSTPRAAAGGGHGSNASQDPHSSVNVVSESTISADASSRHSPTIHGATRREQVQPCDEVASEGSSNDSLVRVYPEHSSGETHGDGATDGEAGRIAEQEQQVASRDRLADRVNRDFNERWQRLRREREEDDTVYHPDLD

SEQ ID NO: 12431 - protein, 541 aa, Streptococcus agalactiae A909
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWTPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 12432 - protein, 339 aa, Polaromonas sp. JS666
MTQGELQATMHALVQKGKGILAADESGPTIAKRFKTINVESTEENRRAWRSLLLTTPGLGEFVSGVILHEETLGQATDDGTPLPQCAARQGIVAGIKVDAGKIPLAGAPGDEITQGLDGLAGRLAAYQRQGARFAKWRAVYNVSDTLPSRLALEANAEALARYAAICQEQGIVPIVEPEVLIDGDHTMARCAEVTEAALHEVFHALHRHRVVLEHMLLKPSMVVPGKTHAHQAAPAEVAVQTVRILRRTVPAAVPSINFLSGGQTPEEATANLDAMNLLGPQPWQLSFSYGRALQEPALQAWKGQAAHARSSQDALLKRARLNGAACRGRYSAAMEAAD

SEQ ID NO: 12433 - protein, 790 aa, Oryza sativa
MDDLPDDQGQSDAHPSDPNWWSSHAEHKLGSISLTKQERNSGSPGSSHCGEGDHSLWAAQTLWCTGYLSSPIPNGFYSIIPDKKLKERFDTIPSPDDLYSLGIEGFKAEIILVDLEKDKKLSAIKQLCAALVKGLKSNPAAMIKKIAGLVSDFYKRPNPQLSPARTSSEEISHFMENRGVQLLGQIRHGSCRPRAILFKVLADAVGMDCKLLVGIPNEEYHEYDDSSKHMSVVVMLKSVEFLVDLMRFPGQLVPFSSKAIITSHISAAGESDSADYDSCDSPLEPNSPLCSQRQEQDDNNRSFKVPSLRNIMLKSTNSMEGKLRCSSHSEPNVANSFCGRSRRKVVEEHQRTASSSPEHPLSRTRGRSMLGDRQHGDGVAVSRSDGASTSNMRRGRRRSISFTPEIGDDIVSAVRAMSERMRENRLSRGQNDGSPGQLNDSQKNESPHDFNDNELHVRGPDEQEGSRRQVSNQKAVSLPSSPHRLRSDGSGLRGPAEFLTADLMSTWNKVLRSSPFLNKPLLPFEEWHIEFSEITVGTRVGIGFFGEVFRGIWNGTDVAIKLFLEQDLTTENMEDFCNEISILSRLRHPNVILFLGACMKPPHLSLVTEYMEMGSLYYLIHASGQKGKLSWRRRLKMLRDICRGLMCMHRLKIVHRDLKSANCLVNKHWAVKLCDFGLSRVMSNSAMNDNSSAGTPEWMAPELIRNEPFTEKCDIFSLGVIMWELCTLSRPWEGIPSVQVVYNVANEGARLEIPDGPLGSLIADCWAEPDKRPGCQEILTRLLDCEYTLC

SEQ ID NO: 12434 - protein, 268 aa, Triticum aestivum
  misc_feature (231)..(231): Xaa can be any naturally occurring amino acid
  misc_feature (239)..(239): Xaa can be any naturally occurring amino acid
  unsure (1)..(268): unsure at all Xaa locations
LPRTSLYKKAGWYRSGIPGISSTHASADAWAHCSPCGTCPASSLFVPANSSSYAPLPCSSSMCPILQGQPCPDRDPFDSAAPLPSCAFSKPFADASFQAALASDWLHLGKDSIPNYAFGCVGSVSGPTSNLPKQGLLGLGRGPMALLSQVGNMYNGVFSYCLPSYKSYYFSGSLRLGAAGQPRAARYTPMLRNPHRSSLYYVNVTGLNVGRSPGERAGGGRSAFDPRTGAXGTVGDSGXLIPRWDGAPVTRRLRERIPGRNVAAPQTV

SEQ ID NO: 12435 - protein, 696 aa, Oryza sativa (japonica cultivar-group)
MCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGGKRRNGAGKVLAIVMPIVAAILAVTVIGFCFWRRRRPEKTPPPGPLRSASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 12436 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFEANTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTIFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYELTLIEVVE

SEQ ID NO: 12437 - protein, 265 aa, Paracoccidioides brasiliensis
MGYEDAVYLAKLAEQAERYEEMVENMKIVASADKELSVEERNLLSVAYKNVIGARRASWRIVTSIEQKEESKGNEAQVALIKEYRQNIETELAKICEDILDVLDKHLIASAETGESKVFYHKMKGDYHRYLAEFALGDKRKDSADKSLEAYKNATEVAQTDLAPTHPIRLGLALNFSVFYYEILNSPDQACHLAKQAFDDAIAELDTLSEESYKDSTLIMQLLRDNLTLWTSSEAEPAPEVAPAPSEQKDEAPAATSEDAPKAAE

SEQ ID NO: 12438 - protein, 359 aa, Dehalococcoides sp. CBDB1
MARTVIPFGPQHPVFPEPVQLKLECEDETVVGVTPVIGYVHRGVEKACELNTLRQNIFLVERICGICSIQHALCYCQGIEELANIEIPQRAQYLRTAWAELSRLHSHSLWLGLLADALGFESLFMQIWRAREIILDILEITAGHRVITSACVVGGVRRDIDAEMLKKTEAMLGDFRKMMDKTILPTLLNDPTLKKRTVGKGILSYDQAVTLGACGPTMRGSGVPSDVRSTGYAAFKELGFEPVVETAGDSYARTLVRTRELYQSIDLTLAALHQMPAGEIMVKADAYPEGEIFTRVEQPRGELTYYIKANGTNHLDRCKIRTPTFANIPTLLVMLPGCELADVPVITLSIDPCISCTER

SEQ ID NO: 12439 - protein, 415 aa, Bradyrhizobium sp. BTAi1
MPLSLPKQKIRVLLLEGVNDSAVRMFEANGYTEIERLPKALGSAELKRMLSGVHMLGIRSRTHLTEDVLQAADRLMVVGCFSVGTNQVDLDAAKRLGIPVFNAPYSNTRSVAELTIAEVVMLMRRIFPRSVAAHAGGWDKSANGSREVRGKTLGIVGYGNIGSQLSNLAEAMGMRVIFFDLTDKLRHGNTEPVESLDELLAMSDVVSLHVPETPATANMIGERQIRHMKDGAYLINNSRGTVVDIEALASALRDGKLAGAAVDVFPVEPASNADPFVSPLQGLPNVILTPHVGGSTEEAQDRIGGEVARKLIDYSDVGSTFGAVNFPQVQLPARPTGTRFIHVHRNVPGVLRQVNEAVSRHNINILAQYLQTDPEVGYVVLETDVVGGEGEELLSELRAVEGTIRVRVLYDHDRP

SEQ ID NO: 12440 - protein, 427 aa, Pseudomonas aeruginosa PAO1
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 12441 - protein, 574 aa, Prochlorococcus marinus str. MIT 9312
MKETSPKSNNGTILDINESFKIEFDPISDALAAIRNGECIIVVDDERRENEGDLICAAQFATPQQINFMATEGRGLICLAMQGEKLDSLDLPLMVDRNTDKNQTAFTISIDAGPENNVSTGISAEDRAKTIQVAINPNTKPDDLRRPGHIFPLRAKKGGVLKRAGHTEAAVDIAAMSGLYPAGVICEIQNPDGSMSRLPQLKEYAKQWGMKLISIADLISYRFQTERFVFRKSDAVLPSIFGNFKAYGYINELDGSEHVALVKQKSKKLSEPVLVRMHSECLTGDAFGSLRCDCRPQLEAALSRIEKEEEGVVVYLRQEGRGIGLINKLKAYSLQDGGLDTVEANEKLGFPADLRNYGVGAQILTDLGIKKLKLLTNNPRKIAGLGGYGIEVIERVPLMICPNDNNAEYLSVKRTKLGHMIDVDNSNFRNIDPFISIFLDGNYKSIHLVPIKNKVNKFCKDQNINIKLESTPRLLAFWNRPKLVWRIIHDRNRTNTNITDEEIKNIELLIEFLSKYEDSKKIGIIVSRNIEQALHPKNSIKLINTKFTINNEILYSSTRKFNLDKETFSIVFEG

SEQ ID NO: 12442 - protein, 422 aa, Arabidopsis thaliana
MAFSSLLRSAASYTVAAPRPDFFSSPASDHSKVLSSLGFSRNLKPSRFSSGISSSLQNGNARSVQPIKATATEVPSAVRRSSSSGKTKVGINGFGRIGRLVLRIATSRDDIEVVAVNDPFIDAKYMAYMLKYDSTHGNFKGSINVIDDSTLEINGKKVNVVSKRDPSEIPWADLGADYVVESSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 12443 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCRVQVEKALENVLK

SEQ ID NO: 12444 - protein, 330 aa, Shewanella sp. MR-4
MQTLAQHLTSKAVNESLSQLILTLADTSKAISHAVRHGALAGVLGATEQENVQGETQKKLDIITNDMLKDALKVDGTVRGLASEEEDHVVEVSANGKYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 12445 - protein, 528 aa, Oceanobacillus iheyensis HTE831
MTFHVLISDPLSEEGLKPLQEAENIEVVINPGWNEQELSDQIDSFDAILVRSQTQVTRALIEKASNLKIIGRAGVGVDNIDLEAATENGVIVVNAPNGNTNSAAEHTMAMIMALSRNIPQAYHALKQKQWDRKRFVGVELKQKTLGIVGLGRIGAEVAARAKGQRMNVIAYDPFFTEEKAEQMGVQYGTLEDVLRAGDFITVHTPLLKETKHLINKDAFDLMKDGVQIVNCARGGIIDEDALYDAIQSGKVAGAALDVFEQEPFTEHKLLTLPEVVATPHLGASTVEAQEVVAIDVSHDVLRFSQGEAVRNPVNMPSVPSEIMYKIEPYFHLAEKLGTFITDLTKEVVSEVKITYAGDLADIEIAPLTRNAVKGLLKRYLGSRINDVNALFLADRKGIEVSESKTSSKKGFTNLITIEVSGKFGTRKVAGTLLNGLGPRLVRVDEYRVDITPEGHMVVIQHRDQPGVIGRMGSTIAKHDINIATMQVDRSDIGGDAIMILTIDRHLADEALNEIESLDEIKSVTAIDL

SEQ ID NO: 12446 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLE

SEQ ID NO: 12447 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 12448 - protein, 603 aa, Oryza sativa (japonica cultivar-group)
MVKKSKKSKSKRVTLRQKHKVLRKVKEHHRKKRKEAKKEGKSHRKKVEKDPGIPNEWPFKEQELKALEARRAQALQELELKKEARKERARKRKLGLLEDEDIANLASAASAQGSEFAEKDAAKENASLDVVKSQVTLFLNLLVVSPDHSERAFYKELVKVIEASDVILEVLDARDPLGTRCIDMEKMVRKADPSKRIVLLLNKIDLVPKESVEKWLTYLREEMPTVAFKCNTQEQRTKLGWKSSKIDKSSNIPQSSDCLGAENLIKLLKNYSRSHELKLAITVGIVGLPNVGKSSLINSLKRSRVVNVGSTPGVTRSMQEVQLDKKVKLLDCPGVVMLKSSNSGVSVALRNCKRVEKMEDPISPVKEILDLCPHEKLLSLYRVPTFTSVDDFLQKVATLRGKLKKGGIVDVEAAARIVLHDWNEGKIPYFTVPPKRDAVDDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRKRKAEKKRRKANKFSVLTDMDADYDFKVDYQMKDALAEEGNDGGDEEPKEADPMTGVDDA

SEQ ID NO: 12449 - protein, 227 aa, Thermus thermophilus HB8
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERVAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 12450 - protein, 375 aa, Yarrowia lipolytica CLIB122
MSYYSRRNRDAQAAPPAAASKKVPIEKSQQLLKSLLRESDNKVCADCKTATHPRWASWNLGCFICIRCSGIHRGMGTHISRVKSVDLDAWTEEQLASMMKWGNTRCNMFWEAKLPKGHVPDDNKIENFIRTKYDMKKWAASTTVPDPDTLGGASHAAAPVQAPPKDTKIAGPPQVTKKAPATQQSSLIGLDFDEPQQHQHKPAQLQQPQQTQKNDDFLSFAQSPPQTQQQSPQQHQQSPPQQQFQAQQPFPSASAPDSSRPDLKKSILSLYANSRQAPVVQQQQQQQQFQQQQFQAQQQFQQQQPQFQQQQGGDFGGFGNMQQQTNSGFGNMQQANSGFGGFGGAPQQQNNAHNDWADAAAPKKQEDDVFANVWK

SEQ ID NO: 12451 - protein, 229 aa, Oryza sativa
MAAAARATARVGLALLLAVVGVGAQDYDFFFLVLQWPGSYCDTKQSCCYPRSGKPAADFGIHGLWPNRDDGSYPQNCDPDSEFDPSKVSDLLGSMRSEWPTLACPSNDGIRFWAHEWEKHGTCAAAALGDEHGYFEAALRLRSRLPVLAALRDGGVSPDGGYYTLSQIKGAIQRGVGAEPFVECNRDESGNSQLYQLYFCVDAAGERFVDCPASPGGRPCGNRIEFPAF

SEQ ID NO: 12452 - protein, 218 aa, Vibrio vulnificus YJ016
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 12453 - protein, 375 aa, Rhizobium etli
MQMRSVILRESGLPKPYSNSKPLKIELVELTPPGPMEVLVKIKAAGVCHSDLSAINGDRPRPLPVALGHEASGVVAAIGPSVEKVEVGDHVVMSFLPVCGHCSYCAEGRASLCEPGYQANAAGTLLSGGKHIRLRGYEINHHSGVSAFSEYAVVSASSVVKVTKDIDLATAALFGCAVMTGVGAVMNTCGVRPGRSVAVIGLGGVGLSAILGAVASGASDIVAIDLIQAKLDLAKELGATKTFLATSPNIVAQVKGATSGGVDYAIEMAGSKKAFELAYEITRRGGMTATAGLASANSRFEVSPLPLVGEERTIKGSYMGSCVPSRDIPRYIDLYLKGKLPVDKLLSSTGPLDEINEVFDRLDRAEINRHLVLMD

SEQ ID NO: 12454 - protein, 155 aa, Brassica napus
MMYVRALPTTDVNRNTEWFTYPGVWTTTHATVFFSWLLVLSIFNCSPGMAWTIVHLAHFAVTYHLFHWKKGTPFGDDQGIYNRLTWWEQIDNGKQLTRNRKFLTLVPVVLYLIASHTTDYQNPMLFLNTLAVFIMVVAKFPHMHKVRIFGINADQ

SEQ ID NO: 12455 - protein, 873 aa, Ashbya gossypii ATCC 10895
MGNVKSSLQDCIELDESMLSIRTDSPAGYNPKFVFIRRTLYLLVDEELTRSGKFIISLRELESEGLLDYKFVNGTGQNAPIVIKQIKNSSKYVLNFHPSMKEGVHKFTIRFDKKRICRVYIYCERAKEDAGDAAPTVPAPSTAPAGSPTPAPAPNTRNPAGMTAVSAVVSAAAPATAPATVHTTPPSPPPPPPGLHDPVPNFIQDGPQFRTQLANWESILFLFRSHLKSLYERSTKLKELLQMTSKEFNLLSNDFNELHCILKDQPVSSVFRHLLLSSSSVCVSQARLMMKKATASQEDLASAIQQYLNTIDLKAVSSSKKQYHDQAKDFYSYVGKNLSQKSDSKLLPRRIQFELQRFDYFHSLLQYVVGCNARDFAVSLARFQSSIDPNNKNTNMHLVKKYRSHFLPFNKIKSQQRIRLSKVSNYSDLNDFYQLASATSEPNKPLKEGLLWSYRNNGWHKQWVVLQGSQLSEYSDWKTKAKVLSRPAINLTFVCVKRSEKKPNGFDIITTDGEARSFQAESEDEMKQWLYALHSAVGIIAIEETDENKDPLSIVRNADPSNSACCDCRSDKQVEWISLNILCVVCINCSGVHRSLGAHVSKMRSLTLDSFSSPESLQLLKCVSNQNVNSLYESEDLPPIFPENSIDQRKSYITDKYVSKKYVNRTEDISKLHISLIKAIHLESIYLLQKCFAEGVSLCEDYWLQNDGNDSLFQYSLKHWEGTKENPVFTVTEFLVLNGLHVDDLPTSHEHRALWSPGQLSYWSSKYKNHNCLHNRVGAKKLPEVPTSAAISLHTRNPRHTTDFTDSICSPDIPSSAEGSSKNDGQSAPGPATTRSRRWSVGMGQHMAGTTSHHFTSPILGKSRHLKFPKIQK

SEQ ID NO: 12456 - protein, 430 aa, Desulfitobacterium hafniense DCB-2
MGFQDQRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTARLAEGLQSIAQELGFPIWVNSVGAMFSAFFTDQPVIDFKSACSSDVERFGSFFRGMLERGIYLAPSQYEAVFLSAAHTDADIDYTLEQARDVLKSLG

SEQ ID NO: 12457 - protein, 219 aa, Erythrobacter sp. NAP1
MKGPTSDEQRLVLFENQWLEKLTVISVRWFVATWAIVLPLILLAGWGTASPLAAIALTASGWFVWSLFEYFAHRKLFHWEPKALWLQQMVFVIHGNHHAQPRDELRNLMPPIVSIPVGALIWSLLWLAAGDAGTWIALGFVGGYVAYDLTHYACHHWSMNGPLGKRLKRHHMQHHFIAAHKNYGVTTIFWDRFFGTRAEGNQKARRENVVDEEALEPAE

SEQ ID NO: 12458 - protein, 369 aa, Arabidopsis thaliana
MSYSGAGLGKPGSGKRRIRDLLTQSDNRVCADCGAPDPKWALIECYDLVSLLVHFLVCFVFRKPIKLLVAYYRSANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 12459 - protein, 179 aa, Triticum aestivum
  misc_feature (100)..(100): Xaa can be any naturally occurring amino acid
  misc_feature (106)..(106): Xaa can be any naturally occurring amino acid
  misc_feature (132)..(132): Xaa can be any naturally occurring amino acid
  misc_feature (144)..(144): Xaa can be any naturally occurring amino acid
  misc_feature (170)..(171): Xaa can be any naturally occurring amino acid
  misc_feature (175)..(175): Xaa can be any naturally occurring amino acid
  unsure (1)..(179): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFRXSTNASXPGYYDGRYWTMWKLPMFGVQPDATQXVINEVEEVKEGXPDAYVRIIGFDNMRQVQWVSFNCLKXXGCEXSGKG

SEQ ID NO: 12460 - protein, 587 aa, Coccidioides immitis RS
MGTGKKEAARRERQGKTGDGMANVRVKGENFYRNAKKVKTLNMYKEGRAQRDAFGNVTKAASYQSREVPNARIEPNRKWFGNTRVISQEALNSFREAVAERASDPYQVLLKTNKLPMSLIRDGQAPNGLKQHEAKVAVEAAPFSDTFGPKAQRKRVKLSVGTLEELAGETEKMHDTYLERLEQAKLLSGTSGETGDNTEQDGELTAAREPVFSKGQSKRIWNELYKVIDSSDVVIHVLDARDPEGTRCRSIEKYIREEAPHKHLIFVLNKCDLVPTGVAASWVRALSKDYPTLAFHASINNSFGKGSLIQLLRQFSSLHSDRKQISVGFIGYPNTGKSSIINTLRKKKVCTVAPIPGETKVWQYITLMKRIYLIDCPGVVPPSNTDTEEDILLRGVVRVENVQNPEQYIPGVLKRTQRKHIERTYEIKNYTDAIDFLSILARKGGRLLKGGEPDLDGVAKMVINDFLRGKIPWFTPPPHTPGEENERIEGRDGRLGEISRKRKAENLGSHDDNIAEELSSENPEDEDDSFNGFDDMELVWLSPARQLFTHASQEPASSESNSRRTPKGGLQVTHGLHWLLCVDSCLD

SEQ ID NO: 12461 - protein, 440 aa, Bordetella parapertussis
MGLLEGICRYRGAILKREVYRARAARRRAGRDRAKGAKIAAFQPGRARFMSAQISSLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLLDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCAPPNLRND

SEQ ID NO: 12462 - protein, 398 aa, Oryza sativa
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNHGCLVVNAPTANTVAAAEHGIALLTAMSRNIAQADASLKAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 12463 - protein, 403 aa, Photorhabdus luminescens subsp. laumondii TTO1
MKKSQGYVYIATIFDTKRTEIFYVRDLIKKAGLAVRTVDLTTQSDSPQRGADITAQTVAEHHPQGKEAVFCGDQGQAISAMSVAFNLFLSKQPDVLAILGLGGSCGTALITPAMQSLPVGIPKLMVSTMASGDVSGYVGVSDISMLYSVTDVSGLNRISRQVLKNAANQIAGAVYFHEENTIEDKPAIGLTMFGVTTPCIQLLTRELEQQYDCLVFHATGSGGKTMEKLAESRLLYSLLDITTTEVCDYLFGGVLACDADRLGAIARTQIPYIGSCGALDMVNFGHLNSIPERYKYRQFYRHNSQVTLMRTIPEENRQMGIWIAEKLNQCEGKVKFIIPEGGFSALDIKDGPFWNPDANQSFINAFEATLIETENRQLIKSPHHINSPDFCQQVIKEYRQMMA

SEQ ID NO: 12464 - protein, 618 aa, Arabidopsis thaliana
MIPHQEVNEEEASLFDFLWLLLASVIFVPLFQKIPGGSPVLGYLAAGILIGPYGLSIIRNVHGTRAIAEFGVVLLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPYVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 12465 - protein, 211 aa, Triticum aestivum
  misc_feature (209)..(209): Xaa can be any naturally occurring amino acid
  unsure (1)..(211): unsure at all Xaa locations
MEPDPSQSPTGGSSSLIFLGTGCSGALPDARCLLKPSTPPCAVCSMGISQPPEGNPNYRLNTSLLIDYCHDDGTHKYILIDIGKTFREQVLRWFVHHKVPYVDSIILTHEHADAVLGLDEVWVVQPRNDRNDVEQIPIFLTQFTMDSITRRFPYLVEQKPEDGDEDAQAAKIEWKIVQDDVEKPFVASALEFVPLPVMHGEGIFVRLLXGR

SEQ ID NO: 12466 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 12467 - protein, 385 aa, Nocardioides sp. JS614
MLAHRLEGIPPTIFTEMSALAVRTRSVNLGQGFPDVDGPPAVIARAVAALEGGHNQYAPGPGVPALRQAIARHQLRHYGVELDPDAQVVVTTGCTEGIAAALLGLVDPGDEVVVLEPYYDSYTAMIQMAGGVRRPVTLRAPGFRLDPDELRAAVTPRTRFVLLNSPHNPTGTVLTRAELQAVADVAIEHDLVVVTDEVYEHLVYDDHEHVPLATLPGMFERTLTLSSAGKSYSFTGWKVGWATGPAELVGAVLAAKQWLTFTSGSPLQPAVAYALDEEPGFPTELAAELRAKRDLLCDGLARVGLDVRVPEGTYFASTDISALGWPDARSFCLALPERAGVVAIPTQAFYDSDAGRHLVRWAFCKDSEVIEEGLRRLAAADLTAS

SEQ ID NO: 12468 - protein, 373 aa, Burkholderia sp. 383
MRALQWHGPRDVRLVEIDTPRVGPGDVRIAVAYCGICGSDLHEYADGPHAIPVDTPHPLSRRTAPLTLGHEFCGTVVEVGEGVTALRAGDRVAVEPEYRCSQCAYCRSGSYNLCVSMGFAGLMGDGGMADFAVVPAYMLHRLPDGVSLEQAAVMEPAAVALHALRRGELRLGETCAVFGLGPIGLLLIMLAKLQGATTIVAVDVSPERLAAATRFGATHTFDARALGASALQDAIRAATGGLGVDASFEAAGLQTTFESAMHALRKGGRIVMVGLMPHAGFDAFRAVNDELTFTASVGYRHAYEDLLRIVASGALDLTSIVTRTVSLEDAVADGFDALLADRAQIKILVSPAQRPPRRAHTIGSIEHESSVGV

SEQ ID NO: 12469 - protein, 261 aa, Wigglesworthia glossinidia endosymbiont of Glossina brevipalpis
MHKPIKKLGQNFLKDKKIIKKIINFINPKYKDKIIEIGPGLGALTIPISKISKSITAIEIDKNLVYFLNKNKNIKNNLNIINIDIMKLNLKKFFSSFCDPVRIFGSLPYNISVSLMFNFIENYNKIIDMHFVIQKEVAQRILARPNNKHYGYISVIMQYYFYVEKLIDISNCAFKPIPKVQSSLIRMRPHKVCPFPFCDIDKMKVLLKSAFNQRRKMLKNSLKKYFSVEQIILYKINPKLRAENLSIENYCNLSNNMIIKK

SEQ ID NO: 12470 - protein, 103 aa, Capsella rubella
MFEIVQAVFAAAAALALMTFAGITLGGSVVALVVSTPLFVIFSPVLVPATIATTLLASGFTASGSFGATALTILAWLYKKRTGKDLPKIPGLTPPSSPASSGK

SEQ ID NO: 12471 - protein, 309 aa, Haloarcula marismortui ATCC 43049
MAKRPAERAGVADIDCTGMQVLVTGSTSGIGREAALSLGRLGADVIVHGRDADAGAAVVSELSGLGVDAAFVQADFAAVDEVRSLAATVRDETDGLDILVNNAGGLFRQGRLTDIGVEYTFHVNHLAPYLLTTELLDHLNAGARVVTTASSAHRGTSLDLDRVTTVDSYTGTWAYSHSKLANVLFATELARRLETTGRDVVSNCLHPGAIPGSGFSRFLPGPIPQFVKLFDAVPGITSVEDGAAEILHLAVSSRIGDVSGRYFAGQRPATPSHAARDRAAASRLWRRSADLLGIDVPLGDVQSSAPTEN

SEQ ID NO: 12472 - protein, 148 aa, Hordeum vulgare
  misc_feature (5)..(5): Xaa can be any naturally occurring amino acid
  misc_feature (139)..(139): Xaa can be any naturally occurring amino acid
  unsure (1)..(148): unsure at all Xaa locations
MASKXILKEFKDLQKDPPTSCSAGPSGEDMFHWQATIMGPHDSPYAGGVFLVNIHFPPDYPFKPPKVSFKTKVFHPNINSNGSICLDILKEQWSPALTISKVLLSICSLLTDPNPDDPLVPEIAHMYKTDRSKYETTAXSWTQKYAMG

SEQ ID NO: 12473 - protein, 239 aa, Aspergillus oryzae
MIVALVTGANSGIGEAVARQLARQPDHHVIVTARNLEAGEKVAAAIVEEGNSASAVRLDLSSDESISTVAEHVKEAYGKLDILVNNAGTFLDHRSDLSVRENLTMTFDTNVIGTAVLTDALLDLLRQSSAPRVVFVSSVLGSLTLSNDENWPLRHIVSKAYKSSKAALNMLVLHYSRALQDVSGLVNTVCPGLVKTKLNGYAEDGVTPDVGGRRIVELALLGPDGPTATFSNRDGPIPW

SEQ ID NO: 12474 - protein, 194 aa, Triticum aestivum
  misc_feature (78)..(78): Xaa can be any naturally occurring amino acid
  misc_feature (92)..(92): Xaa can be any naturally occurring amino acid
  misc_feature (103)..(103): Xaa can be any naturally occurring amino acid
  misc_feature (119)..(119): Xaa can be any naturally occurring amino acid
  misc_feature (129)..(129): Xaa can be any naturally occurring amino acid
  misc_feature (138)..(138): Xaa can be any naturally occurring amino acid
  misc_feature (142)..(142): Xaa can be any naturally occurring amino acid
  unsure (1)..(194): unsure at all Xaa locations
MAPTVMASSATSVAPFQGLKSTAGLPVSRRSNGASLGSVSNGGRIRCMQVWPIEGIKKFETLSYLPPLSTEASSKQVXDYLIRPKWVPCLRXSSKVGVIFREXNASPGYYDGRYWTMWXLPISGCTDAXQVINEVEEXKKGXLTVLRRVRQHRKCMRSCLKQRAARSGRLKVIQRAIMHAVPELLVPPLLLVSK

SEQ ID NO: 12475 - protein, 228 aa, Synechococcus sp. WH 8008
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGAPTNVDLFELSAERLSEIDTVPASLNGALEALNADHHYLMEGGVFTK

SEQ ID NO: 12476 - protein, 474 aa, Synechococcus elongatus PCC 6301
MESPLMLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 12477 - protein, 118 aa, Prochlorococcus marinus str. NATL2A
MNQNIPLNISPKELNKILEDDSSEKPFIVDVREDNEIAIASFSFSVLHLPLSKAANWSDKIVELLPKDQPVVVICHAGVRSLNFGIWLLEQGIAKSVWNLVGGIDAWSTDVDQSVPRY

SEQ ID NO: 12478 - protein, 376 aa, Laminaria japonica
MADEDVQALVVDNGSGMCKAGFAGDDAPRAVFPSIVGRPKHPGIMVGMDQKDAYVGDEAQSKRGVLTLKYPIEHGIVTNWDDMEKIWHHTFYNELRVAPEEHPVLLTEAPLNPKANKERMTQIMFETFNVPAMYVNIQAVLSLYASGRTTGCVLDSGDGVSHTVPIYEGYALPHAINRLDLAGRDLTDNLMKVLTERGYSFTTTAEREIVRDIKEKLTYVALDFDQEMKTAAESSQLEKSYELPDGNVIVIGNERFRCPEVLFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 12479 - protein, 321 aa, Candida boidinii
MSSPLLTLNNGLKMPQIGFGCWKVDNATCAETIYEAIKVGYRLFDGAMDYGNEKEVGEGVNKAIKDGLVKREELFIVSKLWNNFHHPDSVKLAIKKVLSDLNLEYIDLFYMHFPIAQKFVPIEKKYPPNFYCGDGNKWSFEDVPLLTTWRAMEELVEEGLVKSIGISNFVGALIQDLLRGCKIRPAVLEIEHHPYLVQPRLIEYAKTEGIHVTAYSSFGPQSFVELDHPKVKDCTTLFKHETITSIASAHDVPPAKVLLTWATQRGLAVIPKSNKKERLLGNLKINDFDLTEAELEKIEALDIGLRFNDPWTWGYNIPTFI

SEQ ID NO: 12480 - protein, 530 aa, Aspergillus oryzae
MSDARTTLMETWFTPALVAAIVAARLLFSLYSAWRHAQRARSLNCQEAPLYPSRDPFGVATLLETLRADRDKFLPKLSQKRVDLISSQQNRYVSTFRVRQAGRENFFTVDPKNIQAMLATQFNDFFLGDMRRNAGAPVIRSGIFVSDGADWSHSRSLIRPQFTRTQINNLELEERHVQNALRAMPTQSNGWTSEVDIQTILFRLTLDSATEFLFGKSCNSQLTALEKDAGEMSDSFLNSFDRCAWYLAARLRFERLYWIVNNKEFRECTRVVHELVDGYVHAALQRAQQAEKPADPERGSHYVFVDALTATTQDPNQLRDECLNVLIAGCDTTASLLSWNILLLARHPDIFQRLRKEIIERFGTYSEPRDINFSSLKSCQYLQHFINETLRLHPVVPFNRRCANKDTTLPRGGGKDGNSPVYLQKGQPVLYSSYVLQRRKDIWGEDAEEFNPDRWYGRKAIWEHIPFSGGPRTCIGQQFAITNTSFVLVRLLQRFDSIEDVYPEREIRYGVTLTNCPADRVTVRMHQAEL

SEQ ID NO: 12481 - protein, 228 aa, Synechococcus sp. WH 8104
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRGFLTAGGVFSD

SEQ ID NO: 12482 - protein, 237 aa, Ashbya gossypii ATCC 10895
MWSYLFGSGNAKQKKELPKKAILELREHIQLLSKKQAHLQTQMTSQEESARHFLSKGNKNMAKAALKRKKVFESQLLKIDKQVDSLEQQLYSIENANLNLETMKAMKQGASAMKHIHEGLDVERVDETMDEIREQVELGEEISEAISRPLYTGVNEIDEDELDEELDMLAQEEVARKVMEPGAAVPAAAPATKVSLPSVPSSDMPQQDRGQPVTLGMDQEEDEDERALRELQAEMGL

SEQ ID NO: 12483 - protein, 227 aa, Symploca atlantica PCC 8002
HEVATGGQNELGFRFGRLIEAADWLMTYKYVIKNVAKKYGKTVTFMPKPVFNDNGSGMHCHQSIWKDGQPLFWGDGYANLSKMALNYIGGILRHAPALLALTNPTTNSYKRLVPGFEAPVNLAYSQGNRSASIRIPLSGTNPKAKRLEFRCPDATCNPYLAFAAMLCAGIDGIKNEIEPGESLDVDIYDLSPAELSKIPSTPGSLEAALESLEKDHSFLTDSGVFTE

SEQ ID NO: 12484 - protein, 126 aa, Zea mays
IRLSSLRYAPPSPAPRGRFVAARVRASAEAMATEKLGVRVERNPAESRLSELGVRQWPKWGCDKSKFPWTYSAKETCYLLQGKVKVYPDGEEGFVEIAAGDLVVFPKGMSCTWDVTEAVDKHYKFE

SEQ ID NO: 12485 - protein, 1065 aa, Bacillus cereus ATCC 14579
MEKKVSAIPQPKTYGPLGNLPLIDKDKPTLSFIKIAEEYGPIFQIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGDQEENDLLSRMLNVPDPETGEKLDDENIRFQIITFLIAGHETTSGLLSFAIYFLLKNPDKLKKAYEEVDRVLTDPTPTYQQVMKLKYMRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFELIDYQNYQLDVKQTLTLKPGDFKIRILPRKQTISHPTVLAPTEDKLKNDEIKQHVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSKRGEADASGDFEEQLEQWKQNMWSDAMKAFGLELNKNMEKERSTLSLQFVSRLGGSPLARTYEAVYASILENRELQSSSSDRSTRHIEVSLPEGATYKEGDHLGVLPVNSEKNINRILKRFGLNGKDQVILSASGRSINHIPLDSPVSLLALLSYSVEVQEAATRAQIREMVTFTACPPHKKELEALLEEGVYHEQILKKRISMLDLLEKYEACEIRFERFLELLPALKPRYYSISSSPLVAHNRLSITVGVVNAPAWSGEGTYEGVASNYLAQRHNKDEIICFIRTPQSNFELPKDPETPIIMVGPGTGIAPFRGFLQARRVQKQKGMNLGQAHLYFGCRHPEKDYLYRTELENDERDGLISLHTAFSRLEGHPKTYVQHLIKQDRINLISLLDNGAHLYICGDGSKMAPDVEDTLCQAYQEIHEVSEQEARNWLDRVQDEGRYGKDVWAGI

SEQ ID NO: 12486 - protein, 250 aa, Neisseria meningitidis Z2491
MGYMIDGTQAEYVRTQAEYVRTQAEYVRTPYADNSLVPLPDNVNEEVALLLSDALPTAHEIGVQYGDVKPGDTVFIAGAAPVGMSALPTAQLYSPAAIIVCDMDENRLKLAKELGATHTINPASGDVSKQVAAIVGEDGVDCAIEAVGIPATWNMCQDIVKPGGHIAVVGVHGQSVDFKLEKLWIKKLAITTGLVNANTTEMLMKAISSSSVDYTKMLTHRFKFSELEKAYDVFKHAAENQAMKVVLEAD

SEQ ID NO: 12487 - protein, 90 aa, Brassica napus
IQFSPAISIPKRELQHTHATFVRGLLNPGYFGMKSVSDVPALVGTLEDPLIPFSCISILRKYSATDMTYKMFTRQPASDSLLDELFSART

SEQ ID NO: 12488 - protein, 175 aa, Zea mays
  misc_feature (132)..(132): Xaa can be any naturally occurring amino acid
  misc_feature (153)..(153): Xaa can be any naturally occurring amino acid
  misc_feature (160)..(160): Xaa can be any naturally occurring amino acid
  misc_feature (172)..(172): Xaa can be any naturally occurring amino acid
  unsure (1)..(175): unsure at all Xaa locations
MYKLGRGNRDKVQQFMTITGASEKVALQALKASDWHLEGAFDFFYSQPQVDPQDIVMLVISWHMKAATMCEFTRQEFIGGLQSIGVDSIEKFRGKLPSLRAELKDDNKFRDIYNFAFTWAREKGQKSLSLEXTSIGMWQLLFAERNWPLSDHXWCQFLQXVRHNKAISRDTXVPA

SEQ ID NO: 12489 - protein, 252 aa, Bacteroides fragilis YCH46
MKIRILGSGTSTGVPEIGCTCAVCTSKDPRDYRLRTSALVYTDDATILLDCGPDFREQMLRVPFGKIDAVLISHEHYDHVGGLDDLRPFCRFGEVPIYAETYTAERLRSRMPYCFVEHSYPGVPNIPLREIEPNRPFLVNHTEVLPLRVMHGKLPILGYRIGKLGYITDMLTMPDESFEQLQGIEVLVMNALRIAPHNTHQSLSEALEAVKRIGAKETWLIHMSHHIGLQADVEKQLPPHVHFAFDGLELEC

SEQ ID NO: 12490 - protein, 200 aa, Streptomyces sp.
AWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRV

SEQ ID NO: 12491 - protein, 478 aa, Corynebacterium diphtheriae
MAFTSTEDVIKYIKEENVEFLDIRFTDVPGREQRITIPASMFTEEAAEDGFAFDGSSIRGFTTIDESDMNLHPDIATAMVDPFRKAKTLNMKFFVHDPFTREPFSRDPRNVARKAEQYLASTGIADTCFFGAEAEFYVFDKVSYEIEGNRSHYEVDSDNGWWNRGVDQNLDGTHNRGYKTPFKGGYGQCAPYDTLEDLRDEMTLTLRDAGFDIERQHPECGTGSQQEINYRFNTLLHAADDLQTFKYIIKNTAFRNGKTATFMPKPLAGDNGSGMHAHQSLWKDGKPLFHDEVGYAGLSDMARYYIGGILHHAGAVLAFTNPTLNSYHRLVPGFEAPINLVYSQRNRSAAIRIPITGSNPKAKRIEFRAPDPSGNPYFGFAAMMLAGLDGIKNRIEPHAPVDKDLYELPPEEAASIPQAPTSLEASLKALEEDNEFLTDGDVFTDDLIDAYIKLKYDNEIAPVRLRPTPQEFEMYFDC

SEQ ID NO: 12492 - protein, 666 aa, Haemophilus influenzae
MIMDNFDSPFQYNRPEMTVEAIKKSIVYKLIFLIGRSPREASQRDWLNATLHAVRDLVTEGWITTARQTRSEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNNFIRRVSLIEEGYQRKVRMGWLSVVGSHKINGVAEIHSDLMVTSTFADFARIFPERFTNVTNGITPRRWLAVANPQLADLFDKYIGSEWRCDLSQIAKLKPFAQEKAFKEAVADIKFANKVKLAEYVKRELGVELDPHALFDVQVKRIHEYKRQMLNVLHIIARYNEMLANPEKDWQPRVFILAGKAASAYYAAKQTIHLINDVANVINNDERLKDRLKVVFIPNYSVSLAQLIIPAADISEQISLAGTEASGTSNM

SEQ ID NO: 12493 - protein, 402 aa, Thermobifida fusca YX
MTDRPRISARIGGISESATLAVDAKAKALKAAGHPVIGFGAGEPDFPTPDYIVEAAVAACRDSRFHRYTPAGGLPELKEAIAAKTLRDSGYRVEPNQVLVTNGGKQAIYEAFATLLDPGDEVIVIAPYWTTYPESIRLAGGTPVYVVTDESTGYLATVEQLEAARTDRTKVLLFVSPSNPTGAVYSPEQVREIGRWALEHNLWVLTDEIYEHLVYGDARFSSMPVEVPELADRTVVVNGVAKTYAMTGWRVGWLIGPVDVVKAATNLQSHATSNVANVSQAAALAAVSGDLSAVEEMKQAFDRRRQTIVRMLNEIPGVVCPEPQGAFYAYPSVKEILGKEIRGQRPQTSSELASLILEHAKVAVVPGEAFGTPGYLRLSYALSDADLVEGVSRIAKLLSEAH

SEQ ID NO: 12494 - protein, 191 aa, Aspergillus oryzae
MTLLGNSGVRSLISKIRRKHPKLLLRLNSHHHPLVESSAIFLPPGLRIQSPLHPIKTFPAHLMYSRTSTLLSRSCRYFFRAPVHQRQTFSISARSFAAVNAAMADATAGVTPEGLKSKLIEQLQAQHVEIEDLSGGCGQAFQAVIVSPQFEKKTMLARHRLVNSVLKAEIAAIHAWTPKCYTPEQWQALQQ

SEQ ID NO: 12495 - protein, 92 aa, Shewanella sp. MR-4
MYKTAAAVHILVKHKEQAEDIIKQLNKGANFGALAKRYSSCPSAKKGGDLGEFKRGQMVPQFDKVAFSGELLVLHLVKTKFGWHVVKVLYRT

SEQ ID NO: 12496 - protein, 266 aa, Pseudomonas syringae pv. syringae B728a
MPNITVTSLLAMKQKGEKITMLTCYDATFAHTASQAGVEVLLIGDSLGMVLQGHDSTLPVTTAETAYHVACVKRGNQGAMILADLPFMANATLEQTLINSATLMQAGAHMIKVEGAAWLAESIRLLAERGIPVCAHMGLTPQAVNVLGGYKVQGRLETQARQMRADAIALEQAGAAMILLECVPSELAEEITQAVKVPVIGIGAGSATDGQVLVLHDMLGLSITGRVPKFVKNFMTGQPDIQSAIRAYVTAVKDLSFPATEHGFSA

SEQ ID NO: 12497 - protein, 399 aa, Fusobacterium nucleatum subsp. vincentii ATCC 49256
MIYKIEDVLKDIKNGIPLIIVDDENRENEGDLFVAAEKATYESVNLMATYARGLTCTPMSTEYAVRLGLDPMTARNTDAKCTSFTVSVDAKEGTTTGISIADRLTTIKKLADINSVPSDFTRPGHIFPLIAKDRGVLEREGHTEATVDLCKICGLAPVAVICEILKDDGTMARVPDLEIFAKKHNLKIITIADLIKYRKKTEQLMKIDVVANMPTDSGTFKIVGFDNLIDGKEHIALVKGEVAGKENVTVRIHSECFTGDILGSLRCDCGSQLKTAMRRIDRLGEGIVLYLRQEGRGIGLLNKLRAYNLQEEGMDTLDANLHLGFGADMRDYAVAAQMLKALGVKSIKLLTNNPLKINGLEEYGMPVVEREEIEIEANKINKIYLKTKKERMGHLLKIK

SEQ ID NO: 12498 - protein, 492 aa, Mycobacterium bovis AF2122/97
MMSASWLRHRVSERGLIATAEQLWADSFRLALVAAHDDGDSLRVVYLFLAGYPDRRVELEYVVPADNPEIRSLAYLSFPAGRFEREMADLYGIRPVGHPKPRRLVRHAHWPDWHPMRTDAGPAPEFTDTGAFPFLAVEGPGVYEIPVGPVHAGLIEPGHFRFSVAGETIVRLKARLWFVHRGIEKLFHGRPATAAVDLAERISGDTSAAHALAHSLAIEDALGIELPHEIHRLRALIVELERLYNHAADLGALANDVGYSLANAHAQRIRENLLRRNAAVTGHRLLRGAIRAGGVALRALPDTDELAALAVDLAEVATLTLANSVVYDRFAGTAVLHPDDASALGCLGYVARASGLRSDARVEHPTIVLPITEIGAPDGDVLARYTVRRDEFAASAALAQHIVESHTGPIEYAATLHPVGAPSSGIGIVEGWRGTIVHRVEIDVDGRITRAKVVDPSWFNWPALPVAMADTIVPDFPLANKSFNQSYAGNDL

SEQ ID NO: 12499 - protein, 411 aa, Nostoc punctiforme PCC 73102
MPGGVSSPVRAFKSVGGQPIVFDRVKGAYIWDVDGNQYIDYVGTWGPAICGHAHPEVIAALHEALEKGTSFGAPSTLENVLAEMVIDAVPSIEMVRFVNSGTEACMGVLRLMRAFTNRDKIIKFEGCYHGHADTFLVKAGSGVATLGLPDSPGVPKAATSTTLTAPYNDLESVKALFEENRDEIAGVILEPVVGNAGFIAPDAGFLEGLRELTHEYGALLVFDEVMTGFRIAYGGAQEKFGVTPDLTTLGKVIGGGLPVGAYGGRRDIMSMVAPAGPVYQAGTLSGNPLAMTAGIKTLELLQKPGTYDYLERITKKLADGLLQIAKETGHTACGGQISAMFGLFFTSGPVHNYEDAKKSDTAKFGRFHRGMLERGVYLAPSQFEAGFTSFAHTEEDIDQTLAIARDVMSSL

SEQ ID NO: 12500 - protein, 211 aa, Ehrlichia chaffeensis str. Arkansas
MGIIVSENSSFISPVEHIIEDSKQGKMFILIDDEQRENEGDLVVLAEKVTSGVINFMITHGSGIVCLSITEDLMHKLGLEFIPKRHVNCNSASFATSIDARYGITTGVSAHDRAHTILTVVNKNVTEDDFVTPGHIFPIVSKKGGVLERSGHTEASVEIARIAGLAPVAVVCELMNPDGTMSRMPDIIEFSQRYNIKVTSIDKLIQYVKAN

SEQ ID NO: 12501 - protein, 272 aa, Prochlorococcus marinus str. NATL2A
MQTTELVRFKKLGKQISVLTAWDAISSSIVEAAGADVVLVGDSLGMVVLGHSTTLPVTLDQMLHHTKAVCRGFCKPLSKQPLVVCDLPFLSYQCGEDKAVEAAGTLLKNSTASAVKLEGAEPETLLVIKRLIRMGIPVMGHLGLTPQSVHQLGYKSQARDKDSQEKIFKDSKMLQESGCFAIVLEHIPGEIASRLKKHIDIPVIGIGAGNDCDGQVRVTADILGLSIAQPPFAKPLLAGRELCINALKEWINSTDLDQVNPTTKTSESKSDC

SEQ ID NO: 12502 - protein, 84 aa, Brassica napus
  misc_feature (4)..(4): Xaa can be any naturally occurring amino acid
  misc_feature (16)..(16): Xaa can be any naturally occurring amino acid
  misc_feature (24)..(24): Xaa can be any naturally occurring amino acid
  unsure (1)..(84): unsure at all Xaa locations
MEIXRLIGDLVFEFGXGVEILVEXQRLLISVGGGVHCVGIGRSSMLGAASNIIGNVHQQNLWVEFDVINKRVGFIKADCSRSLP

SEQ ID NO: 12503 - protein, 227 aa, Tolypothrix sp. PCC 7101
HEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGSNPKAKRLEFRCPDATSNPYLAFAAMLCVGIDGIKNKIHPGEPLDRNIYELSPEELAKVPSTPGSLELALEALENDHAFLTESGVFTE

SEQ ID NO: 12504 - protein, 227 aa, Nostoc sp. PCC 7906
HEVATGGQCELGFRFGKLIEAADWLMIYKYVIKNVAKKHGKTVTFMPKPIFGDNGSGMHCHQSIWKDGKPLFAGDQYAGLSQMALYYIGGLLKHAPALLAITNPSTNSYKRLVPGYEAPVNLAYSQGNRSASIRIPLSGTNPKAKRLEFRCPDATSNPYLAFAAMLCAGIDGIKNKIDPGSPLDKNIYELSPEELAKVPSTPGSLELALEALENDHAFLTESGVFTE

SEQ ID NO: 12505 - protein, 394 aa, Prochlorococcus marinus str. NATL2A
MTQLETRTEPMVVNFGPHHPSMHGVLRLVVTLDGEDVVDCEPVIGYLHRGMEKIAENRTNVMFVPYVSRMDYAAGMFYEAIVVNAPERLANIKVPKRASYIRAIMLELNRIANHLLWLGPFLADVGAQTPFFYIFREREMIYDLWEAATGQRLINNNYFRIGGVACDLPWGWLEKCKDFCDWFGPKIDEYEKLITNNPIFRRRIEGLGVIGKEQAINWSLSGPMLRAAGVPWDLRKVDHYECYDDFEWDIAWEKEGDCYARYRVRIEEMRQSLKILRQACEMIPGGPTENLEAQRTVEGKKGDLSGFDYQYVAKKVAPTFKIPNGELYTRLESGKGEIGVFIQGNNDVTPWRFKIRAADSNNLQILPHILKGAKVADIMAILGSIDVIMGSVDR

SEQ ID NO: 12506 - protein, 390 aa, Pseudomonas syringae pv. syringae B728a
MSQPYSARSRAIEPFHVMALLARANELQAAGHDVIHLEIGEPDFTTAEPIIKAGQAALADGKTRYTAARGLPQLREAISGFYAQRYGVDIDPQRILVTPGGSGALLLTSSLLVDPGRHWLLADPGYPCNRHFLRLIEGEAQLVPVGPQQRYQLTPELVATHWNHNSVGALVASPANPTGTLLSRDELAALSQALKVRNGHLVVDEIYHGLTYGVDASSVLEVDNDAFVLNSFSKYFGMTGWRLGWLVAPQDAVADLEKLAQNLYISAPSMAQHAALACFEPQTLAILEQRRAEFGRRRDFLLPALRELGFGIAVEPEGAFYLYADISAFGGDAFAFCRHFLETEHVAFTPGLDFGRFQAGHHVRFAYTQSLPRLEQAVERIARGLRSWGV

SEQ ID NO: 12507 - protein, 435 aa, Xanthomonas axonopodis pv. citri str. 306
MSEFRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIQAPERAQYIRTMFDEITRIKNHLMWVGSNALDLGAMAVMLYAFREREELMDVYEAVSGARMHAAYYRPGGVYRDLPDRMPQYKESRWHKGGALKKRNAGREGTMLDFLEEFTNTFPARVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 12508 - protein, 525 aa, Moorella thermoacetica ATCC 39073
MRVLALDGVDARGLAALREAGLEVTTSGKMEEEELKEAIRDCEALIVRSGTRVTAAAINAAKKLKIIARAGVGTDNIDVAAATERGIVVVNAPEGNTIAAAEHTIAMMLALARNIPQASAALKQGRWEKKKFVGVELRGKTLGIIGLGKIGREVARRARGLEMKVVAFDPYVDSEQAARLEVELVPLETLLAGADFVTVHLPLTKDTRHLLDREKLGLMKQGARVLNVARGGIIDEGALYEALKAGHLAGAALDVFEEEPLGQSPLLELENVIVTPHLGASTREAQVAVAVEVAGDVIRCLQGEPVLNAVNIPVVRGHLAEVLHPYLQLAEKLGSFLSQLMESPILTAEICFNGELAGYDLAPLTSSFLKGLLRPLLAEAVNYVNAPLVAKKRGIRIREKKSPEMEYFANLIGVQVQGRRESHRLAGTVNQAGEPRLVNLDGYSVDTIPAGHLLVIPHLDRPRIIGPVALAIGDHGVNIAAMQVGRRERGGQAVMLISVDSEVPRAALDAIRQVDGVLDVRYISL

SEQ ID NO: 12509 - protein, 227 aa, Lyngbya aestuarii PCC 7419
HEVATGGQNELGFRFGTLIEAADNLMIYKYVIKNVAKKYGKTVTFMPKPLFNDNGSGMHCHQSIWKDGQPLFGGDKYAGFSEMDLHYIGGILRHAPALLALTNPTTNSYKRLVPGFEAPVNLAYSQGNRSASVRIPLSGDNPKAKRLEFRCPDATANPYLAFAAMLCAGIDGIKNKIDPGEPLDVDIYDLSPEELGKIPSTPGSLELALEALENDHAFLTESGVFSE

SEQ ID NO: 12510 - protein, 495 aa, Rhizobium etli
MAISSTLLGRLKDQTLVREQMLVGGKWSSEGVNGTRINVLNPSTMDVLASLPSAGLAEVRASIDAAKAAQKKWAKVSAKERSLIMRKFYEEVVANAEDLAVILTSEMGKPLAEARGEIAYGASYIEWFGEEAKRVYGDTIPGHQADKRLLVIKQPVGVVAAIAPWNFPSAMVCRKIAPALASGCAIVFKPAAETPLSALALAILAERAGIPDGLFSVLPTDNARMFGEEVCSNPVVKKLTFTGSTEVGRILMAQGAQKIMKLSLELGGNAPFIVFDDADLDQAVEGAMLSKFRNAGQTCVCANRIYVQSGIHDRFVEKLAMRVSALQVLDGFESGATIGPLINDEAVAKLYGHIDDAVTKGATVVVGGDRDARGGTFVQPTLLSGATKDMKVAREETFAPLAPVFKFDTVEEVIELANDTEFGLAAYFFANDLRNVWKVTEALEYGMVGVNTGLISTELAPFGGVKQSGFGREGSKYGMDDFLSMKYVCMGGIGA

SEQ ID NO: 12511 - protein, 227 aa, Anabaena cylindrica PCC 7122
HEVATGGQCELGFKFGKLIQAADWLMTYKYVIKNVAKKYGRTVTFMPKPVFGDNGSGMHCHQSIWKDGQPLFAGDKYAGLSETALHYIGGLLKHAPAVLAITNPTTNSYKRLVPGYEAPVNLAYSQGNRSASIRIPLSGTNPKAKRLEFRCPDATSNPYLAFAAMLCAGLDGIKNKIDPGEPLDKNIYELSPEELAKVPSTPGSLDAALEALEKDHAFLTEGGVFSE

SEQ ID NO: 12512 - protein, 143 aa, Ehrlichia ruminantium str. Gardel
MLERTLSILKPDVVKRNIAGQVNSYIENSGLKIIIQKMCLLTRYQAEKFYEIHKSQVFFVPLINFMISGPVVVQVLEGENAISLYREVMGATDPKKANSGTIRGDFAENIDANCVHGSDSLENAIREIRFFFSEYELLSLYEC

SEQ ID NO: 12513 - protein, 246 aa, Streptococcus pneumoniae R6
MNKKRFHSKIRTENDGGKSVENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 12514 - protein, 224 aa, Listeria monocytogenes str. 1/2a F6854
MINQKKIAGEKACEWIKDGMVVGLGTGSTVYYTIEKLGEMVNNGLHITGVATSEETNKQAQNLGIPLKSLNDVTEIDITIDGADEIDTDFQGIKGGGGALLREKMVASASLKNIWVVSEEKLVRNLGKFPLPLEVIPFGWKQVERKLEKEHIQTNLRKQSSGEVYVTNNGNYILDIVNQTFTDAEMWQEKLAQIPGIVEHGLFLHYVDIIICAKANGEIELIKK

SEQ ID NO: 12515 - protein, 251 aa, Xanthomonas axonopodis pv. citri str. 306
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 12516 - protein, 110 aa, Glycine max
MAHSMISFRAVTTVNRARADMVAPFTGLKSMAGFSTRKTNNVITSIASNRGRVQCMHVWPPVGKKKTETLFYLPDLDDAQLAKEVECPVRKGWIPCYELEFEHAFVYREH

SEQ ID NO: 12517 - protein, 437 aa, Moorella thermoacetica ATCC 39073
MTDSEAWPRSAAAFAEAVKLMPGGVNSPVRAFKSVGLTPPFIQRGEGAYLYDIDGHKYIDYVSSWGPLILGHRHPEVVDALEKTLREMGTSFGAPTELENELAREITTAMPAVEMVRLVNSGTEATMSALRLARGYTGREKVVKFAGCYHGHADYFLIQAGSGALTFGIPNSPGVPATVAANTIVAPYNDLAAVEDIFQKAGEEIAAVIVEPVAGNMGCVPPLTGFLAGLRTITKEYGSLLIFDEVMTGFRVAFGGAQALYGIRPDLTCLGKIIGGGLPVGAYGGRREIMERVAPSGPIYQAGTLSGNPLAVSAGLATLKVLKKPGTYERLESLSARLEKGLKEAAAEAGVPVTFNRVGAMFTTFFNPGPVTDYATATASDTRAFAAFFRAMLRQGIYLAPSQFEAAFMSLAHREDDIDCTIAAAREAFKGIAIGDS

SEQ ID NO: 12518 - protein, 440 aa, Chlamydophila pneumoniae AR39
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAKDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 12519 - protein, 107 aa, Olimarabidopsis pumila
MFEIIQAVFAAGAALALLTFAGITLGGSAVAFVISTPLFVIFSPVLVPATIATTLLASGLTASGSFGATAISILMWLYKKRTGRDPPKIPGLTPPAPAAPPSAATVS

SEQ ID NO: 12520 - protein, 145 aa, Antirrhinum molle
PKSYCSLTTTTCRRNPLPSRFTIHGLWPDNYSWPLNECGFDFDLPVIKDKGLLRKLDKNWPDLTKRKRKPIRDADKKFWMSQWVKHGTCALSVYTFDDYFQETLKLKSRFNLLKILQDSQIRPGNLVDPALVVQAIKKYTKHVST

SEQ ID NO: 12521 - protein, 330 aa, Kluyveromyces lactis NRRL Y-1140
MWEEFDITKLPYYDPKVDNKVALVTGGNSGIGYYTVLHLYLHGFKVYLGGRNSSRVNHAIKEIKKEAEIRLRKGQDEKPHDGLMIRKTGKLEYLHIDLTDLNSVEKAATKFTVQEDHLDVLINNAGVMAIPYELTKDNFEIQMQTNYVSHFLLTMRLLPLIKARKGRVITVSSLGHNLIFFNCNPGAQFNYWPSMFFMWCRYALAKTASIQFTKMLAIKNPDILCMSLHPGLVMNTNLFSYCTRLPFVGIFFWILFQFVGYFFGVSNEQGAISTLKCALSSDLSAETDNGAYFTTGGYPSKPSRVANSLDNAASTWIWTVHELRDRGHEI

SEQ ID NO: 12522 - protein, 145 aa, Misopates orontium
PKSYCSLTTTTCRRNPLPSRFTIHGLWPDNYCWPLNECGFDFDLPVIKDKGLLRKLDKNWPDLTKRKRKPIRDADKKLWMSQWVKHGTCALSVYTFDDYFQETLKLKSRFNLLKILQDSQIRPGNLVDPALVVQAIKKYTKHVST

SEQ ID NO: 12523 - protein, 378 aa, Archaeoglobus fulgidus
MEEVSSHVKSGKPVMILDSEKSAICIPAEVVSGEILNFMMKNCDEIRLALTWKQILNLGLNRFRFQNGNLIPIDPNLEKISAEERAKFIRELVSGNAGDIKYPGRIFVEETKEMGVLERPGIAEACVDLARMAGFAPSAVYAPLMTAEGGVAGEDYALKFAKEHSMPVFRIKDMIEFRIKSEKIVERVIEATLPTKFYGTFRAVGYKTPLGEIVALVKGRVDEGDVLVRIHSECLTGDVFHSLRCDCGDQLENALKMIDREGKGVAIYMRGHEGRGIGLINKLMAYKLQEEGKDTVDANIELGFPPDMRSYGIAAQILMDLKVKSIRLLTNNPLKIEELKKYGFKIVREPIEVEPCEVNLPYLKAKKDKMGHLICFND

SEQ ID NO: 12524 - protein, 457 aa, Salmonella typhimurium
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 12525 - protein, 145 aa, Misopates orontium
PKSYCSLTTTTCRRNPLPSRFTIHGLWPDNYSWPLNECGFDFDLPVIKDKGLLRKLDKNWPDLTKRKRKPIRDADKKFWMSQWVKHGTCALSVYTFDDYFQETLKLKSRFNLLKILQDSQIRPGNLVDPALVVQVIKKYTKHVST

SEQ ID NO: 12526 - protein, 341 aa, Salmonella typhimurium LT2
MKVKAVFINKPGEVETRWVDYPHKKENEVLIKVDAAGICGSDIGAFRGTNPLVTYPRIIGHEVTGIVLQEGAGMPDNIKEGDRVIVDPYIYCGHCYPCSVGRTNCCENLNVIGVHVDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 12527 - protein, 109 aa, Zea mays
  misc_feature (103)..(103): Xaa can be any naturally occurring amino acid
  unsure (1)..(109): unsure at all Xaa locations
SIDHVRAYVRESTRHELTKNAAYIGTPGKGILAADEPTGTIGKRLSSINVPRGGENRRALRELLFCCPAALQYITGAILFEETLPQKTKDGTPFVDALKEGAXPPCHHG

SEQ ID NO: 12528 - protein, 142 aa, Antirrhinum graniticum
PYSYCSLKKSHCKRAHLPSEFTIHGLWPDNKSYPLLNCPHTYTVLKIENKGLVKKLRVNWPDLTRLKKFQGQKFWITQWKKHGSCALPLYSFEDYFIKALDLKKKSNVLNMLERKSLVPGDQPVDIGDVTAAVVKVTGGFPL

SEQ ID NO: 12529 - protein, 563 aa, Cryptococcus neoformans var. neoformans JEC21
MVCVISDPDWWRQAVVYQIYPRSFADANGDGIGDLKGITARVPYLKALGVDAIWLSPFYPSALRDGGYDVADYRDVDPKIGTLEEFDEMTAAFQKVGIRVIVDIVPNHSSDDHEWFQAALKAGKGSPERERYIFRDGLGPNKDQPPTDWICSFGGSAWSPSGMNDGQWYFHWFDSSQPDWNWENPDVKADFLKTLKFWGDRGVSGFRIDVAHGLAKDMSEPLPNWEQLTKLTHQKLTNGNSELDHPLLDRKEVHDIYRSWREVFNQFNPPLMAVAEAWVAPDQKPLYASSEGLGQTFSFDILLCNFDAEEYRQCIKSSLAGSKKSDSTTTWVLSNHDVMRHPTRFGLPNVPNANHAMTTDTYNKFLKTKLTDPKVDIEQGLRRAKAATLMILALPGSTYLYQGEELGLQEVVEIPDEERQDPIFIRTKGEEVGRDGCRVPIPWVADEKNFGYGPGKRAHLPQPAWFKDYAVDVEEKDANSVLSLYRRALGLRKGLQSAEELEWVENPNKEVLHFRRPGGWEVVVNIGKDSVDLPKGSVLISSSNNALKGGSIPGETTVWLKSA

SEQ ID NO: 12530 - protein, 122 aa, Arabidopsis thaliana
MVDALLDAATFSKSDDGSEKGMSFEDFRSWCPLVPTIRKFLGSLLIPPGPVRPGYQVPDLLYEDSVSSDRLLLKKEYAWHIGGALPHHELVEWKLLYRSSLHGQSFNTFLGHTSGMEGSNMA

SEQ ID NO: 12531 - protein, 535 aa, Streptococcus agalactiae A909
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKASGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQGHQAGFTNGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 12532 - protein, 372 aa, Magnaporthe grisea 70-15
MTFEKVLHKGSSANTGGIGSMLGKDREASKAAINEYFQHWDGKTAKNETSEVREARKADYATLTRQYYNLATDFYEYGWCQSFHFCRFAHGETFASAIARHEHTLAHRIGIKKDMKVLDVGCGVGGPARQMAKFTGANITGITINEYQVERATRYAELEGLSRQLQFVQGDFMSLPFEEETFDAVYAIEATVHAPVLEDVYRQVYNVLKPGGVFGLYEWVMTDAYDDNNLRHRDIRLGIEQGDGIANMQTAKTAVEAIKAAGFELLEVEDLSQSTDGGNSTRAPWYWPLDGSSWRCANTIGDVLGTFRMTPAGRTVAHAMLTVMEAVGLAPPGTKKTADSLARAADALVAGGKEGLFTPMFLMVARKPFAEE

SEQ ID NO: 12533 - protein, 443 aa, Blastopirellula marina DSM 3645
MTDILHIPEVAGLNVKRQVVRIPPEMDVPLSPRVRQLIDSPEFRRLQQISQLGLVSLVYPAANHTRFEHSLGVYRTALLYLQQLAHDERFAEIITPADAELLIVAALLHDLGHWPFCHPIEDLRLANVPQHEMFANSFLLEGEIADCLRDDWGINPRDVVALLSEKPRNKKMQVLQSLLSGPIDVDKMDYLRRDSLHAGVPYGLNFDQQRLIGSLCLNQAGTGLALTNKGRTAAEMMVFARYVMFSEVYWHHAVRSGTAMFQRAFYMLHDQLDLDSLFRQVEQPMIASMRGAAGNGPARDLLFGLFGPVRRVYKRLLEYSFVENPDFYDLIARRPYAWLERLSAEFANRLSTTMTRRIAPHEILIDAPPIKLEVQFNIEIFSPKEDKYRLLGQVSPMVETLAKRQFDDYVKKVRVFAHPAIIDDLRKIDNIEALLSDAIEAID

SEQ ID NO: 12534 - protein, 505 aa, Staphylococcus aureus subsp. aureus MRSA252
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVEDQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 12535 - protein, 183 aa, Arabidopsis thaliana
  misc_feature (132)..(132): Xaa can be any naturally occurring amino acid
  misc_feature (149)..(149): Xaa can be any naturally occurring amino acid
  unsure (1)..(183): unsure at all Xaa locations
MASSMLSSAAVVTSPAQATMVAPFTGLKSSAAFPVTRKTNKDIISIASNGGRVSCMKVWPPIGKKKFETLSYLPDLSDVELAKEVDYLLRNKWIPCVEFELEHGFVYREHGTTPGYYDGRYWTMWKLPLFGXCTDSAQVLKEVEECKKXEYPGAFIRIIGFDNTRQVQCISFIAYKPPSFTEA

SEQ ID NO: 12536 - protein, 1192 aa, Lycopersicon esculentum
MSHKRCHEYFSLNGVLKNVVFMIILLSSSFLVVVSNARKLAENDQVGRLLAFKKSSVESDPNGFLNEWTLSSSSPCTWNGISCSNGQVVELNLSSVGLSGLLHLTDLMALPTLLRVNFSGNHFYGNLSSIASSCSFEFLDLSANNFSEVLVLEPLLKSCDNIKYLNVSGNSIKGVVLKFGPSLLQLDLSSNTISDFGILSYALSNCQNLNLLNFSSNKIAGKLKSSISSCKSLSVLDLSRNNLTGELNDLDLGTCQNLTVLNLSFNNLTSVEFPPSLANCQSLNTLNIAHNSIRMEIPVELLVKLKSLKRLVLAHNQFFDKIPSELGQSCSTLEELDLSGNRLTGELPSTFKLCSSLFSLNLGNNELSGDFLNTVISSLTNLRYLYLPFNNITGYVPKSLVNCTKLQVLDLSSNAFIGNVPSEFCFAASGFPLETMLLASNYLTGTVPKQLGHCRNLRKIDLSFNNLVGSIPLEIWNLPNLSELVMWANNLTGEIPEGICINGGNLQTLILNNNFISGTLPQSISKCTNLVWVSLSSNRLSGEIPQGIGNLANLAILQLGNNSLTGPIPRGLGSCRNLIWLDLNSNALTGSIPLELADQAGHVNPGMASGKQFAFVRNEGGTECRGAGGLVEFEGIREERLAILPMVHFCPSTRIYSGRTMYTFTSNGSMIYLDLSYNSLSGTIPDNLGSLSFLQVLNLGHNNFTGTIPFNFGGLKIVGVLDLSHNSLQGFIPPSLGGLSFLSDLDVSNNNLSGTIPSGGQLTTFPASRYENNSGLCGVPLPPCGSGNGHHSSSIYHHGNKKPTTIGMVVGIMVSFICIILLVIALYKIKKTQNEEEKRDKYIDSLPTSGSSSWKLSTVPEPLSINVATFEKPLRKLTFGHLLEATNGFSSESMIGSGGFGEVYKAQLRDGSTVAIKKLVHVTGQGDREFMAEMETIGKIKHRNLVPLLGYCKIGEERLLVYEYMKWGSLESVLHDGGKGGMFLDWPARKKIAIGSARGLAFLHHSCIPHIIHRDMKSSNVLLDENFEARVSDFGMARLVNALDTHLSVSTLAGTPGYVPPEYYQSFRCTAKGDVYSYGVILLELLSGKRPIDPRVFGDDNNLVGWAKQLHNDKQSHEILDPELITNLSGDAELYHYLKVAFECLDEKSYKRPTMIQVMTKFKEVQTDSESDILDGISVKGSILEESQEREP

SEQ ID NO: 12537 - protein, 321 aa, Glycine max
  misc_feature (68)..(68): Xaa can be any naturally occurring amino acid
  unsure (1)..(321): unsure at all Xaa locations
MEAKKIPEVILNSGQKMPVIGLGTASIPLPPHEALTSIPIVAFEVGYRHFDTASLYGSEESLGKAVAXALDLGLIKSRDKVFITSKLWTTDAHPDLVVPTLKTHCRKKLGLEYVDLYLIHWPLRMKPEAKGYHNILKENVLPSFDMKGIWEAMEECYRLGLAKSIGVSNFGIKKLSQLLENATIPPAVNQVEMSPAWQQGKLKEFCKQKGIHVSAWSPLGAYKSAQGTNAVMESPILKEIACERQKSMAQIALRWIYEQGAIAIVKSFNKERMKQNLDIFDWELSQEESQKFSQIPQRRMYRGITFVSENGPYKTLEELWD

SEQ ID NO: 12538 - protein, 139 aa, Brassica napus
TRQDQLWQQKEERVREFSDVQSQIQKICGEIAGGLSSEVPIVDESDLSLKKLDDFHSQLQELQKEKSDRLQKVLEFVSTVHDLCAVLGLDFLTTVREVHPSLDEETGAQSKSISNETLSTLAKTVLTLKDDKKQRLKCF

SEQ ID NO: 12539 - protein, 108 aa, Brassica napus
MGDFNLALVIVAIVVCVIVFISSIYLLVNYQHPDDANQAYFPKFVVVFGLSIAMISILMLPADVANRHACRHAIYNGACNLTLPMKELWLSVYIVDAILVFFVIPFAM

SEQ ID NO: 12540 - protein, 123 aa, Brassica napus
  misc_feature (11)..(11): Xaa can be any naturally occurring amino acid
  misc_feature (118)..(118): Xaa can be any naturally occurring amino acid
  misc_feature (121)..(121): Xaa can be any naturally occurring amino acid
  unsure (1)..(123): unsure at all Xaa locations
MESTFIMIKPXGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSXSIXSA

SEQ ID NO: 12541 - protein, 142 aa, Antirrhinum meonanthum
PNSYCSLEKSNCRRSRLPLEFTIHGLWPDNKSWPLLNCPYKSIPKIEDKELVKKLDIHWPDLTRRRKRIPEQKFWITQWKKHGTCAFPRYSFKDYFIQAIELKKKNNVLHMLEDKSLVPGDQPVDISDVHAAVLKVTGGAPI

SEQ ID NO: 12542 - protein, 135 aa, Zea mays
  misc_feature (9)..(9): Xaa can be any naturally occurring amino acid
  unsure (1)..(135): unsure at all Xaa locations
AGRRRAGGXTALAATGKTPGEAEEQVPAWAKPGADEPPPWEREGGAARGQEARQVPFYAYLLASTITAIAAIGSIFEYTNQRPVFGIVGPDSVLYAPLLGFFVFTGIPTSAFLWFKAVQTANREAEEQDRRDGFL

SEQ ID NO: 12543 - protein, 275 aa, Oceanobacillus iheyensis HTE831
MIKGLQDTFTLNNGVEMPGFGLGVYKVEDGSVAEESVRIALENGYRSIDTASFYDNEKGVGEGIKNSGVPREDIFLTSKVWNDEQGYTSTKQAFQRSLDKLGTDYLDLYLIHWPVKDTFVETWRAMEELYRDGKVKAIGVSNFHVQHLEKLFVNAEVIPAVNQVEFHPHLTQEGLRAFCRQHNIQLEAWSPLKRGQLLEEDIIQTIAKKYGKSAAQVILRWDVQHEVITIPKSITKERIIANADIFDFSLTEEEMNQIDAMNQNDRSGSNPDSFD

SEQ ID NO: 12544 - protein, 213 aa, Zea mays
  misc_feature (190)..(191): Xaa can be any naturally occurring amino acid
  misc_feature (199)..(199): Xaa can be any naturally occurring amino acid
  unsure (1)..(213): unsure at all Xaa locations
MSAFVGKYADELIKTAKYIATPGKGILAADESTGTIGKRFSSINVENIESNRQALRELLFTSPGALPCLSGVILFEETLYQKTSDGKPFVEFLQENGVIPGIKVDKGVVDLAGTNGETTTQGLDSLGARCQEYYKAGARFAKWRTVLKIGATEPSELSIQRTPKGLARYAIICQEKRLVPIVEPEVLTDXXHDIKKCAXVTETVLLPCTGLND

SEQ ID NO: 12545 - protein, 144 aa, Antirrhinum graniticum
PKSFCLVNSRKCQRNPLPSNFTIHGLWPDNYTRQAPQSCTTNNFQRFTDTDIEQRMEESWPDLKQPSIAGLSYNFWQDQWRKHGSCCFPPHESEIYFLKALELKDRLDVLTILENNNFNPGTPQPFSVLRVFNTISRAIGKTPI

SEQ ID NO: 12546 - protein, 285 aa, Treponema pallidum subsp. pallidum str. Nichols
MCCPNYNSARALAQFLTERGLRMHKKWGQNFLLDPVLRTQLVKILAPERGERVWEIGAGIGAMTALLVQNSDFLTVFEIDRGFVQTLRKLFDAHVRVIEGDVLQQWHAAAAQEQPACVLGNLPYNIAARFIGNTIESGYIFKRMVVTVQKEIGLRMTALPAQKWYSYFSVLCQWQYEVRVIRNVAPVCFWPRPHVVSQALVLTKRNAVPSCVDPALFLHVTKTLFSARRKTVRNNLLTWQKRMPGGAAVCVEELCARAGIDARARAEQLSIYDFITLSDTLRALL

SEQ ID NO: 12547 - protein, 358 aa, Oryza sativa (japonica cultivar-group)
MSAYCGKYKDELIKNAAYIGTPGKGILAADESTGTIGKRFASINVENVEDNRRAFRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 12548 - protein, 391 aa, Lactococcus lactis subsp. lactis Il1403
MDLLKKFNPNLDKIEISLIRQFDQQVSSIPDVIKLTLGEPDFYTPEHVKQAGIVAIENNQSHYTGMAGLLELRQAASEFMNKKYGLSYAAEDEILVTVGVTEAISSVLLSILVAGDEVLIPAPAYPGYEPLITLAGGSLVEIDTRANDFVLTPEMLEQAIVEREGKVKAVILNYPANPTGVTYNRGQIKALAEVLKKHEVFVIADEVYSELNYTDQPHVSIAEYAPEQTIVLNGLSKSHAMTGWRIGLIFAARELVAQIIKTHQYLVTSASTQSQFAAIEALKNGAYDALPMKKEYLKRRDYIIEKMSDLGFKIIEPDGAFYIFAKIPADLEQDSFKFAVDFAKENAVAIIPGIAFGQYGEGFVRLSYAASMDMIEQAMARLTDYVTKKRG

SEQ ID NO: 12549 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 12550 - protein, 807 aa, Debaryomyces hansenii CBS767
MLSSEITEDKLLYRETRRIKAGEIERFKIHYVSDKEGDKAMKVPKSLWVKVKNIELIAFRAAYLAGPYVLYVDCKPEEYDPNKKCFITADQPVFEPQLLPAQSFYAELSCHTIKDSYNWTVDVISQIIFNKTIDVNFEITIGTSKSILHDASLAEKHVKNSDERGTFVPSTILNVENHDTLDLWNLPLPDTKKPIHLVILTHGLHSNVSVDMLYLKEQMDKANNQDNIVVKGYFGNLGKTERGIKYLGSRVAEYIVDLVTKNETYNKGKVAKISFVGHSLGGLVQTFAIAYLQNNFAWFFKSIKPINFITIASPLLGVVNENPAYVKMALLAGVVGKTGQELGLKLIENDSKPLLLLLPTGPTHRTLKMFVRRTVYGNVANDGIVPLRTSALLYLDYKGLTQILNNPDIKKKYTDDNSTTDKIPDNSSLDVNDDSKLLLSLQAMFSYFMPQKQRKKPDVQYQRFQTKKEGKSNNTSNEDDVEDSENNNECYEELPKSSFVEAATTLILPPLPSLKYITNPESRDNVVVHDKVYHESDLPPRDLASKSQIQTLTIKKTPIDKDDETSSSNNDEMSSSQQSSLRQRFMESLDVQNVEHIEEEIAREYHKNMSWRKVLVNLKPDAHNNIIVRRRFANAYGWPVIDHIVKNHFKDGMDTSDKYIKPDRPNGVCGDDPNIASFDSLDAEVDLSDILSRDLLTQQNDDIDKENQNEEIEGEHCEHGWINSKDNAESLFAVGPTGLLSDVSEMVGNLRDQWYNYNGNSKEPKRNVSEGIESNTDTTPNDPEREIPDEINDGDLGLSKLLMGNFI

SEQ ID NO: 12551 - protein, 473 aa, Citrus sinensis
MAGLTLVYDLVLYISISTVIFFIIKRSRSRRLRLPPGSLGLPFLGETLQLIAAYKTENPEPFIDVRVKRFGSIFTTHIFGEPTVFSADPETNRFILQNEGKSFECSYPGSVSNLLGKHSLLLMKGSLHKRMHSLTMTFANSSIIRDHLLVVIDRLVRLHMDSWTDRVLLMEEAKKITFELTVKQLMSFDPNEWTESLRKEYVLVIEGFFTVPLPIFSTTYRRAIQARTKVAEALSLVVRQRRKESEPGERKNDMLEALLAGDDGFSDEEIVDFLVALLVAGYETTSTIMTLAVKFLTETPLALAQLKEEHDEIRAKKSKQEPLEWNDYKSMPFTQCVVNETLRVANIISGVFRRAMTDINIKGYTIPKGWRVFASFRAVHLDHDHFKDARSFNPWRWQNNSGATSPVNVSTSFGGGPRLCPGYELARVELSVFLHHLVTRFSWVPAEQDKLVFFPTTRTQKRNPIIVQRRNEN

SEQ ID NO: 12552 - protein, 313 aa, Cryptococcus neoformans var. neoformans JEC21
MGYTLAVLGCGTMGIAILSGVISSLETRASLPRNPNASSEPPSGISTPTASQFLDAPEASLPSTFIATVGREETGRKLRRTLADMGSIGKQVQVRAGQGNVKTVDEADVILVCSKPQIARSILEEEGMSKALEGKLLISICAGVTISQLKSWVPESTRVVRAMPNTPCKIGEGMTIVTPLSDALSRTLILNIFTSCGRCRFLDEKHFDACTALAGSGPAFVALVLEAMADGGVMMGLPRSEALELAAQTMQGTGRMALQTGLHPAQLKDSVTTPGGCTIAGLLTLEDGRVRSTMARAIQVATNHASGLGQDKK

SEQ ID NO: 12553 - protein, 144 aa, Antirrhinum majus subsp. cirrhigerum
PKSFCLVNSRKCQRNPLPSNFTIHGLWPDNYTRQAPQSCTTNNFQRFTDTDIEQRMEESWPDLKQQSIAGLSYNFWQDQWRKHGSCCFPPHESEIYFLKALELKDRLDVLTILENNNFNPGTPQPFSVLRVFNTISRAIGKTPI

SEQ ID NO: 12554 - protein, 181 aa, Zea mays
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 12555 - protein, 391 aa, Oryza sativa
MDGKSSKLLPHLVVASATRVDAIESALRRPGRFDSEIEVTVPTAEERFEILKLYTKNLHLGECVDLQSVAASCNGYLGADLQALCREAARRAYGRLSSSSESENVLTLIMEDWESAKSVAKNSVTRGVIKEIPAVSWDDIGGLKAVKKKLQQAVEWPIKHAASFDRLGISPIRGVLLHGPPGCSKTTLAKAAAHAAQASFFSLSGAELYSKYVGEGEALLRRTFQMARLASPSIIFFDEADAIAPKRTGPSGNSSGNATVGERLLSTLLTEMDGLELATGIIVLAATNRPNAIDAALLRPGRFDMVLYVPPPDAEGRYEILRIHTRKMPLGDDVDLWKVAERTELFTGADLEGLEGKSEAALRSLRPSLTQSVVDEYSNAAIHGPLTRRKH

SEQ ID NO: 12556 - protein, 138 aa, Arabidopsis thaliana
  misc_feature (2)..(3): Xaa can be any naturally occurring amino acid
  misc_feature (12)..(13): Xaa can be any naturally occurring amino acid
  misc_feature (51)..(51): Xaa can be any naturally occurring amino acid
  misc_feature (63)..(63): Xaa can be any naturally occurring amino acid
  misc_feature (67)..(67): Xaa can be any naturally occurring amino acid
  misc_feature (78)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (90)..(91): Xaa can be any naturally occurring amino acid
  misc_feature (93)..(94): Xaa can be any naturally occurring amino acid
  misc_feature (100)..(101): Xaa can be any naturally occurring amino acid
  misc_feature (104)..(105): Xaa can be any naturally occurring amino acid
  unsure (1)..(138): unsure at all Xaa locations
MXXSMVSSAAVXXSPAQATMVAPFTGLKSSAAFPVTRKTNKDITSIASNGXRVSCMKVWPPIXKKKXETLSYLPDLSXXXLXXEXDYLLXXKXXPCVEFXXQHXXALLTPPYCPLMIPFLCPSFVITLPQCISSPPSP

SEQ ID NO: 12557 - protein, 287 aa, Prochlorococcus marinus str. NATL2A
MNKQIIQWYPGHIAKAEKQLKENLSKVDLVFEVRDARIPLATSHPYLQKWLKGKKQILVLNRKDMINVEAYQAWDKKLRSEGKVPWWCDAKAGTGVLQIKHAAIRAGQELNQRRLDRGMKNRAIRVLTLGFPNVGKSALINRLVKKKVVSSSRKPGVTRSLRWVRLGQDLDLLDAPGVLPPRFEDQNAALKLAICDDIGQAAYDTEQVAISFMKLLETLENIQEAGIKSMCLQNRYGIFVNETIKDKYSWLLSAAERHTSGDTQRMSQRLLDDFRKNLLGNISLELP

SEQ ID NO: 12558 - protein, 112 aa, Brassica napus
  misc_feature (103)..(103): Xaa can be any naturally occurring amino acid
  unsure (1)..(112): unsure at all Xaa locations
LHCLAMRLMEEKIAHPEKYTDEGKARAPELEDSSLYHYAIFSDNVIAASVVVNSAVKNAKEPWKHVFHVVTDKMNLGAMQVMFKLKEYKGAHVEVKAVEDYTXLNSSYVPVL

SEQ ID NO: 12559 - protein, 488 aa, Bacillus anthracis str. 'Ames Ancestor'
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 12560 - protein, 608 aa, Vibrio sp. Ex25
MNLPFIFHSQTIDGLAFNQEQVTFRLKTETLDFDSVYVRLEPDNEEYLVDMAQIGTAGELLLWEASFRPNRDQDVTHYVFKLLKDGQQYWLDARGVQKRIPPKEFHFKLNVNHQPPSWVQEQVFYQIFPDRFSASKSESDIRKAYAQHDSEAIIKSWGDAVGSHKNTGAREFFGGDLKGVEQRLDYLEQLGVTALYFNPIFSSPSNHKYDTTDYFTVDPMFGTNAQFAELCEKICGKNMKIVLDAVFNHTSVHHPWFDIQQKGEGAYGNPQSKFRDYYFFEDETNHYIGWKGIGNLPVLNFENEQVRDYIYQSEESVIKHWLNPPYSVDGWRFDVIHMLGEGEGAKNNAHYVEAFRHATKSVNPNAYVLGEHFFEATQWLQGDQEDGAMNYYGFAHPVRAFIAQQDIMYEPINIDGLEFKAWLDEARAKIPFSNQLSQLNQLDSHDTARFITLVDGDKRKMNIALALLMTYVGTPCIYYGSEVGLEGGLDPDNRRCFPWNEIENSAWLSIYKQWISIRKQYKSLQSGSIQWLHCDTNVLAYARVLGSEAIVVVMNLSGDECSIDLPLWQLGLEATHLSSLLDVRELIDYKGHLSVNIPAQSFKLWQLK

SEQ ID NO: 12561 - protein, 1138 aa, Burkholderia sp. 383
MMKREDSLDDVRRAQFPSLAPGGTPRRRRARRRAPALCADDPLWYKDAIIYQVHVKSFYDSNNDGIGDFPGLIAKLDYIAELGVDTIWLLPFYPSPRRDDGYDIADYRDVHPDYGTLADVRRFIREAHARGIRVITELVINHTSDQHPWFQRARRAKPGSTHRDYYVWSDTDTKYAGTRIIFLDTETSNWAHDPVAGQYYWHRFYSHQPDLNFDNPAVVREVMQVMRFWLDLGIDGLRLDAVPYLVAREGTNNENLPETHAILKRIRATIDAEYPNRMLLAEANQWPEDVQEYFGDEDECHMAFHFPLMPRIYMSIASEDRFPIVDIMRQTPELAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAVNVEAQTRDPHSLLNWTRRILSTRRASQAFGRGTIRFLRPENRKVLAYLRELDGDDPVLCVANLSRASQAVELDLSEFAGRVPIEMTSDSPFPPIGQLPYLLTFPPYGFLWFVLAEHGREPSWRQPHAEPLPEYVTLVMRRGDARPDIEQLHVLAHDALPSWLARRRWFASKDRAIGAARLNVVTPVPGEPFQYAEAWVESDEPGDVERYVVPLAAAWGGETSQPLFAQLALARVRRGHSVGYLTDAFALPAFAHGMLRKLRDGATVPTSDDGRLAFLPEDALAALDPGDNADVRWLAAEQSNSSLVIGDAIVLKLVRKVAHGVHPEAEMSRYLTRIGYPNTATLAGEVVHVDPDGTPHTVAILQRYADNQGDAWTRSFDFLRRAVDELALPAADEEEPDDTDEEPDALLGYAAFAGIIGTRLGQLHVALAQPSDDPAFAPEHATPEHVDGWCADAIASFEHALDVLHTRLDALDPATRAAADTLLASRDAAVRALGELVPRTLDAQCIRIHGDFHLGQVLDVQGDALLIDFEGEPARPLERRRAKSHPLRDVAGLLRSLSYVSAIAQFAIEKAPPQAAGRKRALFDRFGQAAADRFVDCYRAAAELAPARFVDPRYAYRLLALFLIDKASYELCYEAANRPDWLSVPVGGLAALVERLLDGGAASDDGDTP

SEQ ID NO: 12562 - protein, 486 aa, Triticum aestivum
  misc_feature (313)..(313): Xaa can be any naturally occurring amino acid
  unsure (1)..(486): unsure at all Xaa locations
SKKISKAEPTEWPILGQLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTGNLLLAGRDTTGAGLSWFFYLLSKTPNVQQRILDKLAXSLPEEEPEGMVLSTLATDQLGVPAPALSKCLRLYRPCPSSTRRQIAGDVLPSGHELKAGDKILVYCYSMGRMEGVWGKDCMEFRPERWVTDDGKLRHEPSYKFFAFNAGPRTCLGKDVAFTQMKAVAAAVLWNFAVEAVPGHVVEPKLSVMLHMKNGLAVTVKRRKVPCVHAT

SEQ ID NO: 12563 - protein, 107 aa, Arabidopsis arenosa
MFEIIQAVFAAGAALALLTFSAITLGGSVVAFVISTPLFVVFSPVLVPATIATTLLASGFTASGSFGATAFSILAWIYKRRTGRDLPKIPGLTPPAAPASNPAGSGV

SEQ ID NO: 12564 - protein, 387 aa, Aspergillus nidulans FGSC A4
MTTLASHRSGRSSESSVDVVAAEKEKLSTVQLSQANLDALPDLRNSASPKRWKTFWKSFRYLQHLTSKQVDDFMASYIIYNLDWSDEKQMVETLGEDYQRKVGDCLQAYYGVLNHLCALGDVEKMYIPPFMSSKATVRENQLLYEESIAHDIGLKPGDRVLDLGCGRGRVAAHMSQYSGAQVTGLNIDPNQVAQARSFNTRLGFESNSFIVQDFNSLPLPFADDSFDAFYQIQALSLCKDLPALFREIYRVVKPGARISLLDWVSLPDYDPSNAEHAELMRRVKPLIGAVGTPTPEILENALMEAGFTVLRSDNASVGGLQAPLIDKVDLYFRSMRQLILGLVKAHMLPRHFKTLINRLCLDGQAFVKMDKMRLVTTSYRIIAQKQA

SEQ ID NO: 12565 - protein, 269 aa, Salmonella typhimurium LT2
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGVTLDQLARALGHDRKIIRAMPNTPSLVNAGMTSVTPNALVTPEDTADVLNIFRCFGGAEVIAEPMIHPVVGVSGSSPAYVFMFIEAMADAAVLGGMPRAQAYKFAAQAVMGSAKMVLETGKHPGELKDMVCSPGGTTIEAVRVLEERGFRAAVIEAMTKCMEKSEALSKS

SEQ ID NO: 12566 - protein, 142 aa, Antirrhinum graniticum
PPSFCSLSRVACGRDPVPAEFTIHGLWPDNYSHELNYCKSNKQLSVQIEDIGEWLDKDWPDLMKQATVNPDKGFYEEQWRKHGICSSNIFTPKEYFTLGRKLKKARNLLQVFHQNEIYESQFSSISRINKAIKIITGRQSPI

SEQ ID NO: 12567 - protein, 425 aa, Kluyveromyces lactis NRRL Y-1140
MLLNKGLLASLLAYTTTAFDLQHIFYKEQYSCPISLPASCSNNTEIKDSCCFEFPGGIMLQTQFWDYIPPKGVSDPDELVRHLGPLDSFTNHGLWPDNCDGTYAQFCNRESNIDDVWHLLNDDQFNGRDDLPINGTDLLETMDMYWKSNTGDDESLWVHEYNKHGTCIRTLYPDCYKKWGVAGNSKKQAVYDYFRIAMKLFHDKDTYQTLKSAGIEPSVEKSYTKLEISNALKEGHSGEVVHFLCDRHGSLNQIWYFHSLKGSLLGEKFVPISALPKGSNCPDDNIKWYPKGHVPSSYRPPNGNHPGTRGVVRIGNGKGFLIKNGHWYLKGTPANFFLIEAPFGNYYLKTRMGYCGIDNSNKVLACNKNVAQAAQFEYDAKKGYIGYNGAYDWYATKYPRGNQQAPVYAGSNDDGYNFQLKFVKA

SEQ ID NO: 12568 - protein, 248 aa, Triticum aestivum
  misc_feature (80)..(80): Xaa can be any naturally occurring amino acid
  unsure (1)..(248): unsure at all Xaa locations
MAPRKFFVGGNWKCNGTGDDVKKIVTVLNEAEVPSEDAVEVVVSPPFVFLQQATGLLRPDFPRAARLGWRRGGGAFTGRXSVPEMLVNLQVPGVILGHSERRALLNESSDFVADKVAYALAQGLKVIACIGETLEQREAGTTMEVVAAQTKAIAEKISDWTNVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 12569 - protein, 85 aa, Triticum aestivum
MAGPAKASWMVAMSVGAVEALKDQAGLCRWNYALKSIHRAAKANVRASVSQGTKQLPASVVERRQAEKAEEELRTVMYFSCWGPN

SEQ ID NO: 12570 - protein, 222 aa, Triticum aestivum
MITPSYLVDSIEYSSYASNALGALPYGRPAGGRTSDSNTTHYRARAAARAGSDSGITFNEQPKMKALEIAERTRDAILSGKFDQVRINLPNGDVVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLAKVAATVMNLHGFQAPAEYETTLIEVIDK

SEQ ID NO: 12571 - protein, 506 aa, Oceanicola granulosus HTCC2516
MTAPKPVVLCILDGWGLREEREANAPALAETPNFDRIWRDCPHATLTTHGRDAGLPEGQMGNSEVGHTNIGAGRVVAMDLGQIDLALEEGTYAEQPPLKDFIATLKDSGGRAHLLAVVSDGGVHGHIAHLLETARILDAEGVPVVVHAMTDGRDVAPTSGKGFVERLVEELPGSATVGTVIGRYYAMDRDERWERIETAYRAIAEGKGESEAADPVAAVEAAYDADMTDEFIPATVIEGYDGLREADGLFCLNFRADRAREILRALADPEFDGFARETPALAARLGMVDYSSDHNAWYESVFPKKAIRNTLGAWVAAQGLRQFRLAETEKYPHVTFFLNGGKEEPEAGEDRKMPKSPKVATYDLQPVMSAGEVSDAFVGAIEAGYDLIVVNYANPDMVGHTGDLDAAIKACEAVDAGLGRALEALEAAGGAIVVTADHGNCETMVDPETGGPHTAHTLNPVPVIVVGGPEEATLREGRLADLAPTVLDLMGLDQPPEMTGKSLIQR

SEQ ID NO: 12572 - protein, 190 aa, Triticum aestivum
  misc_feature (16)..(16): Xaa can be any naturally occurring amino acid
  misc_feature (28)..(28): Xaa can be any naturally occurring amino acid
  misc_feature (75)..(75): Xaa can be any naturally occurring amino acid
  misc_feature (81)..(81): Xaa can be any naturally occurring amino acid
  misc_feature (91)..(91): Xaa can be any naturally occurring amino acid
  misc_feature (94)..(94): Xaa can be any naturally occurring amino acid
  misc_feature (105)..(105): Xaa can be any naturally occurring amino acid
  misc_feature (137)..(137): Xaa can be any naturally occurring amino acid
  misc_feature (156)..(156): Xaa can be any naturally occurring amino acid
  unsure (1)..(190): unsure at all Xaa locations
HIEQRPSVEDPVPESXRTASALNKNRVXYSASSQLVSELPMLCGSKRIAGVGTPVGKFTSGGALHLAVRALGLLXRMGGFXIWVKPDVESXFVXGNCSENVSRLXRIHENRKSVYGVVVIVSWPDCSSLGSGSAARXVHDRRKAYTKSVVVFHQSXDAGEYICTEEELIRGEAGGLVLILVTALDVTQCI

SEQ ID NO: 12573 - protein, 83 aa, Arabidopsis thaliana
  misc_feature (2)..(2): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(32): Xaa can be any naturally occurring amino acid
  misc_feature (55)..(55): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
  unsure (1)..(83): unsure at all Xaa locations
MXSSMFSSAVVVTSPVQATMXAPFTGLXSSAXFPVTRKTNKDITSIASNGGRVSXMKVWPPIGKKKXEXSILPPLXLSDVRIG

SEQ ID NO: 12574 - protein, 542 aa, Streptococcus pyogenes MGAS8232
MTIDKKKVVYQIYPKSYKDTTGNGVGDLRGIIDKLPYLQELGIDMIWLNPFYLSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELADCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAKEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPLRYQHGQVLISNYEKVSICEKVMLKPYQTLAILADN

SEQ ID NO: 12575 - protein, 404 aa, Pediococcus pentosaceus ATCC 25745
MKNRIIEKIENALQTLKNGGLIIITDDENRESEGDMVGLAEYVTPKAVNTMVTNARGLLCVPMSAEIAQKLGLSPMVTNAEDAFGTAFTISTDAKTTKTGISAFDRAKTIQKLADPQAKFSEFYHPGHVFPLIAEEGGVLARGGHTEAAVDLAKLAGVRPVAYITEVLKKDGTMARRNTLKSLAEGMQMPLLTIEEIKIYRYMKDAGIVKSVAKVHLPTKYGEFEMEAFDTGAGQEPTLLLTKGSLSEVQPLLLRIHSECLTGDIFGSKRCDCGEQLERSLKEIQSRGRGALLYLRQEGRGIGLANKLKAYELQEQGMDTVEANLKLGFQADERHYGVAAAILRKKGITKVNLLTNNPDKIKQLETLGIKVEERVTIQIPARPENRSYLKVKKEKMHHLLKGMD

SEQ ID NO: 12576 - protein, 480 aa, Streptomyces avermitilis MA-4680
MPALRIKSPELLVAESGADLEGHGLKRTMGLFQLICFGVGAIVGTGIFVGLSDSVAQAGPAVVVSFVLAAITCVFTAFAFAELGGAIPVSGSSYSFAYAGLGERTAFLVGWCLLLEYGVSVSAVAVGWSQYVNELLDSLTGLELPAALSAGPGDGGVINLPAVVVIALASVLLVRGVRESARATAAMAVLKLAILVVFCAIGFSAFKDGNLTPFSPAGLGGIGAGTTAAFFSYIGFDAITTAGEEARNPRRDIPIAILVCLGLATLLYCAVALAAIGAIGGDQVGGRPAALSYVVNEVTGSTAGGAVIAFGAVVAIASVVLAVMYGQTRILMSMARDGLVPRVFERVSPKTSTPVTGTLLVALVFAVPAAFASLDAVVNLCTIGTLAIMAVVNVTVIALRRREPGLTRSFRVPLYPVIPVLGVGFCLYLMYETGWTTWIQFAAFLAAGCLVYALYGRRNSRLAKSAAATRTDAEAVSQAV

SEQ ID NO: 12577 - protein, 273 aa, Bacillus licheniformis ATCC 14580
MKRIGFIGAGSMAEAMIKGLVKSGAMEPEAIFVTNQSNTARLRELSETYGVCGEADTAKVAARSDTLVLAMKPKDAAGGIAALRPYLRKEQLLISVLAGIPIHTIQHYAGLELPVVRAMPNTSAAIQKSATAFAASPLVTKEQMQEAADLFATVGSVTIVEESALDAVTAVAGSGPAFVYRFVEALQASAAELGLPEKTAKQLIIDMMAGAAQMLETGRDPSVMRKEITSAGGTTEAGLRMLDDHQFEQTVISCVKEAANRSAELRDMFAAKI

SEQ ID NO: 12578 - protein, 1065 aa, Bacillus cereus G9241
MDKKVSGIPQPKTYGPLGNLPLIDKDKPTLSFIKIAEEYGPIFQIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPGDMTRLTLDTIGLCGFNYRFNSFYRETSHPFITSMTRALDEAMHQLQRLDIEDKLMWRTKRQFQHDIQSMFSLVDNIIAERKSSGNQEENDLLSRMLNVKDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKNHETKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSKRGEADASGDFEEQLEQWKQSMWSDAMKAFGLELNKNMEKERSTLSLQFVSRLGGSPLARTYEAVYASILENRELQTSSSERSTRHIEVSLPEGATYKEGDHLGVLPINSEKNVNRILKRFGLNGKDQVILSASGRSVNHIPLDSPVRLYDLLSYSVEVQEAATRAQIREMVTFTVCPPHKKELESLLEEGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDEREGLISLHTAFSRLEGHPKTYVQHVIKEDRIHLISLLDNGAHLYICGDGSKMAPDVEDTLCQAYQEIHEVSEQEARNWLDRVQDEGRYGKDVWAGI

SEQ ID NO: 12579 - protein, 559 aa, Zea mays
MMSPASERSLIIQSDDDDDARSGHDVEEPEPEQEQDSDSSSSSSSCATPRRGPSSPPYIQQWPQSYRQSIDILSSVQSPNLSFLGTPTLSRLSNSFLAITDSFRSKAPETISSFIKPLLGPTPSDDQQRQHEGTRKSSEYLVPSRRSSLQQIPEDQKPPVGGHGASHDQNCSYTQGVMNGINVLCGVGILSTPYAIKQGGWIGLAILCIFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCACFLAILKTKVRWHQIAACSFIIVVGVCCAYVGTYSSLSKIIQNYA

SEQ ID NO: 12580 - protein, 1131 aa, Burkholderia mallei ATCC 23344
MKPADTLEDVGRAQFVAHMARRPRRARRREAPGVADTPLWYKDAIIYQLHVKSFFDANNDGVGDFAGLIAKLDYIAELGVDTVWLLPFYPSPRRDDGYDIADYRGVHPDYGTLADVRRFIREAHARGLRVITELVINHTSDQHPWFQRARRAKRGSVHRDYYVWSDTDLKYAGTRIIFLDTETSNWTHDPVAGQYYWHRFYSHQPDLNFDNPAVVREVLQIMRFWLDLGIDGLRLDAVPYLVEREGTSNENLPQTHAILKLIRATIDAEYPNRMLLAEANQWPEDVQEYFGDEDECHMAFHFPLMPRIYMSIASEDRFPIIDIMRQTPALAPSNQWAVFLHNHDELTLEMVTDSERDLLWQAYASERRARLNLGIRRRLAPLMERDRRRIELINSILLSMPGTPVIYYGDELGMGDNLHLGDRDGVRTPMQWSSDRNGGFSRADPELLVLPPVMGTLYGYDAINVEAQTRDPHSLLNWTRRILSTRRATRVFGRGAIRFLRPGNRKILAYLRELDGETPVLCVANLSRASQAVELDLSEFAGCVPTEMTSDSPFPPIGQLPYLLTFPPYGFLWFALSEHGREPAWHQQYAEPLPEYLTLVMRRGETQPGAALLDTLAQDALPSWLARRRWFASKERRVDSARFDALTPIPGEPFQYAEARVAVDGREERYVVPLASAWGSETPQPLFAQLALARVRRGHTVGLLTDAFALPSFAHGVLRQLRAGAAVPVAGGGRLEFRPEPDLARLDPGDAPGVRWFAAEQSNSSLVIGEAIVLKIVRKLATGVHPEAEMGRHLRRIGYRNVAPLVGEVVRIGADGAPHTVAILQEYVDNQGDAWTRSCDFLKRAIEELALPAANDADAAAPSAEPEMIDGYATFAGIVGKRLGELHAALAQPSDDAAFAPQRVSPARVDGWIGDALGWFERAASLLAERLDTLEGQTRAAAELLVAQRAAVAEALRALVPRELDGCCIRIHGDFHLGQVLDVQGDALLIDFEGEPARPLGQRRAQSHPLRDVAGFLRSLSYASAAAQFTIEKAPQQAAERKRALFERFGQAAADRFVAQYREALSAASREFVEPRYADRLLALFLIEKASYELCYEAANRPDWLSVPANGLAALVARLIGGAAPQQEDAR

SEQ ID NO: 12581 - protein, 883 aa, Arabidopsis thaliana
MSYQNEEEEEGGDTNDCFYESLDRLASSSSCSCSASNSDYDSESSPRISSAASHDSEELYGGGRRRRYPFPVPRFPMGASKFDVWTSEPASVSERRSKLLNEMGLSRDPVLSRLKPVSDSSSSKDTGAAGFEISRSISCNQLARRDHGECSESVGGCASCIVRSKSDITTSQCGDRDRRYTSPGNPCSCSVSKLSVHHSSHSEISRTSSPFVNCSVGSVSADSLRLNGDSDCVLRESVVNEEVEVCTIKNLDNGKEFVVNEIQEDGTWKKVKEVGTGTQMTMEEFEMCVGHSPIVQELMRRQNVEDSDKNTSKENEDSGNSNKDNASKSKKKGSWFKSIKSVASSMTGHSKERRSSDDRDTSSERGGRRSSSATDDSQESSFHGPERVRVRQYGKSSKELTALYKTQEIQAHNGSIWSIKFSLDGKYLASAGEDCIIHIWQVVEAEKKGELLLDRPELLLLATNGSPEPTTMSPRRRGRTSISRKSLSLENIFVPDSLFGLSEKPFCSFQGHVDDVLDLAWSKSQHLLSSSMDKTVRLWNLSSQTCLKVFSHSDYVTCIQFNPVDDRYFISGSLDAKVRVWSIPDRQVVDWYDLHEMVTSACYTPDGQGVLVGSYKGSCRMYSASDNKLQQKSQINLQNKKKKAHQKKITGFQFVPGSSSEVLVTSSDSRIRVVDGTDLVNKLKGFRNTSSQISASITADGKYVVSASEDSHVYIWKYESPASRPSRSNNNKNVTVTNSYEHFHSQDVSAAISWPGMASTENWGTQNRAGFNGSTNNLDNISTANHPPTPVDQLGTVERLNSPRNGIISSATNGYFFDRMSATWPEEKLLFARNRSGNRLSTDMSSSNGNSGNVSASWGMVIVTAGLRGEIRTFQNFGLPIRI

SEQ ID NO: 12582 - protein, 264 aa, Vibrio parahaemolyticus RIMD 2210633
MKKMTINDLIKWKQEGRKFATSTAYDASFAQLFESQEMPVLLVGDSLGMVLQGENDTLPVTVDDIVYHTRCVRAGSPNCLLMADMPFMSYATPEQACENAAKLMRAGANMVKIEGGDWLVDTVKMLTERAVPVCAHLGLTPQSVNIFGGYKIQGRDQEKADRMVKDALALQEAGAQIVLLECVPAELAERITKVLDVPVIGIGAGNVTDGQILVMHDMFGISANYMPKFSKNFLAETGDMRKAVAKYIEDVANGVFPDDAHTIA

SEQ ID NO: 12583 - protein, 246 aa, Treponema pallidum subsp. pallidum str. Nichols
MCVAVCLVPVRNPFGASVYFAPKTASTMDEAASRAQGCEEGAVFCAGEQVAGRGRGDQRKWQSEPGKNLLCTVVLRRVAFPAFSLCVGYAVALAYMAFLGGVCAPRIKWPNDVLVCDRKIAGVLCQVRAGALLVGIGCNLLQVKFPPELSHACSLAQIVGGERCPDPFAFLPVLLDRLYACVMAPPSIGVLESCLWKQGEYVCFRECAGTRPPILGRVVGLAADGALCIDSAGSMRSYYSGEIAFW

SEQ ID NO: 12584 - protein, 470 aa, Acinetobacter sp. ADP1
MSNEMHGQPSGEGELSRSLSNRHLQLIAIGGAIGTGLFMGSGKTISLAGPSILFIYLIIGVMVFFVMRALGELLLSNLQYKSFIDFSTDLIGPWAGYFVGWTYWLCWITIGIADLSAIIYYLQFFNNGMPFTPTEGAMISVAAIFFIMGLNLMTVKLFGELEFWFAMIKITAIVVLILVGLWMIFTGFTSTSGEVASFTHLWANGGFFPTGMHGFLAGFQIAIFAFVGVELVGTTAAETKNPEINLPKAVNSIPIRIIIFYVLALLIVMSVTPWNRIDPNISPFVNLFSQAGIAAAAIIMNLVVLSSVMSSMNSGVFSTSRMLFGLSKEKQAPQAFGALNKGRVPANALYFSTVCLLLGAALQYVVPNTVEAFTLATTLSTILFICVWLMIIWSYMVYYKKRPELHAKSIFKLPGGLFTCWILIIFFVGMIYVLSLEPDTMKALMVSPIWLVILVIGYFGFYKPRLKSKK

SEQ ID NO: 12585 - protein, 266 aa, Zea mays
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLS

SEQ ID NO: 12586 - protein, 401 aa, Streptococcus pneumoniae R6
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLRKYHIGAQMLKDLGLQSLHLLTNNPDKVEQLEKYGITISSRISIEIEANPYDSFYLETKKNRMGHILNMEEK

SEQ ID NO: 12587 - protein, 331 aa, Vibrio vulnificus CMCP6
MTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 12588 - protein, 574 aa, Arabidopsis thaliana
MRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQVETVAQFGVIFLLFALGLEFSAAKLRVVRAVAIPGGLLQIFLFMCLSGITASLCGGKLTEGIFVGAFLSMSSTAVVLKFLMERNSISALHGQITDCAVGLLFALLPVLGGTSGVLQGVLSMAKSLAILIAFLGALFVLSRTWVPWFLKLMTSLSSQTNELYQLAAVAFCLLVAWCSDKLGLSLELGSFAAGVMISTTDLAQHTLEQARSQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEIGFKGELYHSESAKRISLMIQGSLHDS

SEQ ID NO: 12589 - protein, 303 aa, Ehrlichia ruminantium str. Gardel
MHYCILINLCFTNLFNHYILMYTLYNVVAYKTMNILLIGCGNLGSILLNKWSLNDQISDIVVVQPSLSKKNIFNTINKITFVRDHKEINKSFMPQIVVIAIKPQQVANAIPDYKTYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAIKLISQTFIGSAKLLETRKNSISNLISSITSRGGITQAALEILNSHLPNIMSLSLKSATERLVHLKNSDDNKKNT

SEQ ID NO: 12590 - protein, 143 aa, Glycine max
  misc_feature (135)..(135): Xaa can be any naturally occurring amino acid
  unsure (1)..(143): unsure at all Xaa locations
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVSNEVKEXKKEYPGTP

SEQ ID NO: 12591 - protein, 208 aa, Triticum aestivum
  misc_feature (10)..(10): Xaa can be any naturally occurring amino acid
  misc_feature (16)..(16): Xaa can be any naturally occurring amino acid
  unsure (1)..(208): unsure at all Xaa locations
AAAKIVIHDXNEGKVXYFTLPPKRDVVEDANAVIITEDGSEFNVDEIYKAESSYISGLKSMEEFSHIEIPSNAPPEIDEAMLEDPLTQSAPVKDESMSDANDREGSKAAASGGTQHDKLYTAEGILDPRKKKAEKKRRKGNKFSVLNDMDADYDFKVDYQMKDASPADDEDGDGSKAEGEEPKGEDDKKDAPAAECEPMTSAGFGGAN

SEQ ID NO: 12592 - protein, 331 aa, Vibrio sp. Ex25
MTIKVGINGFGRIGRFVFRAAQERADIEVVGINDLIDVDYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDAVVSQDFIGEVQTSVFDAKAGIALTDNFVKVVSWYDNEIGYSNKVLDLIAHISK

SEQ ID NO: 12593 - protein, 137 aa, Campylobacter upsaliensis RM3195
MEKTLSIIKPDAVKKGVIGKILDRFESNGLRIAAMKKLQLSKEQAEGFYAVHKERPFFKDLVEFMISGPVVVSVLEGENAVLKNRELMGATNPKEAKAGTIRADFAENIDANAVHGSDSLENAKIEIDFFFKPNEIC

SEQ ID NO: 12594 - protein, 96 aa, Zea mays
TADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 12595 - protein, 684 aa, Candida albicans SC5314
MENSNKISLHPEQKKWKAPKGPKPIHHKNKNLIGLGRTIANQRSKENSIQYLPDGEMRFTTDKKEANWVKLRSVTQENALDEFLSTAELADTDFTADKNQQVKIIKVGNTSIVNSNGLLSTDEMLAMRQKHMMFENKLTIPKRPKWNKNQSKIEIDRQENLAFLSWRRELAQLTENNDLLLTPFERNLEVWKQLWRVVERCDLIVQIVDARNPLFFRSIDLDKYVTSLSDPDNNKAKNNLLLVNKADMLTRDQRIAWAEYFKLKKINYVFFSAAKANELLEKEREELENIQNSTGSSSSSSRNTNNNAAAAAVDAEQEEGEANDSIRILKIEELEKLFMDSAPKFEVDPEFPDRKLQIGLVGYPNVGKSSTINALVGSKKVSVSSTPGKTKHFQTIHLSPDVLLCDCPGLVFPNFAYTNAELVCNGVLPIDQLREHIPPVSLVCQRIPKFFLEAVYGIHIPIQKVEDGGNGEYPTARELLNAYARARGYMTQGFGSADEPRAARYILKDYVNGKLLYVNPPPKEATNKNEWILPNLQESRIFNRELYTLNHLPESRQHQIVSAMQHKHIPVDEFNLEKDLTKLNFSQHIAAITGSGDSKDEDNKLRDNNQSQSEAKTLFYGGKQAALESAGDELDREFFAMNNISGKFATPFHKKNNSNTEKNSNKKHNKKNKKQDKKVRVVGY

SEQ ID NO: 12596 - protein, 502 aa, Nicotiana sylvestris
MEHSLMATRSYFLLFSSFTFLLILLSFPVEKSHALEAKETIESHFHTLQLTSLLPSSSCNTATKGKRRGASLEVVNRQGPCTQLNQKGAKAPTLTEILAHDQARVDSIQARVTDQSYDLFKKKDKKSSNKKKSVKDSKANLPAQSGLPLGTGNYIVNVGLGTPKKDLSLIFDTGSDLTWTQCQPCVKSCYAQQQPIFDPSASKTYSNISCTSTACSGLKSATGNSPGCSSSNCVYGIQYGDSSFTVGFFAKDTLTLTQNDVFDGFMFGCGQNNRGLFGKTAGLIGLGRDPLSIVQQTAQKFGKYFSYCLPTSRGSNGHLTFGNGNGVKTSKAVKNGITFTPFASSQGATFYFIDVLGISVGGKALSISPMLFQNAGTIIDSGTVITRLPSTVYGSLKSTFKQFMSKYPTAPALSLLDTCYDLSNYTSISIPKISFNFNGNANVDLEPNGILITNGASQVCLAFAGNGDDDTIGIFGNIQQQTLEVVYDVAGGQLGFGYKGCS

SEQ ID NO: 12597 - protein, 184 aa, Oryza rufipogon
FGSVYRGRLSIKGTVTEAAVKQLDRNGMRGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSFQARLSDFGLAKVGPVGDKTHVSTRVMGTYGYCAPEYALTGKLTTCSDVYSFG

SEQ ID NO: 12598 - protein, 798 aa, Streptococcus mutans UA159
MQLTKEKFIRDFKDTLHEEQLIKIPEATPTELFASLAKVVRKYYTPLWLERNRKISQNQQKVAYYFSIEFLPGRMLETNLLNLGILDTVKEGFAELGVNFEDVKNAEHDMALGNGGLGRLAAAFMDSLATTGYPGFGNGLRYKYGLFKQRIVDGYQVELPDSWFGSVGNVWETRKDHDAVEVKLFGNVYLQANERGRIVPVYDGAQILRAIPYDVPQIGFGNDNINNLRLWDVEIPEECELNYPTLESRRRVKNITAILYPDDSNYEGKELRLIQEYFMTSAGLQTIIKSYLKQGLPLERIHEKISVHINDTHPAVAPAEFMRLLIDEYDLEWDQAWETTVQTMSYTNHTILSEALEKWDAGLFKNVLPRVYQIILEIDNRFVAGLAQKGIDPQIIENTRIVKDNQIHMANLAIIGGHSVNGVAKLHTELLKEDTLHDFYTLYPGKFNNKTNGIVQRRWTQIAAPELSAALDQTIGNSWRTDIHELRKLNDFANDSAVLDHFYQVKQDAKAKLAAYIKESTGVEVSTDAIFDVQVKRLHAYKRQLLNVLHIVKLYWDLKDNPNLDMVPRVFIFGAKAAPGYHFAKSVIKIINELANLINSDESLQGKLKVVFLENYNVSLAELIIPAANVSEQISLASKEASGTSNMKFMMTGAVTLATLDGANIEIKDEVGDENIVIFGMTKDDVYRHYENHDYYSRGVYESNPVIKRVVDTFINGTIPNSQSEGTEIYEALITHNDEYFLLEDFIAYVQAQEKIDALYRDKETWSRMSLCNIANSDKFTSDDTITQYAKEIWHLEI

SEQ ID NO: 12599 - protein, 665 aa, Arabidopsis thaliana
MLSLLLPLISLLFQIQCFTVKSQPVPLNQICSNVTGNFTVNTPYAVNLDRLISSLSSLRRNVNGFYNISVGDSDEKVNSISQCRGDVKLEVCINCIAMAGKRLVTLCPVQKEAIIWYDKCTFRYSNRTIFNRLEISPHTSITGTRNFTGDRDSWEKSLRGLLEGLKNRASVIGRSKKNFVVGETSGPSFQTLFGLVQCTPDISEEDCSYCLSQGIAKIPSCCDMKMGSYVMSPSCMLAYAPWRFYDPVDTDDPSSVPATPSRPPKNETRSVTQGDKNRGVPKALIFASASVAIVVLFIVLLVVFLKLRRKENIRNSENKHENENISTDSMKFDFSVLQDATSHFSLENKLGEGGFGAVYKGVLSDGQKIAVKRLSKNAQQGETEFKNEFLLVAKLQHRNLVKLLGYSIEGTERLLVYEFLPHTSLDKFIFDPIQGNELEWEIRYKIIGGVARGLLYLHQDSRLRIIHRDLKASNILLDEEMTPKIADFGMARLFDIDHTTQRYTNRIVGTFGYMAPEYVMHGQFSFKTDVYSFGVLVLEIISGKKNSGFSSEDSMGDLISFAWRNWKEGVALNLVDKILMTMSSYSSNMIMRCINIGLLCVQEKVAERPSMASVVLMLDGHTIALSEPSKPAFFSHSNAVSDSSSSLGHNAKTSNYNSNTELYPR

SEQ ID NO: 12600 - protein, 548 aa, Pediococcus pentosaceus ATCC 25745
MNFKNKVIYQIYPKSFYDSNNDGIGDLQGIIKKIPYIDKLNIDMIWFNPFFVSPQYDNGYDIANFYEIDPVFGTMSAFEELVRKLKEIHVGVMLDMVLNHISTEHEWFQKALAGDEHYQKYFYIRDPKPNGDLPNNWTSKFGGPAWAKFGDTGKYFLHLYDEHQADLDWHNPEVRQELFKVINFWHAKGVKGFRFDVINVTGKDVELTDAPEGVESKFMYTDTPIVQSYLKEMHQAALQDPEVITVGEFSSASVENGVKYTRPEEHELTMAFTFHHLKVDYDHGQKWTKVPFDFAALKKTINTWQVGMDEGDGWNALFWNNHDQPWALNRFGDSGKYRAKSAEMLATTMHLLRGTPYIYQGEEIGMVDPDYQNIDEYVDVEALNAYQRLLKENKSPQDALEIVKSKARDNSRVPMHWDDSKYAGFSEVQPWLKPTKQTEINVANELEHGEIFAYYQKLIQLRREFSIISEGDYQSFELNHPSVFAYIRTYQDQSLLVLNNFYGNDATISIPSKYTTETAKILINNYETNPELTTTLKLKPYQSIAILI

SEQ ID NO: 12601 - protein, 224 aa, Oceanobacillus iheyensis HTE831
MEYSDKQIAAQEAVRYIKDGMVIGIGSGSTVNEFLYCLAARMRKERLQVVGIPASKKSERLATELGIPLTTFATYQNVDIAIDGTDEIDDQLYLVKGGGGSLVREKMIDLVAETFIVIASGKKKIKKLGSFPVPVEVVPFGWQATEQRLQQFGCQTNLRMVEEDIFVSDNQNYIIDCDFKEIDDAEALHRSLKQIVGVIETGIFINMVDKAIVADNGELSILEK

SEQ ID NO: 12602 - protein, 528 aa, Prochlorococcus marinus str. NATL2A
MTKVLVSDPIDQAGIDILTQVAQVDQKVGLSPDQLKNIIGEYDGLMIRSGTQVTSDVISEAKKLRIIGRAGVGVDNVDVPTATRKGVLVVNSPGGNTIAAAEHALAMMLALSRNIPQANGSMFAGGWDRKKYVGNELYKKTLGVVGLGKIGSHVAKVANAMGMEVIGFDPFVSNERAQQMQVRLSDIEELFKESDYVTLHLPRTPETENLVDIDLLRKMKPTARLVNCARGGIINENDLANALAENVIQGAAIDVYAKEPLAENSPLRAVKKGLVLTPHLGASTVEAQQNVAIDVAEQIRDVLLGLPARSAVNIPGLSAEIMDSLKPHLKLAETLGLLVSQISGGQIQKLEVRLQGEFAQHPSQPLVIATLKGLLTSALGDKINYVNASLEAKGRGIDVVEIKDELCPEFARGSLQLDSFSDKGGHSVSGTVFGDGDLGITSIDEYPINFVPSRHMLFTRHRDMPGIIGQIGSLLGKYNVNIASMQVGRRIVRGEAVMVLSIDDPIPSELLGSILSMQGINEAHSVTL

SEQ ID NO: 12603 - protein, 189 aa, Zea mays
MCFVEKLLLVSVRDAEVQPFLPQDTGDETDVRKESPRYPGKPAPAAACLQSSLPYISTRPPHLHPKQANTQHNQPPHSISHHSQVQRSPTRARLQASNSNPRRQIRSQMAAAAKASWMVAMSVGAVEALKDQAGLCRWNYALRSVHRAAKANAPSFAQARKKLAPPAADKAAAEEGMRTVMYLSCWGPN

SEQ ID NO: 12604 - protein, 480 aa, Pseudomonas putida KT2440
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAEKLAAAVAKLKIGNGLEEGTTTGPLIDGKAVAKVQEHIEDAVSKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 12605 - protein, 141 aa, Thiomicrospira crunogena XCL-2
MLERTFSIIKPDAVKRNLIGQIVSKLEQNGLKVIASKMVFLTVQEAKGFYAEHDGKPFFDTLIKNMTAGPIVVQVLEGDDAIAKNREIMGPTDPENAPAGSIRKEYAISMQQNSVHGSDSPESAQREISYFFSEIEVFSAS

SEQ ID NO: 12606 - protein, 587 aa, Pseudomonas fluorescens PfO-1
MHAISFIQDLAVIMLVAGVVTVLFHRFKQPVVLGYIVAGFIIGPHTPPFGLIHDEETIKTLAELGVIFLMFCLGLEFSLRKLFKVGATAFIAAFLEIVLMIWIGYEIGRWFDWNTMDSLFLGAILAISSTTIIVKALNDLKMKNERFAQLIFGVLIVEDILGIGIIALLSSIAVSGTVSSGEVFSTVGKLSLFMIVALVVGILLVPRLLAYVARFESNEMLLITVLGLCFGFCLLVVKLEYSMVLGAFLIGAIMAESRQLLKIERLIEPVRDLFSAIFFVAIGLMLDPMILLQYAWPIAVITVAVVLGKMLSCGLGAFIAGNDGRTSLRVGMGLSQIGEFSFIIAALGMTLQVTSNFLYPVAVAVSVITTLLTPYLIRAADPLSIKLSAAMPQRLGRVFGMYGEWLRSIQPQGEGAMLASMIRRILLQVGVNLALVIAIFFAGAFFAGRLSIWMQEWISDPSWQKALIWGGALLVSLPFLIAAYRKLKALSMLLAEMGVKPEMAGRHTQRVRRVIAEVIPIISLLVIFLLLAALSASILPTNKLLVLIAVVAAAVAALLWRWFIRVHTRMQVALLETLDNHKESSGH

SEQ ID NO: 12607 - protein, 333 aa, Buchnera aphidicola str. Bp (Baizongia pistaciae)
MTIKIGINGFGRIGRVLFRLAQLRSNIEILAINDLINVQYIAYMLKYDSIHGNFNGKIVIKNETLFVNGKKIRITNEKDPKNLMWGDLNIDVVIESTGIFLTTEDSYKHIQAGAKKVIITSPPKDNTPMFVRGVNFNEYVGQKIVSNASCTTNCLAPLAKVINDEFEIVEGLMTTVHATTATQKTVDGVSYKDWRGGRSALQNIIPSTTGAARAVGKVLPELNGKLTGIAFRIPTANVSVVDLTVRNKKIATYEDICQIIKYASNHDMKEVIGYTEDHVVSSDFNGNTLTSIFDAKAGLSLNNNFIKLVSWYDNECGYSSKVLDLSEFISTFS

SEQ ID NO: 12608 - protein, 263 aa, Photorhabdus luminescens subsp. laumondii TTO1
MKPMTMTDLNQLKKEKRKFATITAYDASFAHLFAEQGIDVMLVGDSLGMTVQGADTTIPVTVEDIVYHTRCVRAGTPYTFIIADMPFMSYATPEQSCENAAKLMRAGANMVKLEGGSWLYDTINMLTERSVPVCAHLGLTPQSVHILGGYKVQGRDEVSANQLIKDAITLEKAGIQLLVLECVPVDLAKRITDELQIPVIGIGAGNVTDGQVLVMHDTLGITVSPPKFVKNFLEEAGNIRDAIRLYKEQVESGIYPGKEHSFY

SEQ ID NO: 12609 - protein, 226 aa, Chlamydia muridarum Nigg
MTLLILLRHGQSVWNQKNLFTGWVDIPLSQQGIQEALTAGEAIKNLPIDCIFTSTLVRSLMTALLAMTNHSSKKIPYIIHEERPDMSRIHSEKELEQMIPLFQSSALNERMYGELQGKNKQEVAEQFGEEQVRLWRRSYKIAPPQGESLFDTAQRTLPYFQKRIFPLIQQGKNIFISAHGNSLRSLIMDLEKLTEEEVLSLELPTGKPIVYEWTEQKFTKSALSFG

SEQ ID NO: 12610 - protein, 965 aa, Psychrobacter arcticus 273-4
MTISQNPTLDTFKGLFNEAEFVYRHLGSNDAKQADLLSAIGYKDMATFINDTVPEPVRLHKELDLPVAMSEHAALAKLRTMADDITVNKSYIGQGYSPVRMPAVIQRNVLENPGWYTAYTPYQAEIAQGRLEALLNFQQVCIDLTGLELAGASLLDEATAAAEAMAMSKRVSKSKSMQFFVDDRVYSQTLDVINTRAKYFGWEVVVGDFELAKSGDYFGALFQYVGVEGDVKDLTDVIAAVKKNKTYVNVVSDIMSLVLLKSPADMGADVALGSTQRFGIPMGFGGPHAAYFAFSDKAKRSAPGRIIGVSKDSQGNTALRMALQTREQHIRREKANSNICTSQVLLANLAGMYAVYHGPGGVKRIATRIHAFATAFADVIKNANDSNLNVVHDQFFDSVVIDCGSEKLATQIFENADNVGYNLWRLGDSKLSVAFSETSDQEDFKILTQLFVTKAHDLPEDARISLDSTHLRTDDILTHPVFNSHHTEHEMLRYLKSLEDKDLAMNRSMISLGSCTMKLNATSEMLPITWPEFANVHPFAPRDQVTGYVAMIDSLQEQLKAITGFDDVSMQPNSGASGEYAGLLAIRRYHESLGETDRDVCLIPMSAHGTNPATAMMMGMKVVVVKTDDNGNVDIDDLTAKSEEHSARLGALMITYPSTHGVFEEGIRKICDLIHKHGGQVYMDGANMNAQVGMMQPADVGADVLHMNLHKTFCIPHGGGGPGMGPIGMKSHLAPFMANHTLSPVHNAQKDCSAVSAAPYGSASILPISWMYIAMMGRDGLLKATELALLNANYVAAELKDYYPVLYTGKNGRVAHECIIDIRPLKEETGISESDIAKRLMDYGFHSPTMSFPVAGTLMIEPTESESKEELDRFISALKSIKAEAMKAKAGEDNWTLENNPLVNAPHTAAMVIDGEWTYPYSRETAAFPLPYIRTNKFWPSVARVDDAYGDKNLMCSCPSIENYM

SEQ ID NO: 12611 - protein, 576 aa, Vibrio angustum S14
MAQPNQNQEKLVWWKEATAYQIYPRSFYDSNADGIGDIPGIIKKLDYLADLGIDLVWICPFYQSPNDDNGYDISDYQAIHPDFGCLDDVDRLIREAHKRGIKIIIDLVINHTSDEHPWFIESRQNRNSAKRDWYIWRDGSEAITEKPTNEPNNWESIFHGSAWQYDAETAQYYLHLFSSKQPDLNWENPEVKAALFSMIHWWLERGIDGFRVDAISHIKKQANLPSLPNPNGDNYVSSFKYHMNVKGIEEHLHELRDKAFSPFDIVTVGEANGVAAEDALTWVAEETATNKAGVFNMIFQFEHMNLWSEDSNQSSFNLVKFKQILTRWQNALEGMGWNALYLENHDQARSINTFGNPNYRYASATALATCYFLMKGTPFIYQGQELGLVNFHFTSLDQFDDISARNLINKLKHQGKSDQYILSLLNRVSRDHSRLPMPWNSEENGGFSTVTPWITVNPNYERINVSEQLNNQNSVLQFYKQLIELRKQHKSLIIGRYKLILADDPNVYAYQRVSDDCTWTIITNLSDNVAKVNIDCSALGDLILDNQTKNNEIAKTNFEKTGLASAYGAYVFMTKH

SEQ ID NO: 12612 - protein, 409 aa, Thiomicrospira crunogena XCL-2
MNDKSLAKDKIKILLLEGLHQSAVEVFNENGYNNIEYVKGSLSDKDLKEKIADVHFVGIRSRTNLTEDVFKVAKKLVGVGCFCIGTNQVDLKAAQKRGIPVFNAPFSNTRSVAELVLGEILLLLRDIPAKNAKVHRGEWDKSATGSVEARGKTLGIVGYGHIGIQLSIMAENIGMKVRFHDIETKLPLSNASQVKSLEELLKISDIVSLHVPETEETQNMMGAEQFALMKKGSIFINAARGTVVDVNALADAIKSGHLSGAAVDVFPVEPKSNNEEFVSPLRGLDNVILTPHIGGSTEEAQENIGQEVATKLVRYSDTGTTLSAKNFPEVSLPEHKDRSRLLHIHKNQPGIMTKINEAFAHKGINVAAQYLQTNAEIGYVVIDINSEDREAGLKELKAIEGTIRTRVLH

SEQ ID NO: 12613 - protein, 467 aa, Coccidioides immitis RS
MLNLTNVLLIPPAAGALHVGYRYLQSYLEAERVRKLENTEDPPKAPNQGIFGINVYRDMARHKEEHVFLQKNLERYDELGDTYTSDMFGRTYIDTRDPENIKAILSTQFEQFSLGDSRLDAFYPMLGEGIFTHVYGGGPKGEPWRHSRAVLRPQFARHQIQDLAKLEDLLPDSPPKETQFYHDFTRGTEICMLRTLLGDLYFLQKDSSEFKRVSAFVQEYIDRFTHKALELHAAGKPTSYDSNGKYVFLEEISKSIRDPVRLRSELLNILLAGRDTTASLLSACFHQLARHKDVWDELRKEIMDNVGDRLPTYEDIKSLRYLRYVLNETLRLFPVVPWNGRQAVVTTTLPRGGGPDGKNKILVKKGTFVLYSTWGLHRSKFYGEDTNEFRPSRWETIRPGWNYIPFNGGPRICLGQQYALVEASYVITRLLQVFKDIENRDPVLPFVEHTTLTLSSEHGAKVALTPA

SEQ ID NO: 12614 - protein, 485 aa, Agrobacterium tumefaciens str. C58
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 12615 - protein, 613 aa, Acinetobacter sp. ADP1
MSEEAHSISLLAPVVLLTAAVIAVPLFKRIGLGSVLGYLIAGLVIGPFGLAFFSDSASILHIAELGIVMYLFIIGLEMQPSHLWGLRREIFGLGTFQIVVCALGLTATGMLFGFSWQIAFIAAAGFVLTSTAIVMQLLGDRGDITQPRGQKIVAILLFEDLLIVPLLAIVAFMAPNQVVESTTSRFENIGIGLLAIAGLIAAGFWLLNPLFRLLAASKAREVMTAAALLVVLGAALLMQVSGLSMAMGAFLAGVLLSESTFRHQIEADIEPFRGILLGLFFLGVGMSLDLKVVAQNWPLILSSVVAFMFVKALMIYIVARTTKSSHQEALDRALLMAQGGEFAFVLFAAATSAQVIDSTIKSNLTAIVVLSMVLTPIIGILFGRFTKSSKQVSLENVDIAENLKGNVLLIGFGRFGQVASQLLLARGVDVTIIDTDIDMIQNAEKFGFKIYYGDGSRLDILHASGADQAEAILVCVDQKEMTNKIVDLVQHEFPLAKLLVRSYDREHSLYLVKQNVDYIMRETFESAIKFGGAVLEELGVDEQEIRQITREIRERDEERYETEIAADDVYAGGGLQYTNQHPRPTAPLIQPKQSAKILNDKDTQDLLDKDEQP

SEQ ID NO: 12616 - protein, 453 aa, Sinorhizobium meliloti 1021
MLVQATNRLRQASARSRSKHLFDRAKGVFTDGTTRASVERDPFPIYAQRGEGAYLVDVDGNRLLDLNNNFTTLIHGHGFAHVSEAVVDLLRLGTCFANPTEHEIALAELLTARIPAMERVRFVNSGTEAVMFAIKAARAFTARPAIARIEGAYHGAYDWAEAGQGVSPGKDGWDPIPIPTPTYRGTPSSVADEVHLLRFNDVEGLERRLSAASDRIACVLIDPMPSRAGLLHPEPTFIEALSETAHKYGILIVADEVLNLRQGYAGASPRYGLKPDLVTAGKIIGGGFPIGAIGGREEVMRVFGTENARPLLPQGGTFSANPVSMAAGLAAMEAMTPDAFDRLEAMGERLRAGLRASIASRDARFSVTGAASLFRIHPKRVAPLEYRDAHLSAEEAWIMRTMSRYFLEAGILLPYGAAACLSTPMVHSDIDRILSAFDEFLEAKIGPEKERAK

SEQ ID NO: 12617 - protein, 477 aa, Mycobacterium tuberculosis
TEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 12618 - protein, 305 aa, Methylobacillus flagellatus KT
MAIQWFPGHMTSARKKAEETMEFTDVVIEVLDARVPEASHNPMIEELRLHRQRPSLKILNKADLADPAVTQAWLNHFNRQDGIKAVALSCKKPGDAKKIPDLCRSLAPHRGSHLKPLRMMIMGIPNVGKSTLMNALLNRRIAKVGDEPAVTKSQQRFELSPQLTITDTPGMMWPKIKYDSDGYMLAASHAIGRNAVIDEEVAEFLAGILLERYPALLQSRYKIDVSNMDAIDLLEAIGKRRGYLLKGGALDMEKTAMAFLVDYRSGTLGRISLETPESRAAMMTEALARQKAREESQEEKTKTEP

SEQ ID NO: 12619 - protein, 527 aa, Candida glabrata CBS 138
MSKDHEVVPLLYDNDLEVGSYESLPREEKYLDEHEVPQGRHLGIFSTTVLFISRMVGSGIFSTPSNIFVSCGGNSFIFFTVWLLTALFAYAGLYIFLEFGYHLPRSGGRKVFLEHSFTHPKLLMSVTVACYSIFSGVALSGSVVFGKYFLAAIGYGSETYNAGNTSKYISIGFVVLATAIHGISVRSGIYIQNALGVVKLMLILMMCLTGFYAIMIYDAPTVTQWDSPFFSFQDKSAFSLNSLASAFISAFFCFAGWDSVHSVTSEVKNPARTLKISGLCSLAICALCYTLMNVAYTKVLSYEEIANAGPLVGSVLFKKLFGAQVGGALMTGSVAVSAASNVIVVIYGISRVNQEIFREGYLPFSKVLARNWPWDAPLFSLLTCALLTCTWIIILPSEGSSFNYLISVEGYGNQVFLLLVAVGLLLFRRQKTYQEHDNSIKASTLGVYSMILLCTYLVVGPFFGDQSANKIAFLPPYEVASVAILLSCVLFWFVKFIMLPFLFNYRLVSKTTTLSDGLRITEWKAYY

SEQ ID NO: 12620 - protein, 482 aa, Acinetobacter sp. ADP1
MIQESLQYLLKHPDISFTAPTSGAVIEVNDAAKGTPLAWVKSHDRSGVEAAIQRSAQAQAKWKTQTALQRADVLWAWFHLINEHKENLAQILTAEQGKPLAEARGEIGYAASFIRWFAEQARRIDGEILPPTMAHQRLLVIKQAIGVTAAITPWNFPAAMITRKAAPAIAAGCSMLVKPAELTPLTAYALEVLALQAGLPQDILINISGDSVEVGKTLCESDVVRKLSFTGSTPVGRILMQQSAPSIKKLSLELGGNAPVLVFDDANLDQAVQGIMASKFRNSGQTCVCANRIYVQSGIYDALTTKLVDAVKALKVGDGREEGVTQGPLIDARAVAKVQSHIEDATSKGATLQTGGQLAAQGGTFFEPTVLSGVTQEMRVAKEETFGPLAALFRFETEEQAIAMANDTEFGLAAYLFTQSTARQWRVGEALEYGMVGVNTGAISNEVAPFGGVKQSGLGREGSQHGIEEYLEMKYLCVDLSE

SEQ ID NO: 12621 - protein, 570 aa, Triticum aestivum
MRSLLGEERSFIIESDDDDEEDPAHRGDGVGHGDDGSSSDSSSCATPRGGGGGGGDSQPNSYTNQWPQSYRQSIDILSNVQSPSLGFLGTPTLSRLSNSFLNSSFLNNSFRGKTPEIVSNLVKPLIRPTTSDEQQQQQQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAT

SEQ ID NO: 12622 - protein, 479 aa, Acinetobacter sp. ADP1
MAAPKNVSESGHSEGLKSGLQSRHLTMISIAGVIGGALFVGSGSVIYSAGPAAILAYTLGGLLVLLIMRMLGEMAVMNPDSGSFSTYADRAIGRWAGFSIGWLYWCFWTLLMGWEAYVAGKILNSWFPFIPIWGYMLLVIVGLVWVNLQDVKNYGEFEFWFALIKVVAIVMFLVVGSLAIMHLWPWGDPSAAGFTNLTAQGFMPGGFSSVITALLGVMFAYMGAEIVTVAAAESKDPAKEIRKASNSIVWRIILFYVGSMFITVCLIPHNNPLLKDPTWGTYSVTLSTLGIPEARHIVNFVVLTSVCSCFNSALYTCSRMMFSLSKRGDAPKIFAKTNRNSSPWAGVIFSSIFSIVAVYLTATESMNVYDVLMLATGTVALYVYLAVAFSQLRMRKKIEAEGKAVDFKMWLFPWLTYAVIITIIGAIITMLIEGTYFKEVTYTTGLALVIVILGILTHKFNWGKDAREKMLEQSKKSMT

SEQ ID NO: 12623 - protein, 447 aa, Brassica napus
  misc_feature (190)..(190): Xaa can be any naturally occurring amino acid
  unsure (1)..(447): unsure at all Xaa locations
VDPRVRHRIDGGSFNFDGDLMEALFGYVGARKPGEANTVPQKPTVSTTQTYILDPRKSQNKAIVLKSLGMTKEEIIDLLTEGHDADTDTLEKLSGIAPTPEEQTEIIDFSGDPTKLADAESLLFHILRAVPSAFNRFNVMLFKINYGSEVAQQKGSLQTLESACNELRARGLFMKLLEAILQAGNRMNAXGTARGNAQAFNLTALRKLSDVKSVDGKTTLLHFVVEEVVRSEGKRAAMNKISGENTGGDIADASREEQEIEFIKLGLPIIGALSSEFTNVKKAAGVDYDSFLATTLALGTRLKETKRLLDQSKGKEDGCLTKLRSFFESAEEELRVITEEQLRIMDLVKKTTNYYQAGGALKERNLFQLFVIIRDFLGMVDTACSEIARNQRKQRPAATVAGASSSTAATTPSAAAPQRNAVRFPILPPNFMSEHSRYSSSDSDSDS

SEQ ID NO: 12624 - protein, 142 aa, Glycine max
MASSFVGTLLPNKFTQNKHLSSVPASRGAPTRRRVHLATTRAESMTTVIEKLGIKIERNPPESKLTQLGVRQWPKWGCPPSKFPWTYEAKETCYLLEGKVKVFPSGSNESVEIAAGDLVVFPKGMSCTWDVSVGVDKHYNFE

SEQ ID NO: 12625 - protein, 289 aa, Brassica napus
MSLFDTHNTWAFVFGLMGNVISFSVFLSPVPTFYRVWKKKTTEGFQSLPYVVALFSATLWLYYATQKKDVFLLVTINSFGCFIETIYISIFLAYAPKKARMLTVKLLLLMNFGGFCLILLLCQFLAKGTTRAKIIGGICVGFSVCVFAAPLSIIRTVIKTRSVEYMPFSLSLTLTISAVVWLLYGLALKDIYVAFPNVIGFALGALQMILYVVYKYCKTPPHLGEKEVEAAKLPEVTLDMLKLGTVSSPETITAVRQANKCTCGNDRRAEIEDGQNAKNGKQSSSATAT

SEQ ID NO: 12626 - protein, 393 aa, Methanosarcina mazei Go1
MRPPCDPSKFIAEAVKSIPPSGIRRFFDLVSGLEDIISLGVGEPDFITPWHIREMCIHSLEKGQTSYTSNSGLPELRDELTRTYYRRYGLDYNPESEILITTGVSEALDIAIRAVVNPGDEVIVVQPSYVAYVPSVIMAGGKPVIVSTHRDDDFSLTAEVLEPAITSKTKAIVLNFPNNPTGAIMQKEGMEDIADLVVENDLFLISDEVYECLTYEGTHVPFSSLEGMKDRTVMLNGFSKAYAMTGLRLGFAMGAPDIIHSMMMIHQYCMLCAPITAQVGAIEALRNGKGEMERMVREYDRRRHFIVNGFNRIGLECCNPKGAFYAFPYIGDTGLSSSDFAERLLNEKKIVTIPGDVFGEAGEGFLRCAYAASLDDIKKAIERMGDFVDGLKQ

SEQ ID NO: 12627 - protein, 454 aa, Burkholderia pseudomallei K96243
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERAIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQIAMRRRLGAAEVAALKFKVPFWPVGPALTIAFMAFVIAMLGYFDDTRVALFVGAAWLAILALVFYTRIRPRLAAVAR

SEQ ID NO: 12628 - protein, 232 aa, Buchnera aphidicola str. Bp (Baizongia pistaciae)
MKVYKLVLMRHGESIWNELNKFTGWHDVDLSNRGVQESLKAAKLLKKHGFYFDYAYSSVLKRSIHTLWNIIKFLDQSWIPVKKSWRLNERHYGALEGLNKDDVIQKYGNDKVQQWRRSFNIAPPKISYLEKKKLAHDSRYNNINFDILPYCESLKLTTQRVLPYWLNEIFPRFQKNTKIIIVAHGNSLRALIKYLNNINDIDILNLNIATGFPIIYEFNSEFKPIQYYYLKQ

SEQ ID NO: 12629 - protein, 252 aa, Buchnera aphidicola str. Bp (Baizongia pistaciae)
MKKKIIIANWKLNGNIQLLQTLLKPLVNFYIRHKNKSSIKLVIMPPYVYLYPMKSIISHSSILLGSQNVDINLIGAFTGEVSINMLKDVGVSYVLVGHSERRQYHRENDVIIAKKFKIVKDSHLIPVLCIGETEHEYLSCKTEKICKFQIDAIFDLLGPSGFNNSVIAYEPKWAIGTNTIPSINFIQKILMFIQNYIFNKQNSTIKLFSLQYGGSVNEHNIIELYDVKNIDGFLVGSASLSLDFFKKLLNNC

SEQ ID NO: 12630 - protein, 424 aa, Chlamydia muridarum Nigg
MVTCEAGIASVQQAIKDIADGNFVIVIDRESRENEGDLILAGEKVSAEKMAFLLSHTTGIVCASVTREQARVLDLPAMVQENQCAFKTAFTVSVDASSGITTGVSAADRTRTVQLLSDPTSISQSFVRPGHVFPLVSQPGGVVKRPGHTEASMDLMRLAGMYPCGIFAELVNADHSMMRQQQILDFAEQHGFTVITVDDLITYRWTFDSLVEHVSSARIPTKYGEFFIHVYKSIIDGTEHFALVKGDIREQESVPVRVHSECLTGDVLGSCRCDCGAQLDMAMRYIAEQGLGVIVYLRGQEGRGIGFGHKIQAYALQDLGYDTVEANLQLSFPIDAREYGVAAQILKDLRLTSVRLITHNPKKFFELQRLGIHILDRIVLPVIVSSENERYLRTKKDRMGHWLNFPVLNESEDEYETVERTSCC

SEQ ID NO: 12631 - protein, 188 aa, Oryza sativa (japonica cultivar-group)
MARRGTEAFPDLGAQCDREDCNQLDFLPFDCDGCGKTFCAEHRTYRDHGCARAADQGRTVVVCEACGDAIERRAGDGGGDDAAVLEAHARSRRCDPARKRKPRCPVPRCKETLTFSNTSGCKGCGQKVCLKHRFPADHACAGAGAGAASKAAGAAAAARSAGQCGRDAQKKEGGGWKLPQSVRNMKIF

SEQ ID NO: 12632 - protein, 502 aa, Zea mays
MTEVALLRGPTNLASTASRAPASPSPSPSSSSLRYLANADSDVLQGSGSPERTAGSAGSRRLLELRGQEAAEEEEERWSFLALLFELLRKSLLGCRTVGGGEGEHGGCGMEIGLPTDVQHVAHVTFDRFHGFLGLPVEFEPEVPRRAPSASASVFGVSTESMQCSYDSRGNSVPTILLMMQRRLYEQGGLQAEGIFRINAENSQEEFVRDQLNSGIVPDGIDVHCLAGLIKAWFREMPRGVLDPIPPEQVMQCQSEEDCARVAKCLPPAEAALLDWAVNLMADVVQEEQINKMNDRNIAMVFAPNMTQMADPLTALMYAVQVMNFLKMLVQKTLKDREESTPEDALLPQKDPSDENRHQKPTVTIDSLLEEGSRRPSFAKEEPLLNSPGHSTDDKSNETNTDLGATAAFTAQTSEVATGVEDSTSSGSQPAPAGPAAIADASGTTATNSLQAGKGSRSLNRRRTRKGKGQSGTRTTPAAEKSRGASIVSRINSRVERIEAWR

SEQ ID NO: 12633 - protein, 317 aa, Arabidopsis thaliana
  misc_feature (254)..(254): Xaa can be any naturally occurring amino acid
  unsure (1)..(317): unsure at all Xaa locations
MWPFWWKGASGFSARSTAEEVTHGIDGTGLTAIVTGASSGIGEETTRVLALRGVHVVMAVRNTDSGNQVRDKILKEIPQAKIDVMKLDLSSMASVRSFASEYQSLDLPLNLLINNAGIMACPFLLSSDNIELQFATNHLGHFLLTNLLLERMKKTASESNREGRIVIVSSEGHRFAYREGVQFDKINDEASYNTLQAYGQSKLGNILHATELARLFKEQGVNITANSLHPGSIMTNLLRYHSFINTIGNAVGKXVLKSIPQGAATTCYAALHPQAKGVSGEYLMDNNISDPNSQGKGKDLAKKLWEFSLRLTGEEES

SEQ ID NO: 12634 - protein, 488 aa, Psychrobacter arcticus 273-4
MLKTTLNLSNPDLIKQQCLIKDGWYAANDEATIEVSNPFNGDVIGTVPSLTTADVNDAVTYSHEAQITWAAKTPQERAQLLQKWADLIDANKEDLAIIMTAEQGKPLAESRGEIGYANSFIRWFAEEGKRVYGDVIPATNSQLRYVVLKQPVGVCAAITPWNFPAAMITRKAAPALAAGCTIIIKPATETPFSALALGALAEQAGIPAGVIQVVTGKSSTIGDILTGDARIHKLSFTGSTEVGRTLMAQCAPTIKKLSLELGGNAPFIVFDDADLEKAADGLIASKYRNAGQTCVCANRVYVQDSIKDEFLGIFIKKVAELKVGNGMEEGVNVGPLINEKALQKVQALLKDALDKGATLIAGGSTNNASALAYNPTVITDISADMDIASEEIFGPIAPVFTFSSEEEVIRAANDTIYGLAAYFYSSDYARAWRVTEGLEYGMVGHNTGMLSTEVAPFGGVKQSGFGREGSKYGIEEYVVTKYWCSDVS

SEQ ID NO: 12635 - protein, 395 aa, Pseudomonas fluorescens PfO-1
MLAQLPPALQNLQLPLRLRLWDGHEFNLGPTPSVTIVVKDPLMVSQLTHPSLDALGAAFVEGKLELEGSISEVIRVCDELSSALLDEDDDSQPVRTLHDKETDAKAISYHYDLSNAFYQLWLDSDMAYSCAYFETGSESLEQAQQAKFRHLCRKLRLQPGDYLLDVGCGWGGLARYAAREFGAKVFGITLSKEQLALARERVKAEGLEDQIELQLLDYRDLPQDGRFDKVVSVGMFEHVGHANLAEYCKTLFGAVKEGGLVMNHGITAKHTDGRPVGRGAGDFIEKYVFPNGELPHLAMISAEISEAGLEIVDVESLRLHYARTLDHWSERLEDNLEAAAKLVPDQALRIWRLYLAGCAYAFARGWINLHQILAVKAHADGSHELPWTRDDIYNP

SEQ ID NO: 12636 - protein, 394 aa, Oryza sativa
MASSNVSTVYISVIDDVISKVRDDFISYGVGDAVLNELQALWEMKMLHCGAISGTIDRSKAAPAPSAGTPGAGTTPPVHDLNVPYEATSEEYATPTADMLFPPTPLQTPIQTPLPGTDAGMYNIPTGPSDYAPSPISDVRNGMAMNGADPKTGRPSPYMPPPSPWMTQRPLGVDVNVAYVENREDPDRTGQPPQLTKDFLMMSSGKRKRDEYPGQLPSGSFVPQQDGSADQIVEFVVSKDNAQQLWSSIVNKQGTATKESSTKETIIAPTIPQRDGMDDYNDPFYFQGVPTEDYNTPGESSEYRAPTPAVGTPKPRNDVGDDDEPPLNEDDDDDDELDDLEQGEDEPNTQHLVLAQFDKVTRTKNRWKCTLKDGIMHLNGRDVLFNKATGEFDF

SEQ ID NO: 12637 - protein, 428 aa, Oceanobacillus iheyensis HTE831
MTLNQSIDAYKEAVDLMPGGVNSPVRAFKSVGMNPIFMKEGKGSKIVDIDNNEYIDYVLSWGPLILGHSDERVVKKLQDITAKGTSFGAPTLLENDLAKLVIDRVPSIEMVRMVNSGTEATMSAIRLARGYTDRDLILKFEGSYHGHGDSLLIKAGSGVATLGLPDSPGVPENIAKNTITVPYNDTDSLKLAFENYGDRIAAIIMEPVCGNMGVVPPKDGFLQYVRHITEENGSLLIFDEVMTGFRVGYHCAQGHYDVTPDLTCLGKVIGGGLPVGAYGGKREIMEQIAPTGPIYQAGTLSGNPLAMTAGYETLSSLSEESYEDINNKVDTLVNGFRDAADKFDIPIHINRAGSMVGVFFTDEEVINFETAQTSNLDYFAQYYRSMVNEGIFLPPSQFEGLFLSTAHTDDDIEKTVKAIHKAFEQIEK

SEQ ID NO: 12638 - protein, 758 aa, Streptococcus mutans UA159
MTQKTKQFSKYVQEKTGQNLEQLSNEAIYVQLLHFVKEAAKDMPKNTSKRKVYYISAEFLIGKLLSNNLINLGLYKTVKDELAAAGKSISQVEDVELEPSLGNGGLGRLASCFIDSMATLGINGEGVGLNYHCGLFKQVFRDNQQEAEPNYWIEDDSWLVPTAISYDVPFRDFTLKSKLDRIDILGYHKDSKNYLNLFDIDGLDYGLIKDGITFDKTEIKKNLTLFLYPDDSDKNGELLRIYQQYFMVSNAAQLLIDEALERGSNLHDLADYAYVQINDTHPSMVIPELIRLLNEKHGLDFYEAVDIVKNMIGYTNHTILAEALEKWPLEYLNEVVPHLVTIIEHLDRIVRSQYKDDAVQIIDRDDRVHMAHMDIHFSTSVNGVAALHTDILKNSELKPFYDIYPEKFNNKTNGITFRRWLEFANQDLAAYIKELIGEGYLEDATELEKLLAFADDKTVHEQLAKIKFNNKLALKRYLKENKGINLDENSIIDTQIKRFHEYKRQQMNALYVIYKYLEIKKGNLPKRKITVIFGGKAAPAYTIAQDIIHLILCLSELINNDPDVSPYLNVFLVENYNVTVAEKLIPATDISEQISLASKEASGTGNMKFMLNGALTLGTMDGANVEIAELVGSDNIYIFGKDSDTIIDLYDKGTYVSKDYYTNNAVIKEAVDFIVSKDVLALGKKERLERLYHELINKDWFMTLIDLKEYIAKKEEMLADYEDQNVWNKKVIQNIAKAGFFSSDRTIQQYDKDIWHSL

SEQ ID NO: 12639 - protein, 381 aa, Streptococcus pneumoniae TIGR4
MDLTKRFNKQLDKIQVSLIRQFDQAISEIPGVLRLTLGEPDFTTPDHVKEAGKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKICSEEGRCLYPWCSLWTLRGRLRPPILCSQHGDYQRSHETT

SEQ ID NO: 12640 - protein, 152 aa, Synechococcus sp. WH 7805
MASERTFIAIKPDGVQRGLIGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETAQFEIGLWFQASELSDWTPSDQGWRTEG

SEQ ID NO: 12641 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPVNFNGLSKAVKKGDTIFIGKYLFTGSETASVWLEVSEVKGEDVTCLVKNTATLSGSLFTAHVSQIHIDLPTLADKDKEVISTWGVQNNIDFLSLYTRHVEDIRHAREFLSKLGDLKQTHIYAKIENIEGLKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPIMPVISVVIPQLKTNQLRWTFTGAFEARQSLIVRGLFPMLADPRHPAESKSGTNESILKVALDHGKAFGIIKPHDRVVVCQKVADSSVVKILELED

SEQ ID NO: 12642 - protein, 94 aa, Triticum aestivum
MPSLQKALPPELADNALRLYRECLRRAKFIGSQQHNTGLLVSMVRQQFKKNMHETDPEKIQKMKDDAARGLINHIIYESEKMTGRKSQVKKVEK

SEQ ID NO: 12643 - protein, 503 aa, Atriplex nummularia
MAASAMGVNEEREVFKKYWVEHSVDLTVEAMMLDSQASDLDKEERPEVLSMLPPYEGKSVLELGAGIGRFTGELAEKAGQVIALDFIESVIKKNECINGHYKNVKFMCADVTSPSLNISPNSVDIIFSNWLLMYLSDEEVERLVERMLKWLKPGGYIFFRESCFHQSGDHKRKSNPTHYREPRFYTKVFKECHMTDESGNSYELSLIRCKCIGAYVRCKCIGAYVRSKKNQNQISWLWQKVDSEDDKGFQKFLDSSQYKFNSILRYERVFGPGYVSTGGVETTKEFVSKLDLKPGQKVLDVGCGIGGGDFYMAENYDVEVVGIDLSINMISFALERSIGLKCAVEFEVADCTKKDYPENSFDVIYSRDTILHIQDKPALFRSFLKWLKPGGKVLISDYCKSAVPPSSEFAAYIKQRGYDLHDVKAYGQMLKDAGFIEVIAEDRTDQFIKVLQRELDALETEKDEFIADFSEQDYNDIVDGWKAKLVRTKGDEQRWGLFIAKKK

SEQ ID NO: 12644 - protein, 404 aa, Vibrio vulnificus CMCP6
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 12645 - protein, 501 aa, Streptococcus pneumoniae R6
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 12646 - protein, 516 aa, Saccharophagus degradans 2-40
MSEVKKPLALIILDGFGYSESDKYNAINAAKAPTWRKIWAENPKTTIATSGMAVGLPEGQMGNSEVGHMTLGAGRVVYQNFTRINKAIADGDFYTNPVYTKAVDDAQSQGKAVHVIGLLSDGGVHSHEDHMIAMMELAVKRGAEKVYMHAFLDGRDTPPRSAKAPLQKTEEKLKALGGGKIASIIGRFFALDRDNRWDRVQQAFDLMVDGKAAFTAQSATAGLEAAYERDENDEFVKATAIVDADGKPVTIEDGDAVIFMNFRPDRARQLTNAFVDKNFDGFARARVPALSDFVMTTEYSADIDTSCAYPPEDLVNSFGEVMAKNGKKQLRIAETEKYAHVTFFFSGGQESLYEGEDRILVPSPQVETYDEQPEMSAPEVTAKLVDAIENGGYDAIICNYANCDQVGHTGDFDASVKAVEAVDAALAEVFAALERVGGEALITADHGNVELMYDDEAQQLHTQHTTLPVPLVYVGKRDISLEQGGSLADIAPTMLALLDVPQPTEMNGRNLVKFSK

SEQ ID NO: 12647 - protein, 137 aa, Leptospira interrogans serovar Lai str. 56601
MSRTFIMIKPDGVKNKHVGNILSRIEKEGFKILGLKYLKLSLEDAKQFYKVHSARPFYNDLCNYMSSGPIVAAALERDNAVLHWREVIGATDPKEAAAGTIRALYAESKEANAVHGSDSDDNAALEISFFFKGNELF

SEQ ID NO: 12648 - protein, 206 aa, Bartonella henselae str. Houston-1
MERTLVLIRHGQSEWNLKNLFTGWKDPGLTEKGRTEAIAAGKKLKETGLKFDIAYTSALQRAQKTAQNILEQMEQSDLELIKTPALNERNYGDLSGLNKDEVRQKWGEQQVQIWRRSYTIAPPNGESLRDTGARVWPYYLHHIQPHILRSQTVLIAAHGNSLRALIMALEGLNSEEIISQELATGIPIVYTFNSDSTISSKTIITP

SEQ ID NO: 12649 - protein, 479 aa, Buchnera aphidicola str. Bp (Baizongia pistaciae)
MIRRFRRTKIVATLGPSTDNHIILENMIKSGVNVFRLNFSHGTREEHIYRAKLVTSIAKRLNCHIALLGDLQGPKIRICKFQDKKVFLKVNNYFILDANLNENLGTSERVGIDYKNLPKDVKKCDILLLDDGKIQLKVINIVDQEIFTKIIIGGVLSNNKGINKLGGGLSARILTKKDKRDIITSIDIGVDYLAVSFPRYGSDLDHARKCAVKFGSKAKIIAKIERAEAVKDLKIIDEIILASDAIMVARGDLGVEIGESELAGIQKTLIRRARQLNRVVITATQMMESMINNPMPTRAEVMDVANAVLDGSDAVMLSAETASGKYPIETIKVMSKVCMGAEKMPSINVSQHRIHDKFHDIEEAIAMSAMYAANHLSGITAIITMTESGKTSLMTSRITSGLPIFALSSHIQTLKLTALYRGVTPIFFNSSKEGVSAANEVINLLVKRGFLEPGNLVIITQGDIMGKVGKTNTSRILKV

SEQ ID NO: 12650 - protein, 388 aa, Mesorhizobium loti MAFF303099
MSLIDSFRAEARAAPESGIVAVVNYGRLREGLIPLWAGEGDLPTPAFITDAASKALAGGETFYTWQRGIPDLRQALARYYARHFGKTFPEEQFIVTGSGMHAIQMSLTALAGAGDEVIYLSPAWPNFDAAAALSGAVPVPVTLDHSGNGWSCDVEKIAAAITPRTRALFINTPSNPTGWTADHETLQAILDLARAKNVWIIADEIYSLFHYGHGRAPSFLDIATEEDRILFVNSFSKNWAMTGWRVGWIKTHPSLQQVFENLIQYSNSGVAQFMQRGAVAALDEGDGFVAEQVERARKARDLVCGILGATGRARFTVPQGAFYLFFTVDGITDSRTAAFDIVDKANVGLAPGTAFGPGGEAFLRLCFHRRLDQLEEAAHRLAKWMKSI

SEQ ID NO: 12651 - protein, 312 aa, Escherichia coli
FGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNK

SEQ ID NO: 12652 - protein, 146 aa, Triticum aestivum
METGAKAPKKAGTAGRRAGGGPKKKAVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAAAKEPKKAADA

SEQ ID NO: 12653 - protein, 577 aa, Silicibacter sp. TM1040
MATSFAARLSQLLTQIYPDLDTEILGSKVVEAFWPEGSHRRKRPRRPGNSLWSERDALLITYGNTMRDGAHKPLDLLHDFLLTYMKGVVNGVHILPFFPFTSDDGFAVTDYRKVNPELGDWADIRRIGGAFHLMSDMVLNHVSSQSAWFNAYRQGQPPYDRFFYEASPSDDLSAVVRPRTTPLLQEVETATGAKHVWCTFSHDQVDLNFENPEVLLEILRIIRLHIDQGVRIIRLDAVAFIWKEVGTSSIHLPQTHAIVQLLRLLADYATETVVLLTETNVPRAENLSYFGNRNEAHVVYNFPLPPLILHAMMAGSARYLLNWARAMPPAPLGCAYLNFTASHDGIGMRPAEGVLPQEEIDQMIACVRAVGGLVSMRALPGGGEAPYEVNCTYFDALGRTFDRGEARKVDRFICAQTIPMSLEGIPAFYIHAMLATANDHDAVARRGMNRAINRHRWDYGELKARLNDADSAQAQVMSALSERLRVRAEQPAFHPNATQFTLQLDDRVFALWRQSLDRAQSIFALHNVSGDGVILHPGALNLIEGETWRDLLSGDMFESDAEITLAPYQCRWITNQA

SEQ ID NO: 12654 - protein, 226 aa, Glycine max
KRLKDEKPSQLRRPPPHSNNRLEHIAWSYSSSIQSYEAFGDAVVFDTTYRVEAYDMLLGIWLGVDNNGMTCFFSCALLRDENIQSFSWALKAFLGFMKGKAPQTILTDHNMWLKEAIAVELPQTKHAFCIWHILSKFSDWFSLLLGSQYDEWKAEFHRLYNLEQVEDFEEGWRQMVDQYGLHANKHIISLYSLRTFWALPFLRHYFFAGLTSTCQSESINAFIQRF

SEQ ID NO: 12655 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 12656 - protein, 819 aa, Oryza sativa (japonica cultivar-group)
MPEAAAAAAGHMDPVGDEAAERREMEEKEEEEEEEEEDEEFYESLDRILSSSCSSTSASDDDDQQHRRRRRHHPQPQQLSSSATFSAYEVWISEPTSVEERRRVLLRRLGLAHDSEPLPHPSPRVSSSSPRSPTPSPPSSSPPRPAPVVAAAEEPRSSGHGKPPLARNPSGGAEQCRIRNLDDGTEFEVGEVHDEVVREVGTGRQLTFEEFELCIGRSPIVQELMRRATTAASSSTSDHAAPASKPRRKPGGWLRGIRHLAGSVAYGRSSTDERDKEKEKEKKEREARRLSSATDDSLDGNGSRNAGRVRVRQYGKACKELTGLFMTQELAAHSGSIWCINFSLDGRYLASAGEDRVIHVWEVSEGERKGELLGEGTVARENGGGCSPFLAAVGNGSPELATLSLSCADGGFVEKKRRPRMQSSRKSVGSDHLVVPECVFGFRDKPVCSLLGHAADVLDLSWSKSQYLLSSSMDKTVKLWDITTSTCLKTFSHTDYVTCIQFNPVDDNFFISGSLDEKVRIWNVHDRKIEDWNDLHEMVTAACYSPDGQVALVGSHKGSCHLFDTTEKKLQYKSQIELRIRKKKSGQKKITGFQFAPGSSSEVLITSADSRIRVVNGDELVHKFKGFRNTSSQISASVAPNGKYVVCASEDSHVYVWRHDNTSHPSRSRSAVDVTNSYEHFHCHDVTVAITWPGAESRGSFGSRSSRNSDSDDAVMNTGRDAPVENSEHDLNGTVNRCTKRPVCEGVASTSNPPADGVSTSWPDEKQSSAKSSPGHCSSDLCIGALDVQRRSAWGLVIVTAGRGGEIRVFQNFGFPVQV

SEQ ID NO: 12657 - protein, 202 aa, Brassica napus
FADNEELQSEWASAKAANKQRLAQYIERVTGVSIDTNSLFDIQVKRIHEYKRQLMNILGVIYRFKKLKEMKPEERKKTTPRTVMIGGKAFATYTNAKRIVKLVNDVGDVVNSDPEVNEYLKVVFVPNYNVTVAEMLIPRSELSQHISTAGMEASGTSNMKFALNGCLIIGTLDGANVEIREEIGEENFFLFGATADQVPRLR

SEQ ID NO: 12658 - protein, 500 aa, Coccidioides immitis RS
MAKQYELPFQLDDPSLLHFDSFVNNEWVTAADGNRFEVVDPGTGKPWATCPTSTAKDVPSTVEAAHAAFEEYKKMNPRQKAMLLMKWDELIREARSDLAKILTHETGKPIPEALAEIDYALGFTWWFAGEAERIHGSISTPAAPNRRVFTIKQPIGVAAALVPWNFPIAMVLRKASAAFAAGCTMIVKPSPETPISTLVLGHLAKKAGYPPGVFNVLTTDLDSTPSLSEALCKHPLVKKVTFTGSTRIGKLIASHCAHGLKKLTLELGGNCPFIVFDDANLDQAISQLMTLKWRHAGQACITANRIYVQSGIYDKFVQLFKERTAALVVGHGAKESTTMGPVTTPRTLEKAANQVEDARKLGGKVILGGKPKTDCGGGYFFEPTIITDMTQEMLISREETFAPIAAVYKFDTEEEAVKWANDTSMGLASYAFTKNVDRMWRMLENLEAGMIGMNTGNSSAAESPFGGIKESGYGKESGKDVAVNEYLITKTGTFTLEGQY

SEQ ID NO: 12659 - protein, 135 aa, Triticum aestivum
  misc_feature (132)..(132): Xaa can be any naturally occurring amino acid
  unsure (1)..(135): unsure at all Xaa locations
SADAWVCISDRLAGVSENAGRIQRHRLRRPQVPGKRHHLLEASRTLSRGALFRLLPPHILFPLFQARCITDVRADAGSTTFLAGTLSLKEENEVHLIRLLPGENELVCDGLFYHPNEIWDLKFCPFDHKLFXTVY

SEQ ID NO: 12660 - protein, 365 aa, Triticum aestivum
MGKGGKGEAAAAVAGEGENMAAWLVAKNTLKIMPFKLPPLGPYDVRVRMKAVGICGSDVHYLKEMRIAHFVVKEPMVIGHECAGIIEEVGDGVKHLAVGDRVALEPGISCWRCRHCKGGRYNLCDDMKFFATPPYHGSLADQIVHPGDLCFKLPDNVSLEEGAMCEPLSVGVHACRRADVGAEKSVLIMGAGPIGLVTMLSARAFGAPRIVIADVDDHRLSVAKSLGADAVVKVSGNTEDLAGEIERIQAAMGGDIDVSLDCAGFSKTMSTALEATRPGGRVCLVGMGHNEMTVPLTSAAIREVDVVGIFRYKDTWPLCLEFLRSGKIDVKPLITHRFGFSQGEVEEAFEVSARGRDAIKVMFNL

SEQ ID NO: 12661 - protein, 244 aa, Frankia sp. CcI3
MSAALVTGSNRGLGFATAQALARLGHRVLVTAREQAAADKAAADLTAQGFDADAIALDVTSPDSIAAATRRVAELPAGLDILVNNAGILPEATDGEQHEFASLDLFGKTYATNVFGPVAVTEALLPLLRRSPAGRIVNVSTTMGSLSDQANPASPYYGLIVPAYQSSKAALNSITISLAKKLADTPIKISSVCPGFVQTDLTPINREQAQLTADQAAQVVVRAATLPDDAPSGTFFDQNGIVAW

SEQ ID NO: 12662 - protein, 619 aa, Emericella nidulans
MRSIDQPLLTRLPSSGRAQTSQLPLTMYNAHRGMVPAPNSRLNELLDQLRQEFENQSRSTGEFEHQLTGQLQEMEMIRQKVYQLEQAQLKMKQDYEAEIRMLRHELESRGVQPVASHVAVPAQHGGPSQAPPPALGHGPSNLFGGIMANQGGSGPGLAPPPPQDQQPSQHTLQQPAAAAQPGAPQPPQSSFGGYQPWRCCYGPPPPPTASPGPGKRPRAPPGPATPQQAHQLAYPESRVSPQLARPTPPNQPVVRDRPGNMLANWNPEDLPPSQKKEGVDWYAVFNPEVQRVLDVELVHHLVHDSVVCCVRFSRDGKYLATGCNRSAQIFDVTLGQNVAVLQDESVDKSGDLYIRSVCFSPDGKYLATGAEDKQIRVWDIATRTIKHIFSGHEQDIYSLDFAGNGRYIASGSGDKTVRLWDIAEGKLVYTLSIEDGVTTVAMSPDGLYVAAGSLDKTVRVWDTTTGYLVERLENPDGHKDSVYSVAFAPNGKELVSGSLDKTIKLWELNLPRQQYNSAGKGGKCHRTFEGHKDFVLSVCLTPDGHWVMSGSKDRGVQFWDPITGNAQMMLQGHKNSVISVAPSPTGNLFATGSGDMRARIWRYASFPNPISLPKIWMLG

SEQ ID NO: 12663 - protein, 168 aa, Aspergillus oryzae
MRIGSMPRVSASTWTLYMHNNGAGELTGDVLMTGAWTIHFVLIIALKIFYDIIPGVSQETSWTLTNISYMFGSFLMFHWVRGIPFEFNAGAYDNLNMWEQIDNGDQYTPTKKFLLCVPICLFLLSTHYTHYDLTYFTINFLATLGVVIPKLPFSHRLRIGLFSPEPEE

SEQ ID NO: 12664 - protein, 261 aa, Lycopersicon esculentum
MASSKERESLVYIARLAEQAERYDEMVDAMKNVANLDVELTVEERNLLSVGYKNVVGSRRASWRILSSIEQKEDARGNEQNVKRIQGYRQKVESELTDICNNIMTVIDEHLIPSCTAGESTVFYYKMKGDYYRYLAEFKTGDDKKEVSDLSLKAYQTATTTAEAELPITHPIRLGLALNFSVFYYEIMNSPERACQLAKQVFDEAISELDSLNEDNYKDGTLILQLLRDNLTLWTSDIPEDGEEAPKGDAANKVGAGEDAE

SEQ ID NO: 12665 - protein, 261 aa, Lycopersicon esculentum
MASSKERENFVYVAKLAEQAERYDEMVEAMKNVANMDVELTVEERNLLSVGYKNVVGSRRASWRILSSIEQKEESRGNEQNVKRIKEYLQKVESELTNICNDIMVVIDQHLIPSCSAGESTVFYHKMKGDYYRYLAEFKAGNDKKEVAELSLKAYQAATTAAEAELAPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 12666 - protein, 91 aa, Prochlorococcus marinus str. NATL2A
MSILVTSPCTETTIQELVTKNWPIWTCDVSSFNWTYEDQETCLLLAGEVTVTPDGGEPVKFGAGDLVVFPAGMDCRWDVHKAVRKHYRFGD

SEQ ID NO: 12667 - protein, 377 aa, Bacillus anthracis str. 'Ames Ancestor'
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQVEYLKVPFGNFTPFVIPESCELEDESLLFLSDVLPTAYWSVINAGVKPGDTVIVLGCGPVGLMTQKFAWMHGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 12668 - protein, 346 aa, Bacillus licheniformis ATCC 14580
MDGNMKALIKKPGEPGASFELVPIPKIDKHEVLIKVKAASICGTDVHIYNWDEWAKSRVKPPYVFGHEFSGEVVQVGENVTTVKEGEYVSAETHIVCGKCLPCLTGKEHVCKKTLILGVDTDGCFAEYVKMPAANIWKNPAGMPEDLASIQEPLGNAVHTVLTGMTAGVKVAVVGCGPIGLMAVAVAKASGAAQVIAIDKNEYRLDLALQMGATDIISVEKEDPLKNVSALTNGEGADLVCEMSGHPTAIRQSLKMAANGGRVHVLSLPEHPVCIDMTNDIVFKGLTVQGITGRKMFETWRQVSGLLQSGTIQIKPVITHRFPMEEFEKGFELMRKGQCGKVVLIP

SEQ ID NO: 12669 - protein, 358 aa, Oryza sativa (japonica cultivar-group)
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIHLNAQGLARYAIICQENGLVPIVEPEILVDGPHDIDPCAYVSEVVLAACYKALNEHHVLLEGTLLKPNMVTPGSDAKKVSPEVIAEYTVRTLQRTVPAAVPAIVFLSGGQSKEEATRNLNAMNKLSTKKPWSLSFSFGRALQQSTLKAWSGKAANIEKARAAFLTRCKANSEATLGTYKGDAVLGEGASESLHVKDYKY

SEQ ID NO: 12670 - protein, 334 aa, Erwinia carotovora subsp. atroseptica SCRI1043
MEYMTIKVGINGFGRIGRIVFRAAQERSDIEIVAINDLLDAEYMAYMLKYDSTHGRFNGTVEVKDGHLVVNGKTIRVTAERDPSNLKWNEVNVDVVAEATGLFLTDETARKHIAAGAKKVVLTGPSKDDTPMFVMGVNHKTYAGQEIVSNASCTTNCLAPLAKVINDNFGIVEALMTTVHATTATQKTVDGPSHKDWRGGRGASQNIIPSSTGAAKAVGKVIPELNGKLTGMAFRVPTPNVSVVDLTARLEKPASYKEVCAAIKAAAEGELKGVLGYTEDDVVSTDFNGEKLTSVFDAKAGIALNDNFVKLVSWYDNETGYSNKVLDLIAHISK

SEQ ID NO: 12671 - protein, 154 aa, Zea mays
  misc_feature (36)..(36): Xaa can be any naturally occurring amino acid
  misc_feature (59)..(59): Xaa can be any naturally occurring amino acid
  misc_feature (91)..(91): Xaa can be any naturally occurring amino acid
  misc_feature (107)..(107): Xaa can be any naturally occurring amino acid
  misc_feature (136)..(136): Xaa can be any naturally occurring amino acid
  unsure (1)..(154): unsure at all Xaa locations
PPKPPSAAISVASVGVGIDHAGLLRNDQDELIKNAXAYIGTPVKDILAADETTETIGRXLSRIIAYNDEENRRALREFLFCCPGALHYISXAILFEETLYHKSNDGXSFVDDLKEGGVLPGIMADKGTIDVDGTDXETTTQGHDDLGKRCAMYY

SEQ ID NO: 12672 - protein, 468 aa, Saccharophagus degradans 2-40
MSEKTLNLIKESEATWLDLRFTDTKGKEQHVTIPASYVDEEFFENGQMFDGSSIAGWKGINESDMILMPDDSTAMLDPFTDEATVILRCDIVEPSTGQGYERDPRSVAKRAEEFLKSTGLGDTAFFGPEPEFFVFDDVKWGADMSGSFVKINSEEAAWSSGSKFTDGNLGHRPRVKGGYFPVPPVDSLHDIRASMCNAMMQMGLDVEVHHHEVATAGQCEIGVKFNTLVKKADEVQILKYCVHNVAHAYGKTATFMPKPIVGDNGSGMHVHQSYWKDGVNQFAGDGYAGLSETALYYIGGIIKHAKAINAFSNPGTNSYKRLIPGFEAPVMLAYSARNRSASIRIPYVPSPKGKRIEARFADPIANPYLCFAAMLMAGIDGVKNKIHPGDAADKDLYDLPKEEADKIPQVCGSLREALDNLDKDREFLTQGGVFTDDMIDAYIELKMEDVFKIEHTTHPLEFDLYYSV

SEQ ID NO: 12673 - protein, 448 aa, Streptomyces tenjimariensis
MTTTGGQSNLETIERARRVTAAEDYDIGTRFPSVFVSAEGSWMRDVEGNRVLDVTAASGSLLLGNRHPAVVEAVTKCVAEHGTVFASTISLPRLELAERLCERYPAGEKAVFCKTGSEATLAAIRLARAYTGRDLILTSGYHGWHDWQLTYLNMGFDPASRVVNFGYNETALARLLEQFGSEIGGVIVTPEPAWLGADYYRRLSELCARHDVPFILDEVITGVRWGARGLNGTGGVRADLITVSKGLSNGHALSAVLGKREIVDAYDKAGIAGTYTREVPPMAAALAVLDAIEDGSVHEHCEKMGRKLKDGMREILKKVGIPAYITGPDMMFDVVVESESLSWDIYRAAFDYGAYFEDSGTHMVTAAYGDEEVEHALHAFEMGAQRVVATREPDFGELPEDRRMAFPLEAFGGNIRDDETVLKRIEDIVRQVEQRDRTLGGTLDPACG

SEQ ID NO: 12674 - protein, 155 aa, Arabidopsis thaliana
  misc_feature (104)..(104): Xaa can be any naturally occurring amino acid
  unsure (1)..(155): unsure at all Xaa locations
AKGVFSFPLDPMSGEFVLTQENIEFPKAGRISSFNEGNYQMWDDKLKKYIDDLKDPGPTGKPYSARYIGSLVGDFHRTLLYGGIYGYPRDAKSKNGKLRLWNEXATISFIVEQDGGKGSDGHSRVLDIQPTEIHQRVPLYIGSTEEVDKLEKYLA

SEQ ID NO: 12675 - protein, 569 aa, Kluyveromyces lactis NRRL Y-1140
MNDTSEHSSDVSPIIFDDISQSKLKDSSENETTDRIIIKPVNDEDDTSVMITFNQKISPFILILTFTASISGFMFGYDTGYISSALVSIGTDLDNKALTYGDKEIITAATSLGALISAVFAGISADIFGRKPCLMFSNILFVIGAALQVSAHSFWQMAVGRLIMGFGVGIGSLLAPLFISEIAPKHIRGRLTVINSLWLTGGQLIAYACGAGLNKVHNGWRILVGLSLIPTVVQFTCFSFLPDTPRFYVIKGNYKKAAEVLQKSYINAPQELIDQKIRELSDLNEAIPGKTPVHKFFNTVKELHTVPCNFRALVIGCALQGIQQFCGWNSLMYFSGTIFQTVGFENSTAVSIIVAGTNFVFTLVAFFAIDKVGRRAILLIGLPGMMVSLVMCAIAFHFLDIKFTGAGESEVSNGGFSSWGIVVIVFIMVYAAFYALGIGTVPWQQSELFATSVRGVGTSYCTATNWAGSLIIASTFLTMLQNITPTGTFSLFAALAAVSTVFCYLCYPELSGLELEEVQTILSDGFNIKASKQLAKKRKQQNSEMQRRFREKDMEAYQKDKPSDELLES

SEQ ID NO: 12676 - protein, 393 aa, Triticum aestivum
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIEKCLDFCDYFLRGVVEYQQLITQNPIFLERVEGVGFISGEEAVNWGLSGPMLRASGIQWDLRKVDPYESYNQFDWKVQWQKEGDSLARYLVRVGEMRESIKIIQQAVEKIPGGPYENLEVRRFKKEKNSEWNDFEYKFLGKKPSPNFELSRQELYVRVEAPKGELGIYLVGDDSLFPWRWKIRPPGFINLQILPQLVKKMKLADIMTILGSIDIIMGEVDR

SEQ ID NO: 12677 - protein, 716 aa, Arabidopsis thaliana
  misc_feature (133)..(133): Xaa can be any naturally occurring amino acid
  unsure (1)..(716): unsure at all Xaa locations
MTRWSMSMHCTLFLLFLLRLTCIFSDSDYLMGLGSYDITGPAADVNMMGYANMEQVASGVHFRLRARAFIVAEPYKKRIAFENVAISGTHTHAGPGGYLQYILYLVTSLGFVHQSFNALVDGIEQSIIQAHEXNLRPGSILINKGELLDAGVNRSPSAYLNNPAHERSKYEYDVDKEMTLVKFVDDQWGPVGSFNCGDNKGTAARIMEDWFERENGCRSVDVESPRRVSSIISDPYDQDLMEMASSLLSTGGKTVTRMSSVARRVRSRFRHADKPRFVSAFCQTNCGDVSPNVLGAFCIDTGLPCEFNQSTCGGKNEQCYGRGPGYPDEFESTRIIGERQFKKAADLFTKASEEIQGKVDYRHAYVDFSQLEVTINGQNGGSEVVKTCPAAMGFGFAAGTTDGPGAFDFKQGDDQGNPFWRLVRNLLKNPTEEQVRCQRPKPILLDTGEMKQPYDWAPSILPVQILRIGQLVILCVPGEFTTMAGRRLRDAVKTVLKEGSNGREFSVVIAGLTNSYSQYIATFEEYQVQRYEGASTLYGPHTLSGYIQEFKKLANDLLSAQTTDPGPQPPDLLHKQISLLTPVVADMTPIGTAFGDVTSDVPRLSKFRKGADIVRVQFRSANPRNDLMTEGTFALVERWLEGRETWVPVYDDDDFCLRFKWSRPFKLSTQSTATIEWRIPETASPGVYRITHFGSAKTPISSIHHFSGSSSAFVVY

SEQ ID NO: 12678 - protein, 560 aa, Oryza sativa
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACRHETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 12679 - protein, 533 aa, Nostoc sp. PCC 7120
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRVQRAYDVMTQDGVGDGRKAVDVLQASYAEGVNDEFIVPVRIAPGTVEPGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIKAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYEVELSRTPIPVGLN

SEQ ID NO: 12680 - protein, 317 aa, Vibrio angustum S14
MSNSIQWFPGHMHKARKEIEEAMPKVDVIIEVLDARIPFSSENPLIKSFRNTNDGKPVVKVLNKRDLADPEMTQLWIDHLEKEQGVKAIAVTTENLNEVNQIMELCRKLAPHREEAGKKIRTMIMGIPNVGKSTIINALAGRTVAITGNQPAVTRQQQRINLDNGVLLSDTPGILWPKVENPHSGFRLAATGAIKDTAMDYIDVAFFTIEYLIKAYPDMIKARYNLDNELPESEIELMEEIGRKRGCLKGGGRVDLHKASVILINELRNGTLGHITLEHPDMITEELINVAVEAERKAEQKIKKKEERRKRYLKNKR

SEQ ID NO: 12681 - protein, 664 aa, Oryza sativa
MAPRVIVDTYPRACAHGVQRLAQLTALFAYHYKYRQLEKHKGINDDGEVVTINVAGVRRCRRAAACVLDGGHGRRRGGGGGGATVEVQPDAADAVRGAGAVWGAGAAGMLCTAAGTGGVPMRVRTEPQLCSSTPSTNHQSSANQQLPSPPQSHRLRLHPPRAIPLPPAIAARSKLASPRYRRGTGAPSFRRGAGAARIIPSVEPASDRPNGHGRSSNYLERAIVLDEMMKSTVFSAVAVSIGYTLLGWDFTTVLGNPSAEANIHMKKEFGLNNGPSIDGIILAVSVFGSIAITVFSGSLLDWLGRRIVFSYCLIFWMTLIPSPNWRIMIGAIFAPSLVYFALLVFYLPESPRWLVSDGKISEARISLQWLRGKDDVSDRSAGEIALIADGMNMITETAVGGHAVGAVRSQSFLGTSTNQMSRHSTFYWHLSDPLVDLLGSIHESMSELGAGRNSYFPVFNSFNIVEQEQTSEQRGNDSLQQSREAYSAEEGNNGDNLQASLLSQVASAETNDINTSFTSEGSSSYLRRHGTSTSGLAQDLISSLHDHDIEEDDEEIHIAALSSQPALGAGLHPFRQQMVRLSETADIKPKWRVLLQPGVRHALCYGMLIQALQQTTFNLLLPGDAKYHWAQWGMCDLCIRVLLGSRVRLLKSSRDEGSSLGAHS

SEQ ID NO: 12682 - protein, 311 aa, Streptococcus mutans UA159
MKTYEKIYQVLSQADDFVTGKVLGKDLGISRTAVWKAIQTLESKGLVIESVKNRGYRLLSGDLFLPDEIEQMTGIKVFFNEKSSSTQLDAKAGIEKGDPAPALYLAPSQTAAKGRFSRQFFTPETGGIYMSIHLHPELPFKQLPSYTLMAATSVVKAISRLTGIETDIKWVNDIYLHGKKVAGILTEAVSSIETGLITDVIIGMGINFHVTDFPEELQSKASSIFSEKPTITRNQLISEIWNIFFNIPKSELIKVYKEKSLVLDRQVTFVENDVTYKGIATDITDTGQLIVQLENGQEKILNSGEISLSSW

SEQ ID NO: 12683 - protein, 240 aa, Paracoccus denitrificans
MLARTDSTNAEALKLAPGLSGSAWVLAREQFAGRGRRGREWVMPAGNFAGTLVLRPQGGALAAAQLSFVAALALYDALGLACGPAARLAIKWPNDVLLNGGKVAGILLESSGSGPGVQAVAVGIGVNLAGAPDAGAVEPGATPPVSVQGETGHAVDPEEFLDLLAPAFARWQAQLDTYGFAPIRNAWLARAARLGEPIIARTGTAESHGIFEGIDDSGALILRGPAGRQVIPAAEVFFGG

SEQ ID NO: 12684 - protein, 456 aa, Staphylococcus epidermidis ATCC 12228
METIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPDVVMVDPPRKGCDETFLTTLLKLNPKRIVYISCNPSTQQRDAQILAEQYELVEITPVDMFPQTTHIETVALFVRKEEE

SEQ ID NO: 12685 - protein, 141 aa, Burkholderia thailandensis E264
MALERTLSIIKPDAVAKNVIGQIYSRFENAGLKIVAARMAHLSRADAEKFYAVHAERPFFKDLVEFMISGPVMIQVLEGEDAILKNRDLMGATDPKKAEKGTIRADFADSIDANAVHGSDAPETARVEIAFFFPEMNVYSR

SEQ ID NO: 12686 - protein, 99 aa, Glycine max
MAWRASLSRSVKEIRVLFCQSSPASAPAREFVKKNYGDIKARNPSLPFLVRECSGVQPQLWARYDMGVERCVNLDGLTEAQIDKKLEELAMAGESLKTK

SEQ ID NO: 12687 - protein, 272 aa, Actinobacillus pleuropneumoniae serovar 1 str. 4074
MNHQKLAFIGTGNMAYAIIQGLLKSHYPASQIIACNKSNLVRRAELQAVGIATNFTNRAAVEQAEVVVLAVKPQMMAEVCSEFSAVDFSNKTVISVAAGISVARLEQLLPTAKNIIRTMPNTPSLIGEGMTGLFAKKSVNSTACQFAESLMSAVGKCYWVEQEQQINHIIAVTGSSPAYFFRFMEAMQQSAMQMGFSEADARLLVQQAALGAAKLVEANPNTPLSTLRENVTSKGGTTAKALEVFEQHALAETVDQAMWAAIHRAEEMEQQL

SEQ ID NO: 12688 - protein, 276 aa, Bacillus anthracis str. 'Ames Ancestor'
MNKQIGFIGCGNMGIAMIGGMINKNIVSPNQIICSDLNVSNLKNASDKYGITITTNNNEVANSADILILSIKPDLYTSVINQIKNQIKNQIKNDVIVVTIAAGKSIKSTENEFDRKLKVIRVMPNTPVLVGEGMSALSFNEMVTEKDIKEVLNIFNSFGQTEVVNEKLMDVVTSISGSSPAYVYMFIEAMADAAVLDGMPRKQAYKFAAQAVLGSAKMVLETGIHPGELKDMVCSPGGTTIEAVATLEEKGLRTAIISAMKRCTKKSMEMSRLTSK

SEQ ID NO: 12689 - protein, 245 aa, Bacillus anthracis str. 'Ames Ancestor'
MIKLVLIRHGQSLWNLENRFTGWTDVDLSENGLSEAREAGAILKKNGYTFDVAYTSVLKRAIRTLWIVLHEMDLAWVPVHKCWKLNERHYGALQGLNKDETAKKYGEEQVHIWRRSIDVRPPALTEDDPRYEMNDLRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHITF

SEQ ID NO: 12690 - protein, 1023 aa, Yarrowia lipolytica
MTSKSDYSGKDKIELDPVFAKSIDLLPNTQVVIDIQLNPKIAHTIHLEPVTVADWEIVELHAAYLESRMINQVRAVSPNQPVTVYPSSTTSATLKVIRIEPDLGAAGFAKLSPDSEVVVAPKQRKKEEKQVKKRSGSARSTGSQKRKGGRGPHALRRAISEDFDGHLRLEVSLDVSQLPPEFHQLKNVSIKVITPPNLASPQQAASIAVEEKSEESLSQNKPPSSEPKVEVLPDIINPASEIVATLVNDTTSPTGHAKLSYALADALGIPSSVGHVIRFESASKPLSQKPGALVIHRFITKTVGAAEQKSLRLKGEKNADDGVSADDQFSLLEELKKLQMLEGPITNFQRLPPIPELLPLGGVIGLQNSEGWIQGGYLGEEPIPFVSGSEILRSESSLSPSNIESEDKRVVGLDNMLNKINEVLSRDSIGCLDYGSRGSGKSAVLNHIKKECKVSHTHTVSIACGLIAQDRVQAVREILTKAFLEASWFSPSVLFLDDIDALMPAEVEHADSSRTRQLTQLFLELALPIMKSRHVSVVASAQAKESLHMNLVTGHVFEELFHLKSPDKEARLAILSEAVKLMDQNVSFSQNDVLEIASQVDGYLPGDLWTLSERAQHEMALRQIEIGLENPSIQLADFMKALEDFVPSSLRGVKLQKSNVKWNDIGGLKETKAVLLETLEWPTKYAPIFASCPLRLRSGLLLYGYPGCGKTYLASAVAAQCGLNFISIKGPEILNKYIGASEQSVRELFGAQAAKPCILFFDEFDSIAPKRGHDSTGVTDRVVNQMLTQMDGAEGLDGVYVLAATSRPDLIDPALLRPGRLDKMLICDLPSYEDRLDILRAIVDGKMHLDGEVELEYVASRTDGFSGADLQAVMFNAYLEAIHEVVDVADDTAADTPALEDKRLEFFQTTLGDAKKDPAAVQNEVMNARAAVAEKARVTAKLEALFKGMSVGVDNDDDKPRKKAVVVIKPQHMNKSLDETSPSISKKELLKLKGIYSQFVSGRSGDMPPGTASTDVGGRATLA

SEQ ID NO: 12691 - protein, 408 aa, Pseudomonas fluorescens Pf-5
MRAMTYHGAHDVRVETVPDPIIEASDDIILRVTATAICGSDLHLYRGKIPAVEHGDIFGHEFMGIVEDTGSAVTAVQRGDRVVIPFVIACGDCFFCQQELYAACETTNTGTGAAMNKKLIPPPAALFGYSRIYGGIPGGQAELVRVPKANTGPFKVPGTLADERVLFLSDILPTAWQAVINAGVSQGSSLAIYGAGPVGLLSAACARMLGVERIFMVDHHPYRLDYAQRTYGVIPINFNDDDDPADTIISQTSGSRGVDGVIDAVGFEAKGSTTETVLATLKLEGSSGKALRQCIAAVRRGGVVSVPGVYAGFIHGFLFGDAFDKGLTFKMGQTHVHRYLPELLEHIETGRLQPDAIISHRLSLEQAAEGYKIFDKKQEDCRKVILTPGGSNMQLADVDDTTSLAPAV

SEQ ID NO: 12692 - protein, 480 aa, Fagus sylvatica
MGEEGNSWIRRTKFSHTVCHRLDASRLASFPIIIRPERNSGLKSRPGATSSSEKFGTIYNKQRSLSPLPESRLSDVFKEARSETKRFMTPLPRRREQAKGVMGKFVHKDFHEVKASDSKSLANSSALRHLSSMKVNDKSKYRKESSWAKYFDHGGGRVNAVETSDEWTVDLSKLFLGLKFAHGAHSRLYHGIYNDEPVAVKIIRVPEDDENGALGARLEKQFNREVTLLSRLHFHNIIKFVAACRKPPVYCVVTEYLSEGSLRAYLHKLERKSLPLQKLIAFALDIARGMEYIHSQGVIHRDLKPENVLIDQEFHLKIADFGIACEEAYCDSLADDPGTYRWMAPEMIKHKSYGRKVDVYSFGLILWEMVAGTIPYEDMNPVQAAFAVVNKNLRPVIPRYCPPAMRALIEQCWSLQSEKRPEFWQVVKVLEQFESSLARDGTLNLVQSLTCQDHKKGLLHWIHKLGPVHPNGSMPKPKLT

SEQ ID NO: 12693 - protein, 332 aa, Zea mays
MSTANRYQHIKSTKPVVGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTTSVKSVDSNFSSTSRKDVFEDTREFVGELNITLVKGTNLAVRDMLTSDPYVVLTLGGQKVQSTVKKSDLNPVWNEVLKISVPRNYGPLKLEVYDHDMFSADDIMGEAEIDLQPMITAAMAFGDTSRLGDMQIGRWFMTKDNALMKDSTVNVVAGKVKQEVHLKLQNVESGELELELEWVPIL

SEQ ID NO: 12694 - protein, 458 aa, Staphylococcus epidermidis RP62A
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 12695 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 12696 - protein, 70 aa, Arabidopsis thaliana
TGSIQASAQASEQHTSELVVGMVRLQFKKLLYDTGPNKLQKLKDEVVRGLINHMLFESAKLTGGKVTHSS

SEQ ID NO: 12697 - protein, 931 aa, Bartonella henselae str. Houston-1
MLERPFFSRHIGLRPDEKQKMLDIVAVDSIDTLVSQALPHSIHLGRPLNLPKAVSEGQALEELSKMMERNYLHKSFIGQGYHGTYVPPVILRNLFENPAWYTAYTPYQAEISQGRLELLFYFQTLISELTGLPVAAASLLDEATALAEAITVAFRFTREKKMKISLQSLLHPQILSVVQTRAETQGLQVSKNSEICSDTAAIVLSWPDTKGSFNDYSEVIKEAKAKGALVIVVADPLALTLMEAPAKWGADIVVGSMQRYGVPMGFGGPHAGYLAVSDALTRLIPGRIVGQSVDTKGRVGFRLALQTREQHIRRDKATSNICTAQALLANMATAYAVWHGPQGLQEIAQRVHHLTCRFVGGLEAVGISCEGEYFFDCVSIVVKGKAREIACQAKAGGRLIRVLDDDRVVINFDELSTQEDAHALAQLFGAGLVDQASPRLMGKGRDTTFLSQPFFHAVHSETDMMRFLRRLSDKDLALDRAMIPLGSCTMKLNAAAELMPVSWPTVANIHPFASREDAVGYQEMIHQLNAWLCEITGFAQVSFQPNSGAQGEYAGLLAIRRYHQSRGEHQRTLCLIPASAHGTNPASAHMAGMEVVVVKCLNDGDVDLDDLKMKAQLYKERLAALMITYPSTHGVYEESIKDICSLIHENGGQVYFDGANLNALVGLARPADIGADVCHMNLHKTFAIPHGGGGPGVGPIGVVEHLKPFLPGHEQEGTTHAVSAAPYGSASILVITWMYIRMMGAEGLKYATQTAILNANYIAARLSQVYSILYRGKHGRVAHECIVDTRVLKEQYGVSVDDIAKRLIDYGFHAPTMSFPVPGTLMIEPTESEPKAEIDRFCDALLSIAEEAKKIGSGVWPKDDNPLVHAPHTLVDTLDDTWARPYSRQEAAFPNCSLDPANKYWPPVSRIDNVAGDRMLICSCPPLGNTY

SEQ ID NO: 12698 - protein, 140 aa, Picrophilus torridus DSM 9790
MIMERCLILVKPDGVERNLIGEVISRFERKGLAIKALKMMRVTREQAEDHYSVHRLKPFFDDLVSYLTSGPIVAMIVEGNNAIASSRMLAGATDGSKAAPGTIRGDFSLDIERNIVHASDSLESYEHEYKIFFNENEIMD

SEQ ID NO: 12699 - protein, 469 aa, Photorhabdus luminescens subsp. laumondii TTO1
MSVEHVLTMIEEHQVKFIDLRFTDTKGKEQHMTIPAHQVNADFFEDGKMFDGSSISGWKGINESDMVLMPDPSTAMLDPFFDDATLTLRCDILEPGTMQGYDRDPRSISKRAENFLRSSGIADTVLCGPEPEFFLFDDVRFSSAMSHSYYHIDDIEAAWNSGTQYEGGNKGHRPAVKGGYAPLPPVDSSQDLRSAMCLTMEEMGLVVEAHHHEVGTAGQNEIATRFNTMTKKADETQIYKYVVHNVAHNFGKTATFMPKPLVGDNGSGMHCHMSLSKNGTNLFAGDKYGGLSELALFYIGGIIKHARALNAFTNPTTNSYKRLVPGYEAPVMLAYSARNRSASIRIPVVASTKARRIEVRFPDPAANPYLAFAAQLMAGLDGIINKIHPGDAMDKNLYDLPPEEAKEIPTVASSLDEALAALDADREFLTRGGVFTDDAIDAYIDLKNSEIERVRLTPHPLEFELYYSV

SEQ ID NO: 12700 - protein, 433 aa, Psychrobacter arcticus 273-4
MSTKNEQLFAQACKHIPGGVNSPVRAFAGVGGTPIFMHRANGSKIYDTEDNAYIDYVGSWGPMILGHAHPKVIDAVKKAADDGLSFGTPTPFETTVADKICEIVPSVEMIRMTSSGTEATMSAIRLARGYTQRDKIVKFEGCYHGHSDSLLVKAGSGMLDIGEPTSKGVPADFAKHTITIPYNDSQAIKDCFEKWGEEIACVILEPIAGNMNMVIPSQEFHDTLREQCTANNSVLIFDEVMTGFRVGLGGAQAHFGIDPDLTCFGKIIGAGLPVGAFGGKKEVMSCIAPLGGVYQAGTLSGNPLAMRAGIAMFEDLTAEGFYDELAVKVDRLVDGFQAAADKHGINLRTNKLGGMFGMFFVTDGDTAVPQNFDEVTECDMEVFNTFFHGMLDRGIYLAPSAYEAGFMSIKHSDEDIDTSIKAADEIFAEMAKA

SEQ ID NO: 12701 - protein, 314 aa, Glycine max
MGAGDKTAAGMPRIGMGTAVQGPKPDPIRRAVLRAIEVGYRHFDTAAHYETEAPIGEAAAEAVRSGAVASRDDLFITSKLWCSDAHRDRVVPALRQTLRNLQMEYVDLYLVHWPVSMKPGRFKAPFTAEDFVPFDMRAVWEAMEECHRLGLAKAIGVANFSCKKLETLLSFATIPPTVNQVEVNPVWQQRKLREFCRGKGIQLCAYSPLGAKGTHWGSDAVMDAGVLQEIAASRGKSVAQVCLRWVYEQGDCLIVKSFDEARMRENLDVDGWELTEEEHRRIAEIPQRKINLGKRYVSEHGPYKSLEELWDGEI

SEQ ID NO: 12702 - protein, 688 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRELYRVIKQANKVRLAEFVKVRTGIDINPQAIFDIQIKRLHEYKRQHLNLLRILALYKEIRQNPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAID

SEQ ID NO: 12703 - protein, 485 aa, Oceanospirillum sp. MED92
MKLQLNDSSLLQTQAFINGEWVNGDAGETFPVSNPATGEVIAEVASVGAEETARTIDLAEAAMSAWKKLAPAERSGILERWYDLIIENTDDLAAIMTLEQGKPLFEAKGEVMYGASYLKWFAEEGKRIYGDVLPSPGDRRSIVIKQPVGVVAAITPWNFPNAMITRKAAPALAAGCSILLKPAAETPLSALALAELSKRAGVPAGLFNVLPTKSSSTVGGEMTSNTKVKKLTFTGSTPIGKLLIKQCADTVKRTSMELGGNAPVIVFDDADLDLAVKGALASKYRNSGQTCICANRLLVQEGIYDQFVEKFAAAVKEFKLGHGFDEEATHGPVVSKKALSDIDAIVQNAVEQGANVVAGGKPSELGNCFYEPTILTDVNDKMSIFGEEIFGPVAPVFKFSTEEEAIAMANDTEFGLASYVFTQNLGRIWRVSEGIEYGMVGVNETAISSEVIPFGGVKESGQGREGSKYGLEDYLETKYICMGGL

SEQ ID NO: 12704 - protein, 337 aa, Debaryomyces hansenii CBS767
MVVYFDPNTAPFLNPAVDRRVAFITGGNSGIGWFTILHLYLHGYTVYVAGRTESKVRKAIEDIKIEAEKRVKEYTKEEQDARSLGSLDYVYLDLLDLSTVVAAAESFSKKEPELHILINNAGIMGVPYEETKDGYEIQYQVNFASHFLLTFKLLPLIKKVALKGSIQPRIIQLTSGGHRASYRYFQPSENMNKFPNILYTWYRYGAAKLASIQFMNLLGKANPDILCVSVHPGIIFGTELFKYWKKMPIFGYLSSASMYAVAPLIGVQIEEGSLSTLKTALDPKINLLQDNGKYYVTGGSEGSTSRVAQNEKDAITTWNWNLDYMRKHNFNIDAPKL

SEQ ID NO: 12705 - protein, 236 aa, Haloquadratum walsbyi
MKTTGGSEEQKRRAGEKAVEYVNDGDIVGLGTGSTAAAAIDALGDAVAAGYDIHGVPTSFATRDRAIEAGIPLTRIEAVDHIDVAIDGSDEINNNLTLIKGGGAAHAREKVIDATADQFIVVADESKLVETLSEPVPVSTLPMAQKPVKHRLDSLGATTTLRSATMKDGPVITDNGNIVFDCAFGHIENAEALAKSLAEIPGTVAHGLFVNLADVACIGTENGTNVYHGDQDQGQN

SEQ ID NO: 12706 - protein, 490 aa, Arabidopsis thaliana
MAETTSWIPVWFPLMVLGCFGLNWLVRKVNVWLYESSLGENRHYLPPGDLGWPFIGNMLSFLRAFKTSDPDSFTRTLIKRYGPKGIYKAHMFGNPSIIVTTSDTCRRVLTDDDAFKPGWPTSTMELIGRKSFVGISFEEHKRLRRLTAAPVNGHEALSTYIPYIEENVITVLDKWTKMGEFEFLTHLRKLTFRIIMYIFLSSESENVMDALEREYTALNYGVRAMAVNIPGFAYHRALKARKTLVAAFQSIVTERRNQRKQNILSNKKDMLDNLLNVKDEDGKTLDDEEIIDVLLMYLNAGHESSGHTIMWATVFLQEHPEVLQRAKAEQEMILKSRPEGQKGLSLKETRKMEFLSQVVDETLRVITFSLTAFREAKTDVEMNGYLIPKGWKVLTWFRDVHIDPEVFPDPRKFDPARWDNGFVPKAGAFLPFGAGSHLCPGNDLAKLEISIFLHHFLLKYQVKRSNPECPVMYLPHTRPTDNCLARISYQ

SEQ ID NO: 12707 - protein, 563 aa, Candida glabrata CBS 138
MGRRKRSPSNNNHNQNFEVPKLGADANTINGEQSQSDETAEPVDPDDSSKLPPNISIRNSTTSTTSTTRTTRTTRTTATYYDKDADKAAKLDIDISVARAFAATPFPRTSGRPAQNSNSSFSSSSSSSSSSTPSFSSSSPLSYLSPSSSVTTANVQPSTGATPQYLKPSSAPCGVLSMSSLMRKHTSASYNVSQTTATGTTHYAKTVSKSRLSSSLATENPATRSTLLNTPPPHLLLKRYPSDNSSSDILDVDLVIEKLLKMGTQPNGTAPTTTKSKRDFPFRSWEIQLICSHAREIFLEEPSLLRLQAPIKVVGDVHGQFNDLLRILKLSGAPPDTNYLFLGDYVDRGKQSLETILLLLCYKLKYRNNFFMLRGNHESANVTKIYGFYDECKRRMGSKSWRFFVDVFNTLPIAATIQDRIFCVHGGVSPELKELNQINQIMRPTDIPDQGLLTDLLWSDPDPQIQDWSLNDRGVSYTFSKRNVYDICSRFKFDLIIRGHMVVEDGYEFFAKKKLVTVFSAPNYCGEFQNWGAVMSVTTGLMCSFELLKPHSLKNKKTRKTRR

SEQ ID NO: 12708 - protein, 314 aa, Arabidopsis thaliana
  misc_feature (91)..(91): Xaa can be any naturally occurring amino acid
  misc_feature (193)..(193): Xaa can be any naturally occurring amino acid
  misc_feature (205)..(205): Xaa can be any naturally occurring amino acid
  misc_feature (299)..(299): Xaa can be any naturally occurring amino acid
  misc_feature (309)..(309): Xaa can be any naturally occurring amino acid
  unsure (1)..(314): unsure at all Xaa locations
MADKKIRIGINGFGRIGRLVARVVLQRDDVELVAVNDPFITTEYMTYMFKYDSVHGQWKHHELKVKDDKTLLFGEKPVTVFGIRNPEDIPXGGEAGADFVVESTGVFTDKDKAAAHLKGGAKKVVISAPSKDAPMFVVGVNEHEFGIVEGLMTTVHSITATQKTVDGPSMKDWRGGRAASFNIIPSSTGAAKXLGKVVPSLNGKXLTGMSFRVPTVDVSVVDLTVRLEKAATYDEIKKAIKEESEGKMKGILGYTEDDVVSTDFVGDNRSSIFDAKAGIALSDKFVKLVSWYDNEWGYXSSRVVDLIVXHMSKA

SEQ ID NO: 12709 - protein, 202 aa, Myxococcus xanthus DK 1622
MPTLVLVRHGQSLWNQENRFTGLVDVPLTDQGRQEARRAAEALSGMTFDVAYTSALIRAQETLSILLDALGQQVPTIRDAALNERNYGDLQGLNKADAAKRWGAAQIKEWRRSFDVPPPNGESLEMTAERVLPFYERAIAGDLRLGKNVLVVAHGNSNRSLVMKLDNLTGEQVVGLELATGVPLIYEMSPDGEVLSKRTASP

SEQ ID NO: 12710 - protein, 315 aa, Schizosaccharomyces pombe
MGKIRVRNNNAASDAEVRNTVFKFNKDFGQHILKNPLVAQGIVDKADLKQSDTVLEVGPGTGNLTVRMLEKARKVIAVEMDPRMAAEITKRVQGTPKEKKLQVVLGDVIKTDLPYFDVCVSNTPYQISSPLVFKLLQQRPAPRGAILMFQREFALRLVARPGDPLYCRLPANVQMWAHVKHIMKVGKNNFRPPPLVESSVVRIEPKNPPPPLAFEEWDGLLRIVFLRKNKTIGACFKTSSIIEMVENNYRTWCSQNERMVEEDFDVKSLIDGVLQQCNLQDARASKCGQQSLSLLHPFHQVGRSFWLMGQDGVFH

SEQ ID NO: 12711 - protein, 534 aa, Zea mays
  misc_feature (9)..(9): Xaa can be any naturally occurring amino acid
  misc_feature (283)..(283): Xaa can be any naturally occurring amino acid
  unsure (1)..(534): unsure at all Xaa locations
EEYVFGLGXSAQVLATTAAVGVIAHRFAVLPGPAAIVVGSGLALSSTAVVLQVLQERGESTSRHGRATFSVLLFQDLAVVVLLILIPLISPNSSKGGVGFQAIAEAMGMAAVKAVAAITAIIAGGRLLLRPIYKQIAENQNAEIFSANTLLVIFGTSLLTARAGLSMALGAFLAGLLLAETEFSLQVESDIAPYRGLLLGLFFMTVGMSIDPKLLLSNFPMISMILSLLIIGKTLLVTFVGRVFGVSAIAAIRVGLLLAPGGEFAFVAFGEAVNQVSSTLDLXSINIVDHRNIYNCFVGISMALTPWLAAGGQFLASKFEQHDVRSLLPVESETDDLHDHIIILGFGRVGQIVAQLLSERLIPFVALDVRSDRVAVGRALDLPVYFGDAGSREVLHKVGAERACAAAITLDTPGANYRAVWALNKYFPNVKTFVRAHDVDHGVNLEKAGATAVVPETLEPSLQLAAAVLAQAKLPMSEIQESINEFRNRHLSELTELCATSGNSLGYGFSRVMSKSKSISSDDESETVDGALAI

SEQ ID NO: 12712 - protein, 631 aa, Cytophaga hutchinsonii ATCC 33406
MENNFLFQTVIYLSAAVVCVPIAKRFAMGSVLGYLLAGMLIGPFVLGFIGQEGKDIMHFAEFGVVMMLFLIGLELEPAHLWKIRKQILGVGLSQVLITTAVVMIIAIAASLAWQSALAIGFAFAMSSTAIVLQSLKEKGLMKAPSGQFSFAVLLFQDIAVIPILAILPLLVFLPVSIPQDAHSGGINDLPRWLQTASVLGAVGGIVLIGKYAIVPLLRVIAKTHMRELFTASALLIVVAIALLMQQVGLSPALGTFLAGVILANSEFKHELESDLEPFKGLLLGLFFIAVGASIDFSLVYEELLTIAILTFSIIIVKASILFAIGKKAKLSLDQNLIFAIGLSQVGEFAFVLFSFIGTHNILSKAQTDMMMAVTALSMTISPLLLIVLDKWILPKLHAADKEQTTKRADHIEERNNVLLVGFGHFGTTLARFLRANGVAATVLDNNSDQVDLLRKMGFNVFYGDATRIDILEAAGAAEASILIIAIDSPETNLEIVKIVKQHFPNLEIMVRSKNRMDAYELLDEGVSNIYREHLDTSIRLGVDVMKKLGYRTYSAFRAGQNFIKYDEAALRTLSQNRKNMKVYISDVREQIALQEELLQIDRQVVPSANDHAWDSREMREKIREMDNQKSV

SEQ ID NO: 12713 - protein, 162 aa, Triticum aestivum
  misc_feature (58)..(58): Xaa can be any naturally occurring amino acid
  misc_feature (73)..(73): Xaa can be any naturally occurring amino acid
  misc_feature (78)..(78): Xaa can be any naturally occurring amino acid
  misc_feature (105)..(105): Xaa can be any naturally occurring amino acid
  misc_feature (126)..(126): Xaa can be any naturally occurring amino acid
  misc_feature (129)..(129): Xaa can be any naturally occurring amino acid
  unsure (1)..(162): unsure at all Xaa locations
MAPSVMASSATTVAPFQGLKSTAGMPVARRSGNSSFGNVSNGGRIRCMQVWPIEGIKXFETLSYLPPLTVEDXLKAVXVPAPSNWVPCPDSSKGPVCPTVENHRXPGYYQRKYWTIWNCQGSVDRXTQXLKDPRRQKGSPILTVKLKLFNPKTPGSGEKPQK

SEQ ID NO: 12714 - protein, 96 aa, Streptococcus pneumoniae TIGR4
GCGPAFVYLFIEALADAGVQTGLPREIALKMAAQTVVGAGQLVLESQQHPGVLKDQVCSPGGSTIAGVASLEAHAFRGTVMDAVHQAYKRTQELGK

SEQ ID NO: 12715 - protein, 531 aa, Triticum aestivum
MAAAARHRKEEEDEMLLDDGDIEESPRDSFRDSDDDDDEAEEARGEDGDGVGSFESHQWPQSYRETTDTYTIAASPIFGYLGPSTSKYSIDGGRSGLASDLRLPFISDKLESVKSLRRHLLGSVRDEKLSFQYTGEIYVGQGCSVTQTVFNGINVLAGVGLLSAPFTIHEAGWAGLAVLSVFAIICCYTGVLLKHCFESKDGIATYPDIGEAAFGRIGRLIISIILYTELYSYCVEFIILEGDNMTSIFPDVNINLFGIHVDSKHFFGVLTALVVLPTVWLRDLRVLSYLSAGGVIATLVVFISVALVGTTEGIGFHQTGEAVKWSGMPFAIGIYGFCYSGHSVFPNIYQSMSDRTKFPKALFICFAVCTAIYGSFAIIGYLMFGDKTLSQITLNLPKESFASKVALWTTVINPFTKFALLLNPLARSLEELRPEGFLNETIVSIILRTSLVASTVVIAFLLPFFGLVMALIGSLLSILVAVIMPALCFLKITQNKATRTQVIASVAIIVVGVISAALGTYSSVASIIGYY

SEQ ID NO: 12716 - protein, 470 aa, Zymomonas mobilis subsp. mobilis ZM4
MLHPVVLCGGSGTRLFPLSRRSHPKQLLSLMGENSLFQDAVARVTDSSLFTAPLVICNEEYRFTIAEQLQEMGVKAQEIVLEPEGRNTAPAIALAASMIADKDPDACMLILPSDHVIRDVKAFHEAIKDAETIARKAKALVTFGVRPTSPETGYGYIEMGEALPIAGGYHIDRFREKPDIKTAEDYLASGRFLWNSGMFLFPVSRILEDFALYQSDILDAVKASLRKSQKDLDFTRLDAESFAKAPSISIDYAIMEPAHNRAVVPVNIGWSDVGSWSSLWAISDHDDNGNVLMGDVVAEDSSNCLIRSENGLVATLGVKDLTIINTSDVTLVVNQDQSQNVGTLVKKMIKEGRLEPLNPKQVARPWGWYESIAMGPRFQVKQIMVKPGHRLSLQKHFNRAEHWVVTQGTARVTVGDHVDLIRENESIYIPMGEVHRLDNPGKVDLLLIEIQTGCYLGEDDIVRLEDDYRR

SEQ ID NO: 12717 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 12718 - protein, 561 aa, Zea mays
MASIPPPSSSVAALTRQPAQFLKWCSVSKETKASVCSFLATNSNSTRVKSVGLRVALSFKNDGGYPADGFSGNGNTLLPKSTSVRGEDHPVADPVLPMDSMMTPEILSANLALVMDKFSDDDTDTELDLDSPTEGFASIPDAIEDVRQGKLVIVVDDESRENEGDLIMAASLVTPEAMAFIVRHGTGIVCVSMKEDDLERLSLPLMVTTKENEEKLCTAFTVTVDAKEGTTTGVSAKDRAKTVMTLASPDSRPEDFNRPGHIFPLKYREGGVLKRAGHTEASVDLAMLAGLPPVAVLCEIVDDADGSMARLPKLRVFAERENLKIISIADLIRYRRKRDRLVERASVARLPSQWGNGHGYCYRSAIDGIEHLAMVKGDIGDGQDILVRVHSECLTGDIFRSARCDCGDQLAMAIEMIEKAGRGVIVYLRGHEGRGIGLGHKLRAYNLQDDGRDTVEANEELGLPVDSREYGIGAQILRDLGVRSMKLMTNSPAKYSGLKGYGLSIAGRVPLVTPITSENPQILCPIREHGRATEDGEELVKQGYIPDLGILVFSCGRCTSC

SEQ ID NO: 12719 - protein, 277 aa, Psychrobacter arcticus 273-4
MSVLDNKKISFIGGGNMAQALISGMVSCGIKPNLITVSDPSSEAREQLAAKGLNTVDPMTDAKAAVIDADIVVLAVKPQVMKAVVSAFADVLDKQLVISVAAGLSTDVLSSMLGGYRNIVRAMPNTPAMIQMGATGLYGTDDISAEQKQLATAVMEASGLVMWVEDEAHMHAVTAVSGSAPAYMFYIIEAMVDGAVALGLDKEQASALAMQTMLGAAKMAMGSEDAPAELRRKVTSPNGTTQAAIESMQANDIGRQISEAMQACYDRSQALSEEMSK

SEQ ID NO: 12720 - protein, 494 aa, Rubrobacter xylanophilus DSM 9941
MNVEREGRVETRMIERLFVGGEWVGEASTGRTFEVENPASGRVIAVLPDGGGGEMRRAVEAAVAAQPGWEEATAYERASVLWRAAGLMRERAEHLARVMTLEQGKPLAESRGEISYAASFVEWFAEEGKRVYGESVPSSFRDKRILVLKRPVGVAAAITPWNFPAAMITRKLAPALAAGCAMVVKPSELTPLSALELAKIFEEAGLPRGLLSVVVGTDPGDITAPLMEDGRVRKLSFTGSTEVGKHLMRQAAKTMKRLSLELGGHAPFIVFEDADLEAAVEGALVSKMRNMGQTCVCANRIFVQKSVLEPFAERLVERMGRMKVGDGLQEGVSVGPLIEERALRKVERHVEDARQKGARVLLGGSRLSSGGGYFFAPTVLCGADESMLVFREETFGPVAALASFESEQEVVERANATPYGLAGYYYTRDVGRVMRLAEKLRYGILGANDGLPSTAQAPFGGLKESGFGREGGHWGIEEYLDVKYLSLGGLGSSS

SEQ ID NO: 12721 - protein, 331 aa, Coccidioides immitis RS
MSASNSIQGLGLAPRSGTTLTVLGCGNLGVAILSGVLASLAEAKKTDSRFFPGCGTATPPEEVSPHQIPSRFFACVRRPESALRIQKTLKQFTHPLTILQNDNIRGVQEADVIILGCKPFMLKEVLDVPGMREALKGKLLISILAGVTAEQIEDTLYGGTDTPDGDRCRVVRAMPNTAAIVRESMTVIGESTPPLPPNWETLVNWIFSRIGRVVTLPASKMDASTSIAGSGPAFAALVLEALADGGVAMGLPRAEAQVMAAQVLRGTASMVQNGDHPALIREKVSTPGGCTIGGLMVLEEAGVRGKISKAVREATAIASGLGQTQKANGTK

SEQ ID NO: 12722 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVSHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 12723 - protein, 331 aa, Triticum aestivum
RPIQVTRLNKFVQKSRLVPVRNSRDIVDPRVRKDLAKGTFRKATWRGILVAVKKLDDDVLTDENKVQAFRDELDVLQLIRHPNVVQFLGAVTQTNPMMIVMEFMPKGDLRKHLNRKGALEPLYAVKLALDIARGMSYLHEHKPQAIIHRDLEPSNILRDDTGHLKVADFDCCNAPEGRRKVREDKPVTSPGNACRYVAPEVLRKEEYDNKVDVFSFALILQEMIEGCLPFHDKKIDEIEKAHSSKERPPFRAPPKHYAYGLRELIEKCWSENPADRPNFRVVIDRLSAIQIELARRNRWKVRPLKCFLSFEGLRKKDRNEGSTTRSSRSSR

SEQ ID NO: 12724 - protein, 331 aa, Methylobacillus flagellatus KT
MLKLSEFLVQQERQHAVADNVLTLIQDIAATCQAVAREIRYGALRGNMGSAGRENVQGEEQKALDVISNDIFTAMASKQPHVAAVASEEMAQAQVFAGKQGKYLLVFDPLDGSSNVNLNLSVGSIFSILPAPEGSVDEASFLQAGSRQLAAGYALYGTSTMLVLTMGHGVHGFTLDPDQGEFYLTHPGLTIAASTEEFAINMSNQRFWQPPVQRYIAECIAGSSGPRGKDFNMRWVATMVAEVHRLLVRGGVFLYPLDSRAVGRGGRLRLLYEANPMSLLVEQAGGLATTGHRRILDVEPAGLHQRVAVMMGAREEVERLQDYHSFTDPTA

SEQ ID NO: 12725 - protein, 359 aa, Oryza sativa
  misc_feature (267)..(267): Xaa can be any naturally occurring amino acid
  unsure (1)..(359): unsure at all Xaa locations
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIHLNAQGLARYAIICQENGLVPIVEPEILVDGPHDIDPCAYVSEVVLAACYKALNEHHVLLEGTLLKPNMVTPGSDAKKVSPEVIAEYTVRTLQRTVPAAVPAIVFLSXGGQSKEEATRNLNAMNKLSTKKPWSLSFSFGRALQQSTLKAWSGKAANIEKARAAFLTRCKANSEATLGTYKGDAVLGEGASESLHVKDYKY

SEQ ID NO: 12726 - protein, 222 aa, Zea mays
MSMFNRIFGKPKEQANSNALATLDKLNETLDMLEKKEKVLEKKAAAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALSAPLGASADFDEDELEAELEELEGAELESQLLEPVAAPPVHPVHAPANKQPARPAPQKATAEDDELAALQAEMAL

SEQ ID NO: 12727 - protein, 467 aa, Xylella fastidiosa Ann-1
MNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDETAFQTAVHVATEAAAQGKLVTFGIIPNTPEIGYGYIKATGNDTIRPVERFIEKPDLATAQSYLSSGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATRHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 12728 - protein, 496 aa, Arabidopsis thaliana
  misc_feature (129)..(129): Xaa can be any naturally occurring amino acid
  unsure (1)..(496): unsure at all Xaa locations
MASCDTPDAFAWLQTLPPLSLWKGNLMSMCICSPNSSHPSLNFTLTRTPQSPNFFTFSIVANFKTPITLFISKTFRTISTNSTTFLNENVISTLLMGFVDVVLNYNVKRTTCSIQLQNLGSTSNLKDVXNLAFFTFVFLICIYEAPTSLRTTCLKTVKDQLVTCRSRQGSKLLMVQLGSNLEEQWMRSLNLAITNWIIEIKAFQHLKSPSPLFSYAFSTQGLWKVHMYCPVVAMEMESVNSSLNDERLFFSLNYHQLEGVIQLNHRIYVREKWFNVAVNIDNVRCDIIRLVNEKLLSERGMGTEEKHFPSRISLQLTPTNQSNILMVSVQKSSENPLTEFEVEKGIEATIDPPNTFFGLKVSANETTTKSMKPWKFEEWVHGYSANLTWFLHDLDDGREVSSSKPSKVSMMNPRAWFKNRYSSAFRPFTKQGGVVFAGDSYGQSVLWKVDKTAIGKVMEFEVKGCVWLTYWPNKHHTFYSDTRKLEFKEMLYLNLP

SEQ ID NO: 12729 - protein, 386 aa, Pseudomonas fluorescens Pf-5
MKAVVFHSVGDIRLEDVAEPTLLAPTDAIIRVTASAICGTDLHFVRGTVAPMKPGTILGHEAVGIVEQLGTDVRNLQVGDRVVVPSTIACGNCSYCRAGYYAQCDDVNPHGKEAGTAFYGGPEITGPFHGLQAEKARIPFAHIGLVKLPEQISDDQAILLSDIFPTGYFGARLAEVSHGDTVAVFGCGPVGQFAIASARLLGATRVFAIDHHQDRLQMARRQGAETIDFDQEDPVATLKRLTAGIGVDRAIDAVGVDAEHACHGDDGRPARSCQWQSGNAPDQVLRWAVEGLAKAGTLSIIGVYPQEARSFPIGLSMNKNLTINMGNCHHRKYIPTLIDMVLNQRIDPASILTQTRPMDDAIAAFEAFDRREPGWTKVQLRPQPQC

SEQ ID NO: 12730 - protein, 312 aa, Scenedesmus vacuolatus
NGFGRIGSLVLRATLDRKDVKVVAINDPFIEGEYMAYMFKYDSVHGRYEGDVQGDKHGITINGEQIKTLAMMDPTQIPWGEVGADYVVESTGVFTTVDKCQAHLKGGAKKVVISAPSADAPMFVMGVNADKYDPKQHTVVSNASCTTNCLAPLAKVVNDTFGIKEALMTTVHATTATQKTVDGPSKKDWRGGRGASANIIPSSTGAAKAVGKVIPELNGKLTGMAFRVPTQDVSVVDLTCILEKPAKYEDIMAALKAASEGPMKGILGYTEDDVVSSDFVSDPASSTVDAKAGIMLSPTFVKLVSWYDNEWG

SEQ ID NO: 12731 - protein, 202 aa, Triticum aestivum
  misc_feature (125)..(125): Xaa can be any naturally occurring amino acid
  unsure (1)..(202): unsure at all Xaa locations
RGGWVVFLWPRNHWVALRWRREAASERGGGSTFELLRAAAGEKTRVLPGEWPTRSSTAVVGVVAFFTKVVYGSMVNQLRITAGVFIVMQQLAEGNGGHYEAIFSIFFGGYDHIIVQGASLTSEEXSLVVVGGSGVFEEASDQLKIIQLVFPFKMFFTFFLKDIIDVPKEVLFSAAVVPSSTVEDTTAAKNAEAPASLSNFSA

SEQ ID NO: 12732 - protein, 237 aa, Prunus cerasus
MVTLKSSLAFLVLAFALFLCFIMSTGDGSYDYFQFVQQWPPATCSLSRTPCYKPRPPQIFTIHGLWPSNYSNPKRPSNCRGSLFDSRKVYPQLRLNLKISWPNVKSGNDTEFWESEWNKHGRCSEQTLNQMQYFERSDEMWNSYNITEILKKAQIVPNATRTWKYSDILSPIKAATNTTPILRCKPDPAQSKSQPSQPKSPQKPQLLHEVVFCYDYHAKKQIDCNRTGCLNKDISFQ

SEQ ID NO: 12733 - protein, 331 aa, Legionella pneumophila subsp. pneumophila str. Philadelphia 1
MFQFNTSQHTLMQILGDGACHSGSELGNALKISRSAVWKQINQLNDLGIPIIRIPHQGYQLEKPLILLDSNEITKQLHSKGFSQPFNLHLFTSIDSTNRYLKDLPSSSAVEICCTEMQTQGRGRFGRHWHSPFGENIYCSTRWSFNCDISKLSGLSLVISLATVLTINEFIVSDKVKIKWPNDILWNNKKLCGILVEIIAESNATAQFIIGVGLNINSDTKNNPLPDKSWCSFFGITNQNYNRNSIVTRLLINLEKYLSKFINNDLNAFKDDWNKYDYLVGKKVKVSQALNSISGIALGINSFGQLILEDEFGNKHELSSGDTSLALSNFE

SEQ ID NO: 12734 - protein, 262 aa, Methylobacillus flagellatus KT
MNLLTLQQMKERGEKIAVLTSYDASFAALSDKAGVDVLLVGDSLGMTMQGHANTLAVSLRDMEYHTRCVANGTQHAFIVTDMPFGSFQKTPEQAFENAVLLMAAGAQMVKVEGGAIMLETVRFLVERGIPVCGHLGLTPQSVHQFGGYRVQARDEAAARQLLDDAKALAAAGAGMLVLEMVPAALAAAVSQAVHIPVIGIGAGKYCDGQVLVLQDMLGIYAGKSPRFVRNFMQGAGSIEQAICDYVAAVKAQTFPGIEHTFE

SEQ ID NO: 12735 - protein, 735 aa, Arabidopsis thaliana
MVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPVQQKATRSWFVFSILGFFFAGVVLNQFGLIRNLTDVKVLSEWGILFLLFEMGLELSLARLKALAKFAFGMGLTQVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 12736 - protein, 273 aa, Agrobacterium tumefaciens
MVKLAAGEVSAMSYNELIGVVRETNRPPGGAGTLREVAEKAFIGPTSRILDIGCSTGFTAVEFARLTGAETIGIDINATSVEVAKDRATRAAAHTASFEVADAMALPFEDGTFDLVFCGNVTSLIDDQSKALTEYLRVLKPNGCLAAVPMYYLEPPPKEVVEKVRSAIQVPIAVKYRREATDFFRPSGLELVHESDWAFDKKTDQEIAAFCRKILGQVEHARFEEEALDVLKSLYASYMSLFRENLSYMGYTIMILRRDAGIDEGELFTGTRR

SEQ ID NO: 12737 - protein, 399 aa, Ehrlichia ruminantium str. Gardel
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSNTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSVAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 12738 - protein, 105 aa, Zea mays
THRRRGGEKAMGVTKEDVEAAITSAFSPSNLVVTDTSGGCGASYEIEVVSEKFEGKRLLERHRMVNTALGSHMAEIHAVSIKKALTPAQAQPQAQPEPAADKPQA

SEQ ID NO: 12739 - protein, 351 aa, Streptococcus agalactiae 2603V/R
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 12740 - protein, 220 aa, Vibrio vulnificus YJ016
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 12741 - protein, 423 aa, Synechococcus sp. WH 8102
MSQRTYHDPLHRGIQLDSHRPGEAMVMALVETAPFQRLRRVRQLGPAFLTFHGAESSRFTHSLGVFHLARQAFERLLKLSPDLEPHRPLLYAAALLHDIGHGPLSHTGEEMFGLHHESWSARIAQNHPQIQACLDQEDQGTAQAVAALLEHGQAPHPVVKRLVSSQLDCDRLDYLLRDSYSTGTRYGQLDLERIMAGLTLSPDGDLAIHPKGLMAVEHYLVVRNLMYRSVYNHRLNVVCNWLLERLVRLARQLGPALVWADGVMQRWLWNAEELDLDSFLANDDVRTGYHLQRWQEEGPPALASLCRRFRERDLLKATAVTQLTREEQLQALAVAGRLAEQRGIDPSLSCGLRHQELRGYHPYRGGLRLWDGEQMQALEEASPLVASLATPAATSWLIHPREIQKELRRTMDVEWGSSLTSDR

SEQ ID NO: 12742 - protein, 453 aa, Pseudomonas stutzeri
MSILNDYKRKTEGSVFWAQRARSVMPDGVTADTRVFDPHGLFISDAQGVHKTDVDGNVYLDFFGGHGALVLGHGHPRVNAAIAEALSHGVQYAASHPLEVRWAERIVAAFPSIRKLRFTGSGTETTLLALRVARAFTGRRMILRIATHYHGWHDFSASGYNSHFDGQPAPGVLPEIAKNTLLIRPDDIEGMREVFAQHGSDIAAFIAEPVGSHFGVTPVSDSFLREGAELARQYGALFILDEVISGFRVGNHGMQALLDVQPDLTCLAKASAGGLPGGILGGREDVMGVLSRGSDRKVLHQGTFTGNPITAAAAIAAIDTILEDDVCAKINDLGQFAREAMNHLFARKGLNWLAYGRFSGFHLMPGLPPNTTDTGSITRAEVARPDVKMIAAMRMALILEGVDIGGRGSVFLSAQHEREHVEHLVTTFDRVLDRLADENLLSWQPTNLSGNQS

SEQ ID NO: 12743 - protein, 409 aa, Vibrio vulnificus YJ016
MAKVSLEKEKIKILLLEGLHPSSVEVLQAAGYTNIEYHKGSLSDADLLEAVKDAHFIGIRSRTNLTEEVINAAQKLVAIGCFCIGTNQVDLNAAAKRGIPVFNAPFSNTRSVAELVLGQILLLLRGIPEKNALAHRGIWKKSADNSYEARGKRLGIIGYGHIGTQLGIIAENLGMRVYFYDIENKLSLGNATQIPTMSELLNKCDVISLHVPETPDTKNMMGAEEFARMKPGAIFINAARGTVVDIEALCHSLESGHIAGAAIDVFPVEPATNADPFESPLQKFDNVILTPHVGGSTQEAQENIGVEVAGKLAKYSDNGSTLSSVNFPEVSLPEHRSCSRLLHIHQNRPGILTQINTIFAEEGINIAGQYLQTSADIGYVVIDVETERSEEALVKLKEIEGTIRARILH

SEQ ID NO: 12744 - protein, 351 aa, Staphylococcus aureus subsp. aureus MRSA252
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCESKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEITFDMEKVIQKEITVVGSRSQKPADWEPSLQLMADGLVNAEALVTKIYDISKWDEAYQHLKSGEGIKALLKPLDLDENEGEN

SEQ ID NO: 12745 - protein, 347 aa, Staphylococcus aureus subsp. aureus MRSA252
MKALKLYGVEDLRYEDNEKPVIESANDVIVKVRATGICGSDTSRYKKMGPYIQGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDIAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 12746 - protein, 758 aa, Gibberella zeae PH-1
MLAKSIDVKVRPLASASLEKASLHGAARVYVSKETLLSLTGTLEVGKHCILTRLESAATKDSVREDDPQQELQREASLWSIKEKNLSPNVAVMTRAFQEAAGFKIGDLIRISLAGTTPNADEIVVQDVTEKTDKTSDDFERLEEYEKAAKYTPPWEALIAPAFVRAELVFPGMVVEATLSSKWRRNFKVISVNSHTNSLGRFDPGSTNITVADENAANAEADAQSGGELVVTGVPGMAPQLKALNGFLSAFRKTLTNPLERESCAFVIHGGHGTGKSFILDRIAATRWGKVHRIKPLDKIASMRETFKLAQSQQPSIVLIDDLENLISKDRSNRDSVIDLLGEELDQLATSAVSNDSLPQVVVVATCSDFLTDIPNQLQRSTRFDNHVPLTIPRIQERLEILEFLDLPINPAEKQSVLLDLAQRTHAYSPLDLRRLCTRARYVMGLRLREAGDDTFSTERFLEISDINKAKKAIRSTAMRDINLNPPTIHWRDVGGQDVLKKVLNRMVKYTKNPEGSLRPPPKGLLLYGPPGCSKTLSAQAAATESGFNFFAVKGAELLNMYVGETERAIRTLFARASNAAPSIIFFDEIDSIGGQRSGSGAASRSTGAVNMLTTLLTEMDGFEPLSGVLILAATNRPESMDPALMRPGRFDQLLYVGPPDEATREAIFKVHLRGLPLAPDVDIPQLSRLADGYSGAEIKAICDETCMVVQERHDEDETEKLELAMADLTIVLERTPRNITKQMIDGYEKWHKLHKRG

SEQ ID NO: 12747 - protein, 255 aa, Escherichia coli
MRHPLVMGNWKLNGSRHMVHELVSNLRKELAGVAGCAVAIAPPEMYIDMAKREAEGSHIMLGAQNVNLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 12748 - protein, 959 aa, Vibrio angustum S14
MTNTTFLQALSDDNDFSHRHNGPNALEQQRMLETIGVGSIDQLIAQTVPASIRLTEPMTLPQAQSEAAMLAELKQIAGKNIINKSYIGQGYYNTFTPNVILRNVLENPGWYTAYTPYQPEISQGRLESLLNYQQMIMDLTAMELANASLLDEATAAAEAMTLCKRAGKNKSNAFFISTDLHPQTIDVVTTRAKYVGFEIITGSAEDLAKHDVFGALLQYPASNGELQDLTDIIDAAHDKKTLVAVASDLLALTVLKAPGEMGADVVIGSAQRFGVPMGFGGPHAGFMATKDKHKRTMPGRVIGVSKDAKGNQALRMAMQTREQHIRREKATSNICTAQALLANMAAFYALYHGPEGLKKIGRRVHHFTAVLAAGLRNNGFELENQHFFDTLTIKTGNKTNALYQKALDAGINLRKYKDKLGVSIDETTLAEDIEQLLGLFTNQDLKVSMFSDDIAADEFAAIPPACRRSSAYLTHSVFSRYHSETQMMRYMKQLENKDYSLTHGMIPLGSCTMKLNAVAEMIPVTWPEFGQLHPFAPQAQTLGYQELAKNLSEMLCSITGYDAFSLQPNSGAQGEYAGLIAIQRYHEANGDSHRNVCLIPSSAHGTNPASAAMVSMKVVVVGCDELGNIDIDDLKAKIEKHRDALSCIMITYPSTHGVYEEVVQEVCDLVHEAGGQVYLDGANMNAQVGLTSPGFIGSDVSHLNLHKTFCIPHGGGGPGMGPIGVKSHLTPFLPGHVEDTNSDELQYAVSAAALGSASILPISYAYIAMMGEQGLTQATELAILNANYVMERLRPHYPVLYRGTEGRIAHECIIDLRPIKDASGISEEDIAKRLMDYGFHAPTMSFPVAGTLMIEPTESEDIAELDRFCDAMIAIKEEINLVQSGEWPLDDNPLVNAPHSQVDMMESEWNHAYSREVACFPSAHTKAAKYWPSVNRVDNVFGDRNLVCSCPSIENYIED

SEQ ID NO: 12749 - protein, 312 aa, Magnaporthe grisea 70-15
MADKDFTLNTGAKIPAFGLGTWQGDKGVIKEAVLTAIKSGYRLIDGAYVYGNEEEVGQGIREAISSGIVKREDLFVVSKCWATYTTRCELGLDQSLKLLGLDYVDLYLVHWPILMNPEGNDEKFPKHADGSRDIIHTHNHVDTWKLMEKLPATGKTKAVGVSNYSKAWLEQLLPHATTVPAVNQVENHPQLPQQELVDFCKEKGIHIMAYSPLGSTGGPLLTAEPVVKIAEKHSISPAAVLLGYQIARGITVIPKSVNPDRIKANAQLKDLDAEDMKLLNDYSEQLAKDGKLNRYVFPPFGTDFGFPDKVGQ

SEQ ID NO: 12750 - protein, 409 aa, Escherichia coli
AKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 12751 - protein, 477 aa, Corynebacterium glutamicum ATCC 13032
MAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 12752 - protein, 453 aa, Novosphingobium aromaticivorans DSM 12444
MPRPEWLRQGRNPPFLSRLEPNGPSDRRNLMRAKPNDVDLRERAAKVIPNGMFGHEATHLLPASFPQFFSRAKGAYIWDVDGNRYLDFMCAYGPNLLGYGDELIDAAATRQLALGDTMTGPGPVLVDLCETLVDMISHADWVMVCKNGTDATTMALTAARAQTGKRRVLVAEGAYHGAAPWCTPMPGGIVPEERAFISKYKYNDVASLEAAVAAAGDDLAAIFASPFKHDAFEDQALPDPAYARRARELCDQTGAMLIVDDVRAGFRLVRDCSWELVGVRPDLSSWGKSFANGHPISALLGSNSCRAGAEAIYATGSFWFSAVPMAAAIETLRILRESDYLERTIRLGERLREGLAAAAARHGFSLRQTGPVQMPQILFNDDPDFRIGFAWAEAMLERGVYVHPWHNMFLNGAMSETDIDFAIEAADGAFAQVREHVGELEPHATLMSLLGAH

SEQ ID NO: 12753 - protein, 191 aa, Glycine max
AAATYCTSLVLPRVRPSVGFTGILVLLVFLSACCSSTHGSLETEKTFAIIKPDGLLGNYTDDIKRTIVEYGFRILKEKIVQLDEGTVKSFYAEHSSKSFFSSLIKYMTSGPVLIMVLEKDNAIADWRALMGPTDASKAKITHPHSIRAKCGLDMEKNCVHGSDSPKSAQREISFFFKELSAEFLLKLIVVF

SEQ ID NO: 12754 - protein, 238 aa, Oryza sativa
MAVKKTMKVVFSLVLLLLPLASTSAVEVKFDFMYFVQQWAPSYCSTAPHECEYEPRLPPNNFTIRGLWPSYEEWRPEYCNISDRLDPGQIQDLVKPLNQSWPSLLRNETNLELWSHEWSKHGTCSNLSQHGYFAAALALDKLKLTNLTKILADGGVVPSDEKTYTLGEISDALAKGTGFSTYLRCSQNELKYGETLLYEVLQCVDRSGEKLVNCTTPYWVTRCLDPDKIKIPAWFYGQ

SEQ ID NO: 12755 - protein, 417 aa, Aspergillus nidulans FGSC A4
MSSISGFLGAIPGAQQILQTMAGSLGLAPLSHPEIASSGSTFQQCGKLELSCQTSYHGQDTCCFNYPGGQMLQTQFWDADPAVGPENSWTIHGLWPDHCNGGFDQFCDSHRKYSNISLILIDAGRRDLLDEMSTYWKDYRGDDPNLWEHEWNKHGTCVSTLETHCYSEYYPQQEVVDYFDKTVELFHDLPTYMTLANAGIVPSYTQTYTRHEVEDALSKAHGATVTVRCRSQRLQEVWYFFNVEGPLQTGKFVPSEPDGQTSNCPAKGIIYQPKTPNKDPGHGHEPTKTRHPHGPTGAPFIGKGNLVVSTMGQQRGCIIGRGTWYSSGTCADFRAKRASGDTFTLSSRKGPCAFKDDIFTCGSYISSPAEFSAEDGKLSYHGNTTFFADKAPKGKVQSDIFVSEADHPIELSIAWRG

SEQ ID NO: 12756 - protein, 156 aa, Brassica napus
FYLLLILFIRTNQCSSSSYSSQTLVLPLKTRITPTDNSGHRPTDKLHFHHNVTLTVTLTVGTPPQNISMVIDTGSELSWLRCNRTSNPNPTNNFDPTLSSSYSPIPCSSPTCRTRTRDFLIPASCDSDKLCHATLSYADASSSEGNLAAEVFHIGY

SEQ ID NO: 12757 - protein, 357 aa, Pseudomonas fluorescens Pf-5
MAKMKAAVFVEKNRIVLEDKDIPEIGPLDALVRITTTTICGTDVHILRGEYPVAKGLTIGHEPVGVIERLGSQVRGFHEGQRVIAGAITPSGQSYACLCGCGSQDGPDTRHGFRATGGWKFGNTIDGCQAEYVRVPDALANLCPIPDGLSDEEVLMCPDIMSTGFSGAERAEVNIGDSVAVFALGPIGLCAVAGARLKGATTIIGVDTVAARMSVARGLGATHVVDFKHGDVVKQIMDLTDGRGVDVSIEALGTQGTFESALRVLRPGGKLSSLGVYSSDLRIPLDAYAAGLGDLSILSTLCPGGKERMRRLMEVVASGQVDLKPLVTHRFKLDDIEAAYELFASQRDGVMKIAITP

SEQ ID NO: 12758 - protein, 414 aa, Ostreococcus tauri
MGDRRTMVTDRVPTAWTRSRARWSGKRWRGECAWDRDGTVTDGATARDVGVKKNAANAATVAKSDGAEAVKENVRWHAAKSTSALPIEFGTPEMYQAVAQSVREGLFDRWNDTYAHFHKENPKQAYYLSMEYLQGRALTNAIGNMGLTGEYSDALRSLGYTLEDVMSVERNAGLGNGGLGRLASCFLDSIATLDLPAWGYGLRYKYGLFKQAVDKKTGEQLEFADDWLEVGNPWEVARPQTAYPINFYGKVVDGKWVPGQQVRAVAYDSPIPGYDTRNCISLRMWDAQPSAVDFDLASFNASDYETSMGPTNLAAMLCAVLYPGDGTREGKALRLSQQYMLCSASVQDILARWKERGNTDWTKLPEKVAIQMNDTHPTLAAPELMRILMDEEGLSWDDAWAITTKTVAYTNHTV

SEQ ID NO: 12759 - protein, 323 aa, Yarrowia lipolytica CLIB122
MTRSKFTEYKQVLRNSCVGKPQYTEKDYPDLDGKNFLVTGATGGVGLEATKLLLEKKSHVIMVGRSKTKSQSTLDELQKTYSHGTFDFVEADLSDLTTVERAGEYIRSKYTTLDGAILNAGVMAPPYSLTPQGHESQWGINVVAHFLLSKYISPALISAAQTAPKDTVRLVWVSSSVVAMSPYEGGIKFDDINHSKVKNPSPWTLYSQSKIGDAYLAYLWSKHHPDSGVLSVSLDPGNLASDLSRHTSWLSSIKNYVLYPPKYGAYTELSALLNPSVKNNEHLIPWGIEGHLRQDVDDGRRGKDGEELWQGLNKDVEGFFKEE

SEQ ID NO: 12760 - protein, 119 aa, Triticum aestivum
MAAAAATKASSWMVAMSVGAVEALKDQGGLCRWNYALRSVYRTAKANVRSGSRSFAAQRDKDLGPGGGEGAGRTRPRGGGFRTVMFLSCWGPINYLSYPNWPWLPQRPRTRQLIINIRR

SEQ ID NO: 12761 - protein, 139 aa, Cytophaga hutchinsonii ATCC 33406
MGGNRTFSMIKPDAVKDGHSGSILKMIEGAGFRIVAIKLTYLSAERAGEFYAVHTGKPFYDSLKSIMSESPIIALILEKENAVEDFRKLIGATNPANADAGTIRKLFAKSLERNAVHGSDSDENAQIEGSFFFSALEKF

SEQ ID NO: 12762 - protein, 230 aa, Gloeobacter violaceus PCC 7421
MDLDILKQTAARRAVELVEDGMVVGLGTGSTAAFAVSVLAERVRLGLRVVGIPTSERTARQAEAEGIVLGTLAEQSRVDLTIDGADEVALGELALIKGLGGALLREKIVAAASERLIIIVDATKLVEQLGSHGPLPVEVAPFGWQATARALERLGAEVNLRAQHGQAFLTDGGHYILDCRFGPIARPAELEAAIDRIPGVVESGLFVGMASAVIVADEGGIEVLTPSAAP

SEQ ID NO: 12763 - protein, 230 aa, Staphylococcus epidermidis RP62A
MKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 12764 - protein, 474 aa, Anabaena sp.
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNLIHPGEPLDKNIYELSPEELAKVPSTPGSLELALEALENDHAFLTDTGVFTEDFIQNWIDYKLANEVKQMQLRPHPYEFSIYYDV

SEQ ID NO: 12765 - protein, 466 aa, Xylella fastidiosa Ann-1
MMSHPLSSLRDLEYHGAFVERHIGPNDVEIAQMLRVVGYDSLESLTDAIVPEKIRSTVALDLPKGITEEEALAKIRVIANKNQVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDALAIHCAAAAAGMNLRMIDNAQLGISLDETVTRSDVVALGQVFGVQVDVEALDAITADALPAGLLRSS

SEQ ID NO: 12766 - protein, 447 aa, Arabidopsis thaliana
GDGKSGDTSFNVLRRVLSPKEKDLIKKLPGQPSGVSFRQYGGYVPVNEPSSRFLYYYFVEAIKPNTSTPLVIWFNGGPACSSLGGAFLELGPFRVHSGGRKLFRNPYSWNNEANVLFLESPVTTGFSYSSNPIDLEELGEKGDKATAEDNYIFLMNWLERFPEYKGRDIYIAGQSYAGHYVPQLAQIIIHRNKKTLVNLRGILIGNPSLLTSIQDPYGYEFMLSHGLMSQQQMDNYNQFCLRDDLYDNDKCALSVKTIDDAKKHLDTYNIYAPVCLNSTLSRISKKCTTVLEVDPCSKDYLKAYLNRKKVQKAIHANTTKLPYEWTSCNNELTENWSENDRDTPMIPILHELMGEGVRVMIYNGDVDLEIPFASTLAVVKEMNLTVVKEFRPWFTGGQLGGFTEDYKGNLTFVTVKGAGHSVPTDQPIHALNIFTSFIRNTPLPHTA

SEQ ID NO: 12767 - protein, 388 aa, Legionella pneumophila str. Paris
MNHYEKMSLLKDSATVAINSLAQQKIHAGIKIHNLSAGEPKLPPHPSIINAVTQAMEQGHTLYPPIMGIPELRHMGCEWMYRSYDCSFQNEQCLIVNGGKLGIYLLMQLLLQPKDEVIIPSPYWVSYPAMVSLFGGTPVPVETTEAEEWKLTPQALQKACTTKSKILILNNATNPTGALYTQSELIHLLQIAKKHNLLVISDEVYSELTYDGHHYVSCGSLPQFRERVIIIQSCSKNFSMTGWRVGFIFAPEIFIKPLSALVSQSTSGVATLSQWAAVAALQEINQVNIWVQQNMEKRRNCLLRTLHDYLGLTITPPISSLYVFLSLKDIGCKNQNSEEFCKQALDKANVAMVPGIAFGKEGYVRLSFGGNEDDLKSGIYALAQWLHR

SEQ ID NO: 12768 - protein, 75 aa, Brassica napus
  misc_feature (10)..(10): Xaa can be any naturally occurring amino acid
  misc_feature (21)..(21): Xaa can be any naturally occurring amino acid
  unsure (1)..(75): unsure at all Xaa locations
FIFAEREWPXACVNHWCDFVXNRHSKAISMDTWAQLLEFFRTVDLELSNYGAEGAWPYLIDEFVEYLYDKSIVEK

SEQ ID NO: 12769 - protein, 314 aa, Lycopersicon hirsutum
KISFNKVPLYYRNVSGGSRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 12770 - protein, 928 aa, Oryza sativa
RSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKQIITKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKICHVLYPGDESPEGKVLRLKQQYTLCSASLQDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 12771 - protein, 287 aa, Methanosarcina barkeri str. fusaro
MYSIYSGGFSLVRSLLKKYNIKGGTFDQHFLVDAGYLDRIVAAAELGPKDVVLEIGAGVGNLTERLAKKVKKVIAIELDPVLVRVLHDRFDKVGNIEIIAGDALKVEFPEFDKIVSNLPYSISSEITFKLLRHKFKLGILMYQYEFAARMVSQPNCKDYSRLTVDTCYFADASILMKVPKSAFQPAPEVDSAVIKLVPRPVPFEVKDQAFFMNFVSAVFSQRRKKLRNAILNTNYLLKIPNIKEVISRLPEDMMSKRAENLTPEELAQVANHIIDLKTSILANELNE

SEQ ID NO: 12772 - protein, 500 aa, Staphylococcus epidermidis RP62A
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 12773 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 12774 - protein, 272 aa, Vibrio vulnificus YJ016
MEHKNIAFIGAGNMVRAIVSGLVADGYPADKITATAPSETRRLPLEQQFGIQTTSDNFMAATQADVIVLSVKPQMMEEVCKPLQSVDFSNKLVISIAAGINCARLNEMLATQLNLVRVMPNTPSQLGLGMSGLYAPVSVAEQDRHFAEQLMQAVGKTCWVDEESGINHVIAAAGSAPAYFFLFMEAMQAEAMAQGFDKQTARLLVQQSALGAASMVVENPDTELATLRENVTSKGGTTAEALRTFNEHQLSDIVAKAMQAAVARAQEMEKLF

SEQ ID NO: 12775 - protein, 114 aa, Synechocystis sp. PCC 6803
MTSMPIEISVQDLALMLAHPNGDRQLIDVREPHEVEIAALPGFETLSLSEFAQWSGTIRERYDGEKETVVLCHHGIRSDQMAHWLVDQGFSKVKNVVGGIDAYSRLIDATIPCY

SEQ ID NO: 12776 - protein, 1097 aa, Cytophaga hutchinsonii ATCC 33406
MQVYIPDKPYEIFSLTYCFETIYNMKQRTFVLLFFILTLSSYAQTLKLETVIQKGHSASVKAVAVSPDGKILATGSRDKSVKLWDQQSGMEIRSLIGHDHTVNGLAFSPDGKLLATSSADGTARVWDILTGKEIFTSPKNSKYITDVAFNPDGKSFAYAGYPDSASIYAIPSGKLIKRLEVNADQGSGYGISLKYSNDGKWLAIGEDNKTANVYRTSDWHLAYTFKPAEGWCGGCGTYVEFSRDNKSLFKIAHNDKLSQYDLQTGSLIKTFGEPVDYLRGITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESGLEFYEHVHISSREWMARTPQGYFSATEQARADIHFVKGMDVYAPDQFFEYYRPDLIQQIFLNRGSSPTGMQNVENSLQLSPPPLIKLACIPNADGLQATLNIKVMDEGGGLSEIRLAHNGKNMAVALDPKKVVEGKGNSYIYSVPVSLVRGTNQFSGIAVSKGKIESAASLVSVVSDKAPSAAVCHVFAIGIDTYKNPAYTLNYAREDAEAFAESVKRNGANLYQKVIVHGLYDAAATRQNVLDTLKSLEAHIALNDVFIFYYAGHGSMVDQNFYFIPTECTSMYQATANNALSAETIQAGFKNIKALKQIIIMDACQSGGSVEVLAMRGANEEKAFAQLSRGAGIHVMASAGSEQNAKEILELKHGLFTYVLLEALNGKADGAPKDGKITIYELKSYLDDQVPELNSKYSGKIQFPYTFSRGSDFPIVLE

SEQ ID NO: 12777 - protein, 235 aa, Synechocystis sp. PCC 6803
MAELDAANLMKQAVGKAAADRVKSNTIVGLGTGSTTAYALEFIGDRLKKGELENVVGIPTSFQAEVLARKYGIPLTTLDVADRIDIAIDGADEVDPQKNLIKGGGAAHTREKIVDALAETFLVVVDSGKLVDKLGSTFLLPVEVIPMALTPVMRALAKLGGKPELRMGVKKAGPVVTDQGNLVIDVKFDAITNPAELEKTINNLPGVLENGLFVGVADVILVGEIIDGQPTVREF

SEQ ID NO: 12778 - protein, 453 aa, Haloquadratum walsbyi
MSTQPPGPNGVPVFGNSRQYASDPFTFLRSVADAYGDVVRFSLGPLDTYMLTNPVDIERVLVTDDQKYQKPDFQDDAIGTLLGDGLLLSEGETWQKQRQLAQPAFGPKRITSLAGTMTDHTRGMLDGWEPGDIKDVHLEMARVTVRIIVEAMFGTSLTDTQTTAVQENLEPLGKRFEPDPLRFIIPDWVPTQENQEYHKSVSVLEDIIDEIVSERRGTETNSDIDPGAGSDDDPMDLLSILLRAKQRGEQTDKQLRDEMMTILLAGHDTTALTLTYTWYLLSEHPKVRDQVHEELASVCGGETPTMADTRSLDYTERVLQESMRMYPPVYVIFREPQVDVRLGGYRIPAGSAIMLPQWVVHRSPRWYDNPTTFDPDRWRPERRADRPRFSYFPFGGGPRHCIGKHLSMLEAKLILGTVAQSYELDYVRDRPFDLRGSLTMHPDEPMGMRVTER

SEQ ID NO: 12779 - protein, 317 aa, Staphylococcus epidermidis RP62A
MTKVYIAGAIPEVGLNLLKEHFEVDMYDGEGLIDKETLKKGVEHADALISLLSTSVDKDIIDSANNLKIIANYGAGFNNIDVEYARQQNIDVTNTPHASTNATADLTIGLILSVARRIVEGDHLSRTTGFDGWAPLFFRGREVSGKTIGIIGLGEIGGAVAKRARAFDMDVLYTGPHRKEEKERDIGAKYVDLDTLLKNADFITINAAYNPSLHHMIDTEQFNKMKSTAYLINAGRGPIVNEQSLVEALDNKAIEGAALDVYEFEPEITDALKSFKNVVLTPHIGNATFEARDMMAKIVANDTIKKLNGDEPQFIVN

SEQ ID NO: 12780 - protein, 474 aa, Legionella pneumophila subsp. pneumophila str. Philadelphia 1
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDINGVSVAYPNLANELSIGDHLLINDGLIELEVIEISGSKIHCKVVEGGVLTDLKGLNRKGGGLAARTLTEKDRNDLRTAIEAEVDYISLSFVKDAEDIRQARALMKDYGAQITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWVSRHHSTVPIFAISANKRTIGRLSLVNNVFPIYIDFHQFNPEGLNQQILHELIKSGHLEKRGYVLLTRGTQIGMPGGTNCMEIIPVV

SEQ ID NO: 12781 - protein, 670 aa, Pseudomonas aeruginosa
MSRSAFTALLLSCVLLALSMPARADDLPYRFGLGKADITGEAAEVGMMGYSSLEQKTAGIHMRQWARAFVIEEAASGRRLVYVNTDLGMTFQAVHLKVLARLKAKYPGVYDENNVMLAATHTHSGPGGFSHYAMYNLSVLGFQEKTFNAIVDGIVRSIERAQARLQPGRLFYGSGELRNASRNRSLLSHLKNPDIAGYEDGIDPQMSVLSFVDANGELAGAISWFPVHSTSMTNANHLISPDNKGYASYHWEHDVSRKSGFVAAFAQTNAGNLSPNLNLKPGSGPFDNEFDNTREIGLRQFAKAYEIAGQAQEEVLGELDSRFRFVDFTRLPIRPEFTDGQPRQLCTAAIGTSLAAGSTEDGPGPLGLEEGNNPFLSALGGLLTGVPPQELVQCQAEKTILADTGNKKPYPWTPTVLPIQMFRIGQLELLGAPAEFTVMAGVRIRRAVQAASEAAGIRHVVFNGYANAYASYVTTREEYAAQEYEGGSTLYGPWTQAAYQQLFVDMAVALRERLPVETSAIAPDLSCCQMNFQTGVVADDPYIGKSFGDVLQQPRESYRIGDKVTVAFVTGHPKNDLRTEKTFLEVVNIGKDGKQTPVTVATDNDWDTQYRWERVGISASKATISWSIPPGTEPGHYYIRHYGNAKNFWTQKISEIGGSTRSFEVLGTTP

SEQ ID NO: 12782 - protein, 344 aa, Rhodopseudomonas palustris CGA009
MNLADLNQIARAMVAPGKGILAADESSGTIKKRFDVIGVESTETNRRDYREMLFRSKEAMSDYVSGVILYDETIWQNAADGTPLVKLIEQAGSIPGIKVDEGTQPLPNCPGETITVGLDKLAERLAKYYKQGARFAKWRAVIDIDTARGVPSHTAIMTNAHALARYAALCQQAQIVPIVEPEVLMDGAHDIDTCYNITEWVLKETFQQLYFQRVALEGMILKPNMAVPGKKSAKKASVQEVAEKTVKLLKACVPSAVPGIAFLSGGQSDEEATAHLDAMNKIGGLPWGLTFSYGRALQAAPQKAWSGKAENVAAGQAAFTHRARMNSLAAKGEWSAELETKKAA

SEQ ID NO: 12783 - protein, 376 aa, Eremothecium gossypii
MDSGEVAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHAILRIDLAGRDMTDYLMKILSERGYSFSTTAEREIVRDIKEKLCYVALDFEQEMQTAAQSSAIEKSYELPDGQVITIGNERFRAPEALFHPSVLGLEAAGIDQTTYNSIMKCDVDVRKELYGNIVMSGGTTMFPGIAERMQKEITALAPSSMKVKIIAPPERKYSVWIGGSILASLTTFQQMWISKQEYDESGPSIVHHKCF

SEQ ID NO: 12784 - protein, 277 aa, Prosthecochloris aestuarii DSM 271
MNKQSTQKLPHVTTRRLHDMKSEGEKISMLTAYDYTTARILDRAGVDVILVGDSASNVFAGHNTTLPITIDQMIYHARAVVRGVQAETSRAMVVIDMPFMSYQLSSEEALRNAGKIMKENECDAVKIEGGNVIVDTVKRITDVGIPVMGHLGLIPQSIYKFGSYKVRAREEQEAEELLRDAKLLEEAGAFALVLEKIPADLAAEVTASISIPTIGIGAGGACDGQVLVINDMLGLSTEFHPRFVRRYAELDRVIFDAVSRYVDDVRGGTFPGEDESY

SEQ ID NO: 12785 - protein, 247 aa, Chlorobium tepidum TLS
MKKLVLLRHGESQWNRENRFTGWVDVDLSEKGREEARTAGQLLKDEGFVFDLAYTSVLKRAIRTLWTVLDEMNLMWIPVTKNWRLNERHYGALQGLNKAETAQRHGDEQVLIWRRSYDTPPPALTESDEFWPGKDPRYASLSSQELPATECLKDTVARFLPYWHETIAPQIRDGKNVIITAHGNSLRALVKYLDNISDEDIVGLNIPTGIPLVYELDDDLKPLKSYYLGDQEELKKKVEVVVKQGKA

SEQ ID NO: 12786 - protein, 771 aa, Candida glabrata CBS 138
MAPKSASSGSKKKSSATSDEIKQPKFKLPTEYIIRPLPANSNSKESGTITVNSKVLSALEISSGSFCIISKFGENGIAAIANPSKNENHPANVILVSDTLRSVSNIILGDRVEIQKLTQQPAYAKSITVGPFEEGLANEKVKLVEKLLDDCGLIMPGMRFNEIATDNNEKLHFVVTDVDDDDLPDIGKLSLNADESETLEFMSKPVLFKKGLTKLKFTADKNVSKKYSLPQSLSYDAVGGLKCEIDLLKKAIDLPLHRPEIFADFGISPPKGILMHGPPGTGKTMLLRCVANASNAHVLSIDGPSIVSKYLGETESKLREIFNEAKKYQPAIIFIDEIDSIAPNRANDDSGEVESRVVATLLTLMDGTSSSGRIAVIAATNRPNAVDPALRRPGRFDQEIEIGIPDVDARFDILKKQFEKISTDKHTLSEGDIKSIASKTHGYVGADLTALCRESVMKTIQKALTENSTTDMTELKVGITDVESAMLEIRPSAMREIFLEMPKVYWSDIGGQEDLKRKMKEMIQLPLEAADTFAALGIKAPKGILLYGPPGCSKTLTAKALATESGVNFLAVKGPEIFNKYVGESERAIREIFRKARAASPSIIFFDEIDALSPDRDGSSTSAANHVLTSLLNEIDGVEELNGVVIVAATNRPDEIDSALLRPGRLDRHVYVSPPDFNARLQILKKCTKNFDLDNTDELLNDLATRTEGCSGAEVVLLCQEAGLAAIMDDIHTKKVDANHFEVALQGISKCITPEMLEYYQEFASRSGIAS

SEQ ID NO: 12787 - protein, 409 aa, Halobacterium sp. NRC-1
MTTTIKDSVHDHIEVTGVVAALLDTPPLQRLRNVAQLGTVSLVYPSANHTRFEHSLGVYHLADRALDHLGITGQRATRVRAAAILHDIGHGPFSHNVEDVIERHTGNRHDDVHDLVASGQVASVLADHDIQPAEIAALVAGDGEPLAQLVAGELDVDRMDYLVRDAHHTGVPYGTIDHGRLIRGLTFIDGDLVLGAGNVQSAESLLLARALMNPTVYSHHVARISKSMLRRAAETLLATTDVTAPALRRMDDHDLVAALRAHDATSRVAARLFERDLYKRAVWAELGDVDDDLVGADHDTVRGFERAIAADAGVPERDVIVDAPSEPSMPESSTGVLVNGEVRRLHEQSTLVTALQTAQREQWRLGVYTPRAHTDVVGRATERVLGLDPDDGLVTEVNAPDDSPPGFSE

SEQ ID NO: 12788 - protein, 526 aa, Aspergillus nidulans FGSC A4
MAASSSLDHLSNRMKLEWHSKLNTEMVPAKNFRRTSIICTIGPKTNSVEKINALRRAGLNVVRMNFSHGSYEYHQSVIDHAREAEKQQAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 12789 - protein, 110 aa, Magnaporthe grisea 70-15
MAESEITEASIKDALTQRLKAIHAEVTDMSGGCGQAFTVLIVSSEFAGKNSLKRHRLVNAAMKDEIARIHAWTAKCQTPEEWERDKASATGADGPSMDGTVGGHVDGVKE

SEQ ID NO: 12790 - protein, 129 aa, Candida albicans SC5314
MFKVIKTGKSKSKSWKRMITKHTFVGEGFTRRPVKMERIIRPAALRQKKANVTHPELGVTVFLPILGVKKNPQSPMYTQLGVLTKGTIIEVNVSELGLVTAGGKVVWGKYAQITNEPDRDGCVNAVLLV

SEQ ID NO: 12791 - protein, 257 aa, Triticum aestivum
HYRTSLYKKAGWYRSGIPGISSTHASADAQRTMLAYQGTSSTLAYDSDLAEIVSKSNLLIVEGYLFEFSHTIEAIKQACEDAKKNGALIAVSASDVSCIKRCHSDFWDIVGNYADILFANANEARAFCELTSEESTMSAARYLSHSIPLVSVTDGMHGSYIGVKGEAIYIPPPACIPVDTCGAGDAYASGILYGILRGASDLKGIGLLAAQVPAVVVGQQGTRLRVKDADRLAESFEFHLDNLEFCSDAGTDQVPNL

SEQ ID NO: 12792 - protein, 444 aa, Bacillus licheniformis ATCC 14580
MAKYTRDDIVKLVNEENVKYIRLQFTDILGTIKNVEIPVSQLEKALDNKVMFDGSSIEGFVRIEESDMYLYPDLDTFVIFPWTAEKGKVARFICDIYNPDGTPFEGDPRNNLKRILKEMEDMGFSDFNLGPEPEFFLFKLDEKGEPTLELNDKGGYFDLAPTDLGENCRRDIVLELEEMGFEIEASHHEVAPGQHEIDFKYAGAIRACDDIQTFKLVVKTIARKHGLHATFMPKPLFGVNGSGMHCNLSLFRNGANAFFDKDADLQLSETAKQFIAGIVKHATSFTAVTNPTVNSYKRLVPGYEAPCYVAWSAQNRSPLIRIPASRGISTRVEVRSVDPSANPYLALSVLLAAGLDGIKNKLEAPAPIDRNIYVMTKEERLENGIVDLPATLADALEEFKSNEVMVKALGDHLFEHFVEAKEIEWDMFRTQVHPWEREQYMSQY

SEQ ID NO: 12793 - protein, 131 aa, Glycine max
  misc_feature (50)..(50): Xaa can be any naturally occurring amino acid
  unsure (1)..(131): unsure at all Xaa locations
EASVSRNRSTIIVPAGSSRDEGWAAFRNVLAEINEASRLFILPNQQNSEXQSVSKVIRADQKRFFFDLGSNNRGHFLRISEVAGSDRSSIILPLSGLKQFHEIVGHFVEITKDRIEGMTVANVRTVDPPQR

SEQ ID NO: 12794 - protein, 148 aa, Mesembryanthemum crystallinum
MASKRILKELKDLQKDPPTSCSAGPVGEDMFHWQATIMGPSDSPYAGGLFLVTIHFPPDYPFKPPKVAFRTKVFHPNINSNGSICLDILKEQWSPALTISKVLLSICSLLTDPNPDDPLVPEIAHMYKTDKGKYESTARSWTQKYAMG

SEQ ID NO: 12795 - protein, 245 aa, Ralstonia eutropha JMP134
MRQKLVIGNWKMHGSLAANAALLEGIKAAPARARLAVCAPFPYLAQCQALLNGSQVAWGAQDVSAEARGAFTGEVAASMLGEFGCTYALVGHSERRTYHGESDAVVAAKALRALEFGIIPVICVGETLAQREAGETEVVVGRQLQAALDALSVEQLGRVVLAYEPVWAIGTGKTASSEQAQAVHAFLRAEVRERDAGVADRMAILYGGSVKPDNAAELFSMSDIDGGLIGGASLKSEDFLAIGNA

SEQ ID NO: 12796 - protein, 481 aa, Triticum aestivum
MTEVALLRGATNLASPASRGPSSSLRYLANADSDVLQRGGSGESPTGSAGRTEREVQGSEEEERWSFLALLLALLRKSFLGCREEGDQGEGCAMEIGWPTEVQHVAHVTFDRFHGFLGLPVEFEPEVPRRAPSASASVFGVSTESMQCSYDPRGNSVPTILLMMQRRLYEQGGLRAEGIFRINPENSQEELVRDRLNSGIVPYGIDVHCLSGLIKAWFRELPSGVLDPIPPEQVMQCQSEEDCARVAKCLPLAEAALLDWAVNLMADVVQEEKINKMNTRNIAMVFAPNMTQMADPLTALMYAVQVMNFLKMLIEKTLKDREESNLDDVSLPQKDPSDENGHHNPGFAVDSHRAEGSRRPSFFSEEPLLNSPAHSTEDKPNETNPTGGDSAPSGQILNTVGSCRWSQPLPAASATTDISLAAALNSLQGNGSRSLNSSRRTRKGKGQSGTPAVAPPTEKKSRGASIVSRLNSTVERIEAWR

SEQ ID NO: 12797 - protein, 443 aa, Brachypodium sylvaticum
MLIYRSFRPAAASNSSTSAFSVMHRHGPCSPLQTPDDAPSDADLLEHDQARVDSIHRMIANETAVVGQDVSLPAERGISVGTGNYVVSVGLGTPARDLTVVFDTGSDLSWVQCGPCSSGGCYHQQDPLFAPSSSSTFSAVRCGEPECPRARQSCSSSPGDDRCPYEVVYGDKSRTVGHLGNDTLTLGTTPSTNASENNSNKLPGFVFGCGENNTGLFGKADGLFGLGRGKVSLSSQAAGKYGEGFSYCLPSSSSNAHGYLSLGTPAPAPAHARFTPMLNRSNTPSFYYVKLVGIRVAGRAIKVSSRPALWPAGLIVDSGTVITRLAPRAYSALRTAFLSAMGKYGYKRAPRLSILDTCYDFTAHANATVSIPAVALVFAGGATISVDFSGVLYVAKVAQACLAFAPNGNGRSAGILGNTQQRTVAVVYDVGRQKIGFAAKGCS

SEQ ID NO: 12798 - protein, 532 aa, Yarrowia lipolytica CLIB122
MSYGTAPIDYPPDRQRRSSILIPSIPSSPFTGVNSLGRFASSFQRAQSFLNLDPPQGLNRERTYFDDDEFSPYRRGDHTGDDESVFDESDFLDEPSFAYTESVQPRSRLDSLVSQDAPLLVKRVENADGTIVTSVEGQSTAPQTVFNSVNVLIGVGLLSLPLGFKYAGWGIGMVLLLASAYSTHYTAKLLAKCMDTDPSLVTYADIGYAAFGSKARVLVSLLFSLELVAACVSLVVLFADSLNALVPQVTKTEWKVVAFFVLTPPTFLPLSVLSISSIMGIMSVVGLVVIVFIDGLVKPTAPGSLLDPMPTSMFPHAWILVPLSFGIFMAPWGGHAVFPNIYRDMRHPQKYTKCLKTTYRITLGLDLAMGVLGFLMFGDQIQDEVTKNILTTEGYPAVLNVIVTVLIALIPLSKTPLNARPIISTLDALFNIQASQTPGAKIARVSTRCICVATFVILSMVFPSFDKIIALMGSGFCVSICLILPLSFYLKIFRHDIKGGERFFIYALLLIYSAVAVVGTIWSFLGVEPPHV

SEQ ID NO: 12799 - protein, 270 aa, Methanosarcina mazei Go1
MINRKIGFIGAGKMGSALMQGIIKAGIVQPENIGASDVYEPFLKELQTKLGIRVSTDNTVIVRESDILILAVKPQTLGSVLENLKNEITSEKLVISIAAGVPLSTYEGALLEGTRVVRVMPNIAATVSEAASGISPGKNATPEDMKDALTIFSAVGTAVQVPESLMDAVTGLSGSGPAFIFPVIEAMADGAVLEGMDRKSALTLAAQTVLGAAKMALETGMHPGELKDMVTSPAGTTIQGVHALEEAGIRAAFMNAVIRASERSRELGKK

SEQ ID NO: 12800 - protein, 870 aa, Ostreococcus tauri
MDRIGSPFAQSTTTVLDRPRQYVDDAEMGADHLAHKELLWKLSSTYLPNDVGSLQRSLVRHVEYTLARRRYKLDDNTFYQATAHSVRDRLIERWTDTQQYSAKVGAKKVYYLSLEFLIGRSLGNAVSNLGLRGAYAEALRQIGYNLEDIMSEEKEPALGNGGLGRLASCFLDTLATQNYPAWGYGIRYKYGMFEQRILNGQQVEFPDYWLTDGNPWEVERLDVQYPVRLFGHVREFKDQEGNTRYAWQGGEVVMAQAYDTPIPGYGTYNTNNMRLWSSKPSHEFDLASFNAGNYYGAVEAKERCESITSVLYPNDATDEGKRLRLKQQYFFVSATLQDIFRRFKKSVGRTATTKIQDMPKKVAIQLNDTHPAIAIPELMRLLLDVEYLSWEEAWEISRNVFAYTNHTILPEAMEKWSVPMITELLPRHMQIIYEINHRFLLEVQKLWPNDDTRLSAMSIIEESTPKMVRMSNLAVIGSHTVNGVAMIHTKLLKSTLFPDFLLMWPEKFINVTNGVTPRRWLLQANPALSSIYTGMVGPGWVNDLKRLEPIKTMAQDALFRQRWRAAKQTNKNAVVDWLYKTMGIQVNPNALFDMQVKRIHEYKRQLLNVLGIVHRYAEITQATPEQRNQMVPRVCIMAGKAAPGYVMAKNLIMLVCAVSEVVNADAACRDLLKVIFIPNFNVSLAELLIPASDVSQHISTAGLEASGTGNMKFVMNGGLIVGTMDGANIEIAQAIGEHNMFTFGAKASEVAAIRRTMSHHPPKIDPRLQRATQMIRSGVFGKPKDGEYHQLLDAIDPHKDVYLTAQDFPSYLRAMDEADAQFQLEEKWTAKCIESACSMWMFSSDRTIREYAAKIWNVEPLPFRPPKHQN

SEQ ID NO: 12801 - protein, 425 aa, Campylobacter upsaliensis RM3195
MTNKAAFKEAFKVIAGGVNSPVRAFASVGGEPCFIAEGEGAYIKDIEGKRYIDFVQSWGPLLFGHCDKDIVKACKKALKKGTSFGAPTLSESHLAKLVLEDFKHLDKIRFVNSGTEATMSAIRLARGFTKREKILKFEGCYHGHSDSLLVSAGSGAATFNTPSSLGVLNEVAKQTLVARYNDIESVKELFEKYKGEISCVIIEPIAGNMGLVLGEQKFLEELARLCRQNGALLIFDEVMSGFRASFLGSFGVNKIKADIVTFGKVIGGGLPAAAFASRAEIMDILSPLGGVYQAGTLSGNPLAMAAGIASISKAKKDKELYKKLARLAKILTQGLSELAKEKGVPFNATFVGSMFGYFFTEDPVRNYQDALKSNLKLFAKFHQNMLKQGIYLAPSQFETGFICDKMDEKMMIKTLEAARKSFKAL

SEQ ID NO: 12802 - protein, 634 aa, Brachypodium sylvaticum
MARFAAATLLFQAAVMAVTPHSSSTPPSMPGCPSSCGDVTIPYPFGVGAGCHLAGFGLTCDVATLLGPPKLRLVVTGCNVQAVLLDEISRRVVAACTAICSARTTVAHDDDSCAGAGCCQASIDTGLASYGIRLSSFGDATPNSSLDESASVFITDSAWFRENAGKLLDDGDKPPAVLDWGIGNSGASHGGYSCRCQHGYAGNPYVADGCQDIDECALPEEYPCYGECMNRPGSFLCLCPGGTQGDARTEGGCGIAFPSLYVIALTMAYLIKARRVKKLKELFFKQNRGLLLHQLVDKVIAERMVFTLEELETATNQFDQRRKLGSGGHGTVYKGFLPNRHVVAIKKSNITVQKEIDDFINEVVILSQINHRGVVRLFGCCLETRVPLLVYEFISNGTLSDHLHVEGPESLPWTDRLRIALEAASALAYLHSSASVSIIHRDVKSANILLDDRLTVKVSDFGASRGIPIDKKGVTTAIEGTFGYLDPEYYQTSRLTDKSDVYSFCVVLVEMLTRKKPTVFTSTENASLIALFNLRMMQGKLYQILDPQLISEGMETAEEFAALASACLSLKGGERPTMRQVEMRLERLLGPNLVIEVEQGCSTEVQCTLTQMSNGNSRQYSMEQEFLSSATFPR

SEQ ID NO: 12803 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESPYKFLAFNAGPRTCLGKRLTFLQMKTVAVEIIRNYDIKVVEGHKPKPVPSVLLRMQHGLKVSVTKI

SEQ ID NO: 12804 - protein, 410 aa, Aspergillus nidulans FGSC A4
MFITSAAAFVWANLNPTNYIGSVSFCPERDIPDLAGKVVLVTGETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPVGIVKQRNRYVVDQKMGRRLWEWTETELKRDHKEGFIERMLQPHPHHQRRRSSVGEGEIEKPDLAIGLERQSSTERNEQGQNQAESGGQNVLRPQRRNSRLQRLKEFMHSEEELDDAGKTYAKLM

SEQ ID NO: 12805 - protein, 479 aa, Halobacterium sp. NRC-1
MPPTQLKDPVHGYIELDAALVDGLIDRKPFQRLRHVRQLSATTLVYPGANHTRFEHSLGVYHLAKTVFENLRTQPYFHQDATTTELDAIQRTLECAALLHDVGHPPFSHLGERYLDRSAILDRLADHGLHATFADAGVGNAPLREASPHELFGCLFVCREFADAITAMDVDPHAVCAHILGYSLAYERGGRWQHGVAAQILHSPIDVDRLDYITRDNQMTGADVLSFDTARMVASYTAHPDEGLALSDKALSTIGNYLEGRIALYMWVTQHHKSVFAHALLRELLAALAAMRDTPPITIDAVLDRGIDDNTILERLRVAARDNPDSTLATLYERFRSREFPETCWKHRVAYAARVDVGDTTASASAPADDPPRATDADIDAFSDWLTGNADRLEPRLADALGVPVHEVWIEHSYVPEYEPQALEDIPIAYGGTTRSVGDWGLYGDRAFDSPIPFVFVPHGVETQAITTLSAWFHAESTA

SEQ ID NO: 12806 - protein, 638 aa, Picrophilus torridus DSM 9790
MSFRDYLSEAKAIFDRLYPDNKISEVDYEGPTIVVYTKDEELFSKRDDIARQIAQELRRRIAVRPDPSIMLDEDTAEKLIKEIIPDEAGLKDIYFEPDTGEAVIELDEPSIVTRNQEVMVNIKSRTKWSPRIVRAPPMYSRTVKEMREFLRSVKKERKEFLHNLGIKLTTPVMPGETWIRITALGGHREVGRSATLISTNNSKILVDCGMINVNDPDHPWEEAPYLYVPEIQPFSSLDAVILTHAHLDHSGLVPLLYKYGYDGPLYTTAPTRDLAALLQNDYIKVAHSEGHKISYESKHIREMLKHTIALKYNETTDITPDVRLTLYNAGHILGSASVHLHIGDGLYNIVLSGDQKFEKTWLFNPAVNRFPRVETFMIESTYAGRDDYTYTRSRAGEILTDVINRTFERGGSVLIPVFAVGRSQEVMLVIEDAVKRNIIPRTNVYLEGMIMEATAIHAAYPEYLNKDLREQIMVKRDNPFLSDIFKQVETKKQREEIMDSSESKIILATAGMMNGGPVLDYFKSMAPLREHSLVFVGYQADGTLGRYIQSGAKNVTLTDNGKPVKIDINMSVETAEGFSGHSNKAQLLNYIATMQPKPQRILVNHGDGDKCYEFSRLIRSKFGIDAISLKNLETVRVY

SEQ ID NO: 12807 - protein, 345 aa, Medicago truncatula
MLKKRKNVTIFFLPLPLPSELMRISIPSFTGKRRLKDLLVQKDNRFCADCSAPDPKWASANIGVFVCLKCCGVHRSLGTHISKILSVTLDEWSNDEIDAMMEVGGNASANSIYEAFIPEGYTKPGPDASHEERAKFIRSKYERQEFLKHSLRILSTKSKRQTSFSKKIMDSFRKSSGSKNMEGMVEFIGMLKVKVVKGTNLAIRDMRTSDPYVVLKLGQQTVQTTVIRSNLNPVWNEELMLSVPQQFGPISLEVFDHDLFSADDIMGEAQIDLQPLINSAMAFGDTGMFDDMRIGKWLRSNDNALIEDSIVNIIDGKVKQEMFIKLQNVECGELNLELEWMSLDH

SEQ ID NO: 12808 - protein, 229 aa, Listeria monocytogenes
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNADLKPVNKYYLDK

SEQ ID NO: 12809 - protein, 438 aa, Brassica napus
MSHGDHASHKKVIDLPHASNPQSKDNTIAIMLDTKGPEVRSGDLPQPIMLDPGQEFTFTIERGVSTPTCVSVNYDDFVNDVEAGDMLLVDGGMMSFMVKSKTKETVICEVVDGGELKSRRHLNVRGKSATLPSITEKDWEDIKFGVENKVDFYAVSFVKDAQVVHELKNYLQGCGADIHVIVKIESADSIPNLHSIITASDGAMVARGDLGAELPIEEVPILQGRIINLCRSMGKAVIVATNMLESMIVHPTPTRAEVSDIAIAVREGADAVMLSGETAHGKFPLKAAGVMHTVALRTEATITTSTEMPPNLGQAFKNHMSEMFAYHATMMSNTLGTSTVVFTRTGFMAILLSHYRPSGTIYAFTNEKKIQQRLALYQGVCPIYMEFSDDAEDTFTKALATLLKQGMVKKGEEIAIVQSGSQPIWRSQSTHNIQVRKV

SEQ ID NO: 12810 - protein, 116 aa, Zea mays
  misc_feature (82)..(82): Xaa can be any naturally occurring amino acid
  unsure (1)..(116): unsure at all Xaa locations
PEVLPGPPEANMVTPGSDSKKVTPEVIAQYTVRTLQRTVPAAVPAVVFLSGGQSEEEATLNLNAMNKLSTKKPWALSFSFGXFLARCKANSEATLGTYKGDAAADTESLHVKDYKY

SEQ ID NO: 12811 - protein, 248 aa, Ralstonia eutropha JMP134
MYKLVLIRHGESTWNLENRFTGWVDVDLTDTGAAQARLAGKLLKEAGFAFDVAYTSVLKRAIRTLWHVQDEMDEMWIPVRNEWRLNERHYGALAGLNKAETAAKFGDEQVLVWRRSYDTPPPALEPTDPRASYDDPRYANVPREQIPLTECLKDTVARVLPLWNESIAPDIQSGKRVVIAAHGNSIRALVKYLDQISDDDIVGLNIPNGTPLVYELDASLRPLRHYYLGDQEAIAASLAAVASQGKAR

SEQ ID NO: 12812 - protein, 948 aa, Mesorhizobium sp. BNC1
MSYTPTGYAPYDFANRRHIGPSPREMAEMLETVGAESLDAFIDAIVPADIRQTRPLAWGKALSERGVLERLRNVAKKNKPNASFIGQGYHGTFTPPAIQRNIFENPAWYTAYTPYQPEISQGRLEALLNYQTMMTNLTGLDIANASLLDEGTAAAEAMALCERASRTKARAFFVDHHCHPQTIAVVATRAEPLGWEVIVGDPFTYLDPSRVFGALFQYPGTYGHVHDFTAPIAALKDAGALAVVAADPLALTLLKPPGEMGADIAIGSSQRFGVPLGYGGPHAAYMTVRANLARSMPGRIVGVSIDARGNRAYRLSLQTREQHIRREKATSNVCTAQALLAVMASMYGVFHGPDGLRAIAERIHRKIVRLVKGLETLGFPIEPVSFFDTVTVECGPRRDAILASALREGINLRPIGETRIGITFDETVRRSHTEAIWRAFGGGMADDDMTPDYRLPEALLRTSSFMTHPVFHMNRAEAEMTRYMRRLADRDLALDRAMIPLGSCTMKLNATAEMMALSWPEFANMHPYAPADQAQGYAEMLSDLEAKLCQITGYDAFSMQPNSGAQGEYAGLLTIRRYHEVQGDGHRNICLIPTSAHGTNPASAQMAGMKVVVVGVAADGNIDVADFRAKAEAHAENLAACMITYPSTHGVFETTVREICDITHANGGQVYIDGANMNAMVGLARPGDIGGDVSHLNLHKTFAIPHGGGGPGMGPIGVKAHLVPHLPGNPPAGKFAISAAPFGSASILLISWAYCLLMGGEGLTQATKTAILSANYIARRLASAYPILYSSAAGHVAHECILDTRVLKERAGVTVDDIAKRLVDCGFHAPTMSWPVAGTLMVEPTESEPKAELDRFIEAMLGIAAEAEAIAAGTLDAQDNPLKRAPHTVEDLVGEWDRLYSREAACFPAGSFRTDKYWPPVNRIDNVHGDRNLVCTCPPLESYAEAAE

SEQ ID NO: 12813 - protein, 417 aa, Ralstonia eutropha JMP134
MADIKNYTLNFGPQHPAAHGVLRLVLELDGEVIQRADPHIGLLHRATEKLAEQKSWIQNVPYMDRLDYVSMMSNEHAYVMAIERLLGIEVPIRAQYIRVMFDEITRLLNHLMWIGAHALDVGAMAVFLYAFREREDMFDMYEAVSGARMHAAYYRPGGVYRDLPDTMPQYRASKVHNERAIKVMNEARSGSLLDFIEDFTNRFPKYVDEYETLLTDNRIWKQRLVDIGVVSPERALQMGFTGPMLRGSGIAWDLRKKQPYEVYDKMDFDVPVGVGGDCYARYLVRVEEMRQSNRIIKQCIEWLRRNPGPVITDNHKVAPPSRVDMKSNMEELIHHFKLFTEGMHVPEGEAYAAVEHPKGEFGIYAISDGANKPYRLKIRAPGFPHLAALDEMAKGHMIADAVTIIGTQDIVFGEIDR

SEQ ID NO: 12814 - protein, 348 aa, Ostreococcus tauri
KLQAEWKAAKLARKQICKDYIKKVTDIDVPIDSMFDVQVKRIHEYKRQLLNILGIIYRYKQMKAMTPEERAKCVPRVCIFGGKAYATYMQAKRIVRLINNVGSIVNNDPEIGDLLKVVFVPDYNVSLAETLIPASELSQHISTAGTEASGTSNMKFQMNGCLIIGTLDGANVEIRECVGEDNFFLFGITDPEVEPARKERAEGKFVPDKRFTEVVEYVRSGVFGDKFEELLGSLEGNEGFGRGDYFLVGKDFASYLEAQERVDEAYRNQQGWTESSIISTGYSGKFNSDRTIDQYAKEIWGITPARARRSKRRGYKIHLGAHAQMRWHGLVFERGPRRLEGAVLLTAG

SEQ ID NO: 12815 - protein, 541 aa, Gibberella zeae PH-1
MAGSITKPKKPKSKRTPVRLRHKIQKASAAKQKKERKLAKKNPEWRTKLKKDPGIPNLFPYKQKLLDEIEENRIKKAELAQRRKELTKAAKTGATDDNAMTDVQVDVSDEMEEDEELDDDVDESNPMAALIASARAAAATYDRQLADDDDMDDDDESDDSDNDHGPEMSIGQASSRKTYDRVFKQVVEQADVVLYVLDARDPEGTRSREVERQIMASPDKRLILIINKCDLIPPKVLRDWLVYLRRYFPTLPLRASGAAPNAHTFNHRDLTVQSTSATLFKALKSFAASRQLKRAVSVGVIGYPNVGKSSVINALLSRMSGKGGSSSKACPAGAEAGVTTSIRSVKIDSKLTLLDSPGVVFPSSSSTQSAGLVSLKNATEAHAHLVLLNAVPPKQIDDPIPAVTLLLKRLSASPDLIQKLTNVYDIPALLPNRADGDFTTDFLVQVARKRGRLGRGGIPNLPAAAMTVVTDWRDGRIQGWVEPPVLAVGSTATAAKPTIKNAGEDDIAPDQKQIVTEWAAEFKLEGLWGDNSADVDEAMEE

SEQ ID NO: 12816 - protein, 436 aa, Gibberella zeae PH-1
MSSDLSHQIQSKLDAAIDRYVARNPRSKALHEEALKSMPGGNTRTVLHTSPFPVAIKSGQGYQVTSEDGHVYTDLAGEFTAALYGHSNPVITSAIRHVLDNVGMNVGGHTAQEQLFARELCSRFNLEHVRFCNSGTEANIHALAAARAFTKKRRVVTFSGGYHGAVIGFKGGKPEANNVDTDDWVVARYNDLGSARAAIKSDGVAAILIEGMQGSGGGLPAMPEFLQGVQDIAAKAGVLFIIDEVMTSRLSGGGISELRGLKPDLKTFGKYLGGGLAFGAFGGRADIMAAFDPRSPNALSHSGTFNNNTLVTHAGHAGLTKIYTPEVANQFTKSGHELRERLNAVTEGTRVLFTGLGTIMGVHFTTHGDRVIERSGEVEEIDALRDLFWFEMLEEGFWVVRRGFIALVLGTPTAEFDRFVNCVEAWVSKHADLVKI

SEQ ID NO: 12817 - protein, 215 aa, Glycine max
NRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 12818 - protein, 228 aa, Erythrobacter sp. NAP1
MPKLILVRHGQSQWNLENRFTGWWDVDLTEKGVAEAKAAGTLMKEKGVLPTTCFTSFQTRAIKTLNLALEEMGRLWLPVTKDWRLNERHYGGLTGLNKQETRDKHGDEQVHIWRRSFDTPPPPMEPGSEYDPGADPRYEGIDVPYTESLKLTIERVLPYWESDILPVLSSGETVIISAHGNSLRALVKHLSNISDEDITGLEIPTGQPIVYEFDDTMTPGERYYLKDS

SEQ ID NO: 12819 - protein, 452 aa, Staphylococcus epidermidis RP62A
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKEAR

SEQ ID NO: 12820 - protein, 1128 aa, Brachypodium sylvaticum
MPPRPRAVALAPPRRLALLVSSAFAALLLIVSPCHCVNEQGQALLEWKRSLRPAGGALDSWKATDAAPCRWFGVSCDARGDVVSLSVTGVDLRGPLPASLPATLATLVLSGTNLTGPIPPELGAYSELTTVDLSKNQLTGAIPPELCRLSKLETLALNTNSLRGAIPDDLGDLASLTHLTLYDNELSGTIPGSIGKLKQLQVIRAGGNVALKGPLPSEIGGCTNLTMLGLAETGMSGSLPETIGRLEKLQTLAIYTTLLSGRIPESIGNCTELANIYLYQNSLSGPIPPQLGRLRKLQTLLLWQNQLVGAIPPEIGQCEELTLMDLSLNSLSGSIPASFGRLKNLQQLQLSTNRLTGAIPPELSNCTSLTDIEVDNNALSGDIRLDFPKLPSLTLFYAWKNGLTGGVPASLAECASLQSVDLSYNNLTGPIPRELFALQNLTKLLLLENELSGFVPPDIGNCTSLYRLRLNGNRLSGTIPAEIGNLKSLNFLDMSSNRLVGPVPAAISGCASLEFLDLHSNALSGALPDVMPRTLQLVDVSDNQLAGPLRPSSIVSMQELTKLYLGKNRLTGGIPPELGSCEKLQLLDLGENAFSGGIPAELGELPSLEISLNLSCNRLSGEIPPQFAGLDKLGSLDLSHNQLSGSLDPLAALQNLVALNVSFNGFSGELPNTPFFQKLPLSDLAGNRHLVVGDGSGDSSRRGAITTLKAAMSVLAVVSAALLVAAAYILARARRRGGTGGSTAVHGHGTWEVTLYQKLDISMDDVLRGLTTANVIGTGSSGVVYRVETPNGYTLAVKKMWSPSPDETAAAAAAFRSEIAALGSIRHRNIVRLLGWAAANNGSTATRLLFYSYLPNGNLSGVLHGSGGASVAKQSAQPGSDWAARYDVALGVAHAVAYLHHDCVPAILHGDIKSMNVLLGPAYEPYLADFGLARVLSAAQSKLDDDSSKPRPIAGSYGYMAPEYASMQRISEKSDVYSFGVVLLEILTGRHPLDPTLPGGAHLVQWVTQARRRACDGDDALLDARLRERSAGEADAQHEMRQVLAVAALCVSQRADDRPAMKDIVALLEEIRRPGTAAADDVKPAPAPAASLPAAVAAAPVLSPARGGAHSRGVSSSCSFAGVSDYSA

SEQ ID NO: 12821 - protein, 585 aa, Staphylococcus epidermidis RP62A
MRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 12822 - protein, 483 aa, Pseudomonas fluorescens
MIPVILSGGSGSRLWPLSRKQFPKQFLALTGEHTLFQQTLERLVFEGMDTPIVVCNKDHRFIVNEQLANRKLECQRILMEPFGRNTAPAVALTAMMLVNEGRDELMLVLPADHVIDDQKALQRALALATVAAERGEMVLFGVPATRPETGYGYIKSTNDSLLPEGVSRVQQFVEKPDEKRAVEFVKSGGYFWNSGMFLFRASRFLEELKKHDPDIYDTCVLTLERSEQTADTVTLDDATFACCPDNSIDYAVMEKTQRACVVPLSAGWSDVGCWASLWAVNDKDIHGNVSKGDVVIQDSRNCMIHGNGKLVSVIGLDNIVVVETKDAMMIAHKDKVQGVKQMVSTLNDQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPVERGVSVKTIAQ

SEQ ID NO: 12823 - protein, 482 aa, Candida albicans SC5314
MGSNSSKSAPTLQRSDTNNSTRSTRSNRSIRSRRSISSIKDSQQQQSDSQQQQEEEEEQSQSQQRPQPILSRNNSATSENPILIRRNTNETLQTPNFSDTLSPHSHSQQQQQQPGSPLSTSMNGNTISRTSTNHSIISTTSHKSSSQQSNLPLKKETTTSSLSTNSNTIDIDSLIDKLLNAGFSGKRTKNVCLKNTEIELICASAREIFLSQPSLLELAPPVKVVGDVHGQYHDLIRIFSKCGFPPKTNYLFLGDYVDRGKQSLETILLLLCYKIKYPENFFLLRGNHECANVTRVYGFYDECKRRCNIKTWKLFIDTFNTLPIAAIVAGKIFCVHGGLSPVLNSMDEIRNIARPTDVPDFGLLNDLLWSDPADTINEWEDNERGVSYVFSKVAINKFLSKFNFDLVCRAHMVVEDGYEFFNDRTLVTVFSAPNYCGEFDNWGAVMGVSEDLLCSFELLDPLDSAALKQVMKKEKQERKKST

SEQ ID NO: 12824 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTASAIVFNPFSSDGGLGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDEWGPSQMETTFDVMSGLDMADTMVLFRNAVKQICRRRGYLASFMCKPKIEGFCASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 12825 - protein, 440 aa, Anabaena variabilis ATCC 29413
MSNQGAFEGAANVESGSRVFVYEVVGMRQNEETDQTNYPIRKSGSVFIRVPYNRMNQEMQRITRLGGKIVSIQTVSALQQLNGKTTIATVTDASSETAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPETGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 12826 - protein, 258 aa, Glycine max
  misc_feature (103)..(103): Xaa can be any naturally occurring amino acid
  misc_feature (116)..(116): Xaa can be any naturally occurring amino acid
  unsure (1)..(258): unsure at all Xaa locations
MGSAASPPRALDAATQEDLKRVSAHRAVDMVESGMTLGLGTGSTAAHALDRLGALLRTGALRAVAGVPTSLKTEAHAARVGIPMLALADAAEIHLSIDGADEXVDPDLNLVKGRGXAPLLREKMIEGAGARFVVIVDESKLVPRLGCTGSVPVEVVPFGSAYTLGLIRMVFDKLPGFHARLRTVKSKAGDGQEELFLTDNGNHIVEMFFEDGIHGNLRDISDSLLRITGVVEHGMFLGMATKVIVAKKDGTVAVLSKK

SEQ ID NO: 12827 - protein, 238 aa, Zea mays
MSAASKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 12828 - protein, 372 aa, Oceanospirillum sp. MED92
MKLNTPEELLEDIRQGKMVILMDDEDRENEGDLVIAAEMVRADDINFMATHARGLICLTLTRDRCEQLNLPLMVQSNGAQFSTNFTMSIEAAEGVTTGISAADRAHTVRVAVKENAKPEDIVQPGHIFPLMAQPGGVLSRAGHTEAGCDLARMAGFTPASVIVEIMNEDGTMARRPDLEEFAEKHGLKIGTIADLIHYRTANEHTVERSEEGVMATEYGDFNYVTYRDEIQNCTHLAMTLGEVKADEPVYVRVHNRAEVLRDVVGAVNPNEEPKWTMRKALARVAAEGQGVVLLLDTNERIDMSESVDLMLNGRQQSKVNVSASGAYLTVGTGSQILRDLGVGKMRLLSSPMKFNAISGFDLEIEEYIPCEE

SEQ ID NO: 12829 - protein, 355 aa, Neurospora crassa
MPPKKQEPKAAGKKKAVEDKTFGMKNKKGSAAQKQIAALQASMKNGGNAEQKRKEAEKAAREREKKAAEDAKREADLLLNKPAQIQKVPFGVDPKTVVCIFFKKGNCEKGKKCKFSHDLEQERKVEKRNLYQDTRAEEDDKKKQETSADWDEEKLRSVVLSKKGNQRTTTDKVCKFFIEAIEEGKYGWFWICPNGGDKCMYKHALPPGFVLKTKEQRAAEKALLDKSPLRTLTLEEFLESERHKLTGTLTPVTPESFAKWKKERLDKKAAEEAARKAKEATGRALFESGNWRMEADIDSDDEGDDDAWNLEKLRKETEAIQIKKEEERLSALHGVPVTLGEAKDVTGLSEPTLGT

SEQ ID NO: 12830 - protein, 540 aa, Prochlorococcus marinus str. MIT 9312
MSKIRSKSINKLSKPQSPVVLAILDGWGYREAISDNAIKSAKTPIMDSLWHAYPHTLISASGSEVGLPDGQMGNSEVGHLTIGSGRIIQQELVRISNVVKNNQLCIVNELKEMADSLKRNKSTLHITGLCSDGGVHSHIDHLLGLIKWASDNGIKKVAIHIITDGRDTPAKSASKYLNQIESCIKKFDTGEIASICGRYWIMDRNLLWDRTEKAYANLTDPDIKVSNISPQDYIKQSYDKNITDEFIEPIRISENYLKDGDSLICFNFRPDRARQIIKSLSEKKFSDFKRKVVPNLDLVTFTQYDQNFSVKVAFPPESLNNFIGQIVSENGLKQYRTAETEKYPHVTYFFNGGVEIPLPGEERHLIPSPRVATYDMEPEMSAEELTISCSKAIKSGDYAFVVINFANPDMVGHTGNMNATIKAIETVDKCIGQIVNATGEMGGSILITADHGNAEVMKGPAGEPWTAHTINKVPLIFIEGEKRKIPNMGNEIYLRDNAGLADIAPTLLQLLNLPIPKEMTGKSLIKEIELKGYNKVVQHV

SEQ ID NO: 12831 - protein, 478 aa, Bifidobacterium adolescentis
MTALETKADAEALINKEGIEYVSVRFTDLIGVQQHFTVPASEFLKDAFTDGMPFDGSSVEGFQAINESDMKLVPDVSTAFIDPFRKHKTLDVAFSIVDPLTDEPYSRDPRQVAGKAEAYLKSTGIADTASFAPEAEFFIFDKVRFENSMQRSFYEVDSIEAPWNSGIDTEDDGTPNIAFKNRVKKGYFPVPPIDHTQDLRDDMVANLQKVGLILERSHHEVAGAGQQEINYRFNSLQHAGDDLMKYKYVVHETAALAGKAATFMPKPIAGDNGTGMHCHQSLWKDGKPLFYDEKNYGGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPAPVDKDLYELPPEEHAGIKQVPSSLAEAMDALEEDHDFLTAGDVFTDDLIDTWISIKRGEIDQARLAPTPLEYELYFHI

SEQ ID NO: 12832 - protein, 274 aa, Bacillus clausii KSM-K16
MKMVTLNNGVNMPQLGFGVWQVPDEEATPAVAKALEVGYTSIDTAMIYKNEAGVGKAIKESGIDREKLFITTKVWNADQGYEQTLKAFDASLERLGLDYIDLYLIHWPTPHYDQYIETYKALEKLYNDGRVRAIGVCNFDIDHLERLLDECDITPVLNQVECHPYFAQNELKDFCAKHNIYVEAWSPLDQGGEVLTDEVVEKIAKAHNKTTAQVVLRWHLQNNTIVIPKSVTPSRIEENFDVFDFELSDEEMDAINRLDRNQRRGAKPSEMNTR

SEQ ID NO: 12833 - protein, 354 aa, Glycine max
MGAERFSHDHAPLILGLQPSALVDNVATVDWSLLHRIPGERGGSIPVQIEELESILREVKSKSHDDIKTLAGGSVANTIRGLSRGFGISTGIIGAYGDDHQGQLFLTNMTFNSVDLSRLRQKKGHTAQCVCLVDDMGNRTMRPCLSNAVKVQAQELVKEDFKGSKWLVLRYAVLNLEVIQAAIHLAKQEGLLVSLDLASFEMVRNFKLPLLKLLESGNIDLCFANEDEAAELLRDEQKDDPIAAVEFLSKYCQWAVVTLGANGCIAKHGKEMIQVPAIGETKATDATGAGDLFASGFLYGVVKGLSLEECCKVGTCSGGSVIRSLGGEVTSENWQWMYKQMQINGLPTPPGLCK

SEQ ID NO: 12834 - protein, 536 aa, Oryza sativa
MRKNPSEQEEEEKETEKKANEIEVQFPFRPTDPTHLPQPQVDAQVHHPCSIRTNTTTQTTYRCDTRSRAKRYHPPIHGGLHLRHLLLHSHQARLLLLLLLKSQLRLLRQVSIGVALGGWIFAGSLAAIGDVMTASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 12835 - protein, 232 aa, Aspergillus nidulans FGSC A4
MSSSEYDQELDSLLVGPIPVGVNKFIFEADPPDLRRIPTSEILGVTVILLTCSYDGREFVRVGYYVNNEYDSEELTADPPAKPIIERIRRNILAEKPRVTRFAIKWDTEESAPAEYPPDQPEADGLDDDGAAYGQEEAELEAALLKELQEAEKNESTKGEDHDMEGADNGEEDISDAESEDIEDESDDDEDEVDEEEGNDADEDVEMGDDSEPKDDNANPAAHHSQQEVMVH

SEQ ID NO: 12836 - protein, 536 aa, Zea mays
MDRVLLSSHLPSHALANTRLQLGPGGLNSIGFAVIKKGCLKLRCYAIGDELGGPGRLSKHFVENSNGPVFQGLDASAGSFRTVGAEITQDTGDFFVSDAEGDPDKPTDGFSSIDQAIGALREGKFVIAVDDENGDNEGDLVMAATLVDQKSVAFMIRNGSGIISVGMEEEDLTRLMIPMMSPITEIEDITAAASTVTVDARVGISTGVSAADRAKTILTLASSDSKPSDLRRPGHIFPLKYRNGGVLKRAGHTEASVDLVALAGLRPVSVLSTVMDPRDGSMAGVTVLQQMAMEHDIPIVSIADLIRYRRKREKLVELIAVSRLPTKWGLFRAYCYQSRLDGTEHIAVVKGDIGDGEEVLVRVHSECLTGDILGSARCDCGNQLELAMQLIEKAGRGVLVYLRGHEGRGIGLGQKLRAYNLQDEGHDTVEANVELGLAVDAREYGIGAQILRDIGVRTMRLMTNNPAKFIGLKGYGLAVVGRVPVISPITKENQKYLETKRTKMGHVYGSDLPGSLPEFANPQEAPTEQDDDDNQN

SEQ ID NO: 12837 - protein, 408 aa, Nitrosomonas europaea ATCC 19718
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 12838 - protein, 791 aa, Glycine max
MRRTGRALKKKKTALVFSLNFGVMEFPSPTMRVWTLFLFLLLLKSDVVQSASDSLIGLGSYDITGPAADVNMMGYANTEQIASGVHFRLRARAFIVAQPKGNRVVFVNLDACMASQLVVIKVIERLKARYGDLYTEKNVAISGIHTHAGPAGYLQYVVYIVTSLGFVRQSFDVIVDGIVITIVQAHENLRPGSIFVNKGELLDAGVNRSPSAYLNNPAAERSKFKYDVDKEMTLLKFVDDEWGPLGSFNWFATHGTSMSRTNSLISGDNKGAAARFMEDWFERKGSVRMDSVGFENDGIPRRISNIIPSLHDNHHELLELAASFQSPPGKPATKTSSVARRVRGVLRQVDKPRFVSAFCQTNCGDVSPNVLGAFCIDTELPCDFNHSTCGGKNELCYGRGPGYPDEFESTRIIGERQFKKAVELFNGASEQIKGKVDFRHAFIDFSQLGVNLSKVGASEVIKTCPAAMGFAFAAGTTDGPGAFDFKQGDDQGNPFWKLVRNLLKTPGKEQIDCHHPKPILLDTGEMKLPYDWAPSILPIQVLRVGQLVILSVPGEFTTMAGRRLRDAVKTVLSGNKGFGSNIHVVIAGLTNTYSQYVTTYEEYQVQRYEGASTLYGPHTLSAYIQEFTKLAHALISGQPVEPGPQPPDLLDKQISLLTPVVMDATPIGVKFGDCSSDVPKNSTFKRADMVSVTFWSACPRNDLMTEGTFSLVEFLQGKDMWVPAYDDDDFCLRFKWSRPFKLSSHSKATIEWRIPKDVTPGVYRIKHFGAAKGLLGSIHHFTGSSSAFVVA

SEQ ID NO: 12839 - protein, 627 aa, Arabidopsis thaliana
MEFNCLPPTFITLRLMRRKLPFSMCCGYCLQASYSCLYFRKFLEVTPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQGIMTPQLSSLLFLVVGISMALTPWLAAGGQLIASRFELQDVRSLLPVESETDDLQGHIIICGFGRIGQIIAQLLSERLIPFVALDVSSDRVAIGRSLDLPVYFGDAGSREVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAI

SEQ ID NO: 12840 - protein, 689 aa, Brachypodium sylvaticum
MAAAARGRRCRGAVLLLLLLPSVLAPLVLYGYSPTSPLPDSTLARVAFDREDGSNLVWPHMAASEVSLAKDLTIERLGEHKNRVLSATDDWQAVQAARSRSSENSDASVQLKVPVTRDADEMIAEETGSALSGQEGRIKEVVSSQRNADGFGDPGNAKQAEEQDGLATEVEHTDGSGASTENNVAGIHTTESTADSLSNGTIHATPRESYTRATGINADLPTTTSSAGHSTASPDVKIRIIKDQLIRAKTYLGFVASRGNHGFAKELRARMRDIQRALGDATNDGLLPQNVHSKIKAMEQTLGKVKRSHDSCSGAVNRLRTALHSMEERLQSHKNEANYLAQIAAKSLPKGLHCLPLRLTNEYYSTNSNNKDFPNTEKLEDPKLHHYAVFSDNVLAAAVVVNSTLVHATNHVFHIVTDRLNYAAMKMWFLANPLGKAAVQVQNIQEFTWLNSSYSPVLKQLGSRSTIDYYFRSGTARPDENPKFRNPKYLSILNHLRFYLPEIFPKLNKVLFLDDDTVVQQDLSALWSIDLKGKVNGAVETCGETFHRFDKYLNFSNPIVANNFHPQACGWAFGMNMFDLSEWRKQNITDVYHTWQKLNEDRLLWKLGTLPAGLVTFWNRTFPLDRSWHLLGLGYNPNVNERDIRRASVIHYNGNLKPWLEIGLSKYRKYWSRYVDFDQIFLRECNINP

SEQ ID NO: 12841 - protein, 169 aa, Glycine max
MAAQGKMEMGVVLVVMIISMMCVGAKAQQSSCTSALVNLSPCLNFITGNSSTPSSGCCTQLSSVVRSQPQCLCQVLNGGGSSLGVTINQTQALALPGACNVRTPPITQCNAASPVGSPSPNSDPSGTGSTNVPTTDNGSSSATSVKLSIPLMFFVLAATYAPTFGTLIL

SEQ ID NO: 12842 - protein, 287 aa, Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 12843 - protein, 284 aa, Zymomonas mobilis subsp. mobilis ZM4
MSDTASDSAPLLPKDQAPFWAFGAGNMAGSMISCWLNNGLNPKDMLVIRPSGKPVAEGVKVVTSLPEDGSTPATLLLGVKPQMLPQIAPALAPYITEKTTLISILAGVELETLRHFFPKAKSIVRAMPNLPVALGKGVVALCADKLTDEQRKCIEKLASTLGIFEWVNENQFDTATALAGCGPAFVYRFIDALAQAGQKLGLTADQALPMAIATVEGAASMAKQADITPAELADKVASPGGSTRKGMDVLDKDEALYQLMDATLEASFKQNRYMAEKAKETIAQ

SEQ ID NO: 12844 - protein, 576 aa, Bradyrhizobium japonicum USDA 110
MHELIRDITLCILFAWMLGLLAHFSRQPLILAYLIAGFCIGPFGAGWVKSQESISVISELGLIFMLFMIGLEIDLKKIVRAGKVILFAAGGQLPGGCLLGVLFFAGIGLSLGGGHFDAVYLCIACALSSTVIIVKVLYEKRELDTLPGRITLGVLVLQDIFAILFLAVQPSLANLQVSVILLSIGRVAVLVAAALLVSRYVLPRLFHQIARRPELILLGALAWCFLVAETAERLSLSREMGALIAGVSLSTFPYALDVTAKVTTLRDFFITLFFVALGMTIPVPGLSVIGLALMIAAFTVVSRLVTTFTPLYLMKQGLRASLLPALNLAQISEFSLVVIQTGVTDNHIAAETANAASFAFVVLAVLSTFVMTRSDEIARWAIGPLKRIGLRDLDHGNGHAEEGHEGGHGEARRIVILGFFRAASALLAEIERQAPVLLEQITVVDFNPNVYQTLLSRGLHVIYGDISSADTLLHAGVGKSEMIILSVPDALLKGASNEKLVRHVRTLNPTAMIVATADLLSDVGELYEAGASYVTVTRLSDAHELFTVIEAAQAGLLADKRAELDLRLGERREVLP

SEQ ID NO: 12845 - protein, 358 aa, Bradyrhizobium japonicum USDA 110
MPDTVQEVLQAFARGELVVVTDDEDREGEGDLIVAASLCTAEKMAFIIRHTSGIVCAPVTTEDARRLRLDPMVAHNDSAHTTAFTVSIDYKPDGGTGISAEERASCCRALSNPNVGANDFARPGHIFPLIAKDGGVLLRSGHTEAAVDLCKLSGLPPVGVISELMNDDGSVMKGEQVARFAAQHKLKHVTIADMIAYRQVREKLIERVSTFVTDSPIGPLQGYAYRSPFDSIAHVAFVYNGVGDGKNVLTRFHKPNIVKDIFTGHKRMAAVLEHFERSGRGVLVYLRDGAAGVPVAPLPDETSTEADRNRQWREIGVGAQILRDLGVTSIRHLTSSVHDYKGLSGFGIEIVANELLEI

SEQ ID NO: 12846 - protein, 228 aa, Malus x domestica
MGIMGMIYMVMMVFSLIVLILSSSTVGFDYFQFTHQYQPAVCNSNRTPCKDPPDKLFTVHGLWPSNRNGPDPEYCKNTTLDVTKIGNLQAQLDIIWPNVYDRTNNVGFWSKQWAKHGICGSPTIQDDVNYLETVINLYIIKKQNVFEILSNAKIEPEGKNRTRKDIVKAIRSGTKGKRPKLKCQKNNRTTELVEVTLCSDRNLTQLINCPNLIKPKSPYFCPLKSIQY

SEQ ID NO: 12847 - protein, 587 aa, Oryza sativa
KARQQRVSHGRGLHCYPSCNNTHTPHLVPPVATPPVRQCPWPPLMGKKAGTTSSWLTAVKRAFRSPSKDDSPNKAARLRDDTDDDKGKRERRRWLFRKSSSPSPAPPTPPPPQQQQQQSRAAAVTEEQRHAIALAVATAATAEAAVATAQAAAEVVRLTRPSSSFVREHYAAIVVQTAFRGYLARRALRALKGLVKLQALVRGHNVRKQANMTLRCMQALVRVQARVRDQRMRLSQDSISLSAAAASAAPCGSSKSSYSVDTSTFWDSKYTHDFAAADRRSIERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPDYMAATESAKARVRSQSAPRQRPATPERDRMSFGGGGGGGGAKKRLSFPVPIDPYRAYAQSLRSPSFKSAAGRFSSEQRSNVSSSCAESLGGDVVSPSSTTDLRRWLR

SEQ ID NO: 12848 - protein, 428 aa, Nonomuraea sp. ATCC 39727
MIPPHTLLVFFVQAAALLLLALLLGRLAVRLGLAAVVGELCAGVILGPSVLGQVAPGAEQWLFPSPSSHMLDAVGQLGVLLLIGLTGAHLDLRLIRRQGATAVRVSAFGLVVPMALGIGAGLLLPAEFRGTGGSAVFALFLGVTMCVSSIPVIAKTLMDMNLLHRNVGQLTLTAGMIDDAFGWVLLSVVTAMATAGAGAGTVVLSIASLLGVIVFSVVIGRPAVRVALRTTEDQGVIAGQVVVLVLAAAAGTHALGLEPIFGAFVAGLLVSTAMPNPVRLAPLRTVTLGVLAPLYFATMGLRVDLTALARPEVLAVGLLVLALAIIGKFLGAFLGAWTSRLSRWEALALGAGMNARGVIQMIVATVGLRLGVITDEIFTIIIVVAVITSLLAPPLLRLAMTRIEATAEEEARLLAYGLRPGEAREDVR

SEQ ID NO: 12849 - protein, 533 aa, Picrophilus torridus DSM 9790
MYGISDSLLALIFIGALLFLAKMGEELFERFKLVPYVAAVFIGIVIGPGVLGLIKILPNITLFISLGINFLLFAGGSLEFKDINTKELLKVKNIIIGILEFIIPFSLISFIVYYIFHNIIVSMVTGIVTGMSSAGPLTRLLSDTGLNRTQDGNSIFRQVVAIEISAVVLFSFLSDVYREKITLIHILIIAAELFVSILLIILFGKYILKGFLEKMDISSKAHETIIAIIISFILILGFVGQYYGFNSAIVALFLGIILRDFINDRPLIAEKVSTVTYGFFEPLFFIGLGLYFVKVSLSLIILGIIIFVLGLLIKPIAGIIFSRFIGIKALRNGLGTSVNGGVDAALLVVALSISIVTRYQYSIIMFAISLLTLAVPLLFNIENPVIPSNNSRYVWNIVEQQFKNLKACDIAKTLQTVSVNKRNPLSFAFKMCMDLNARAVVVIDNNNYVLGQITLSDMISLGEGKLQTLRVYEAGIVPVIRVQCSAPATDLIRIFRDKDPPIVAVVDSNEKFVGTILEREILKYISDVLDTKN

SEQ ID NO: 12850 - protein, 90 aa, Zea mays
  misc_feature (72)..(72): Xaa can be any naturally occurring amino acid
  misc_feature (84)..(84): Xaa can be any naturally occurring amino acid
  unsure (1)..(90): unsure at all Xaa locations
TPGPAPQHRPPQLLLLPQQRIGDSPQSAAIRAVTVRASAETMATEKLGIKVERNPPESRLSELGVRQWPTWXCEKSKFPWTYSXKETCYL

SEQ ID NO: 12851 - protein, 156 aa, Triticum aestivum
MDASATGAVSKVKKYVVGRKLGGGPRKKAVARSVKAGLQFPVGRIGRFVKKGRYAQRVGMGAPVYLASVLEYLAAELLELAGNAAKDNKKSRIIPRHLLLAIRNDQELGKLLAGVTIAHGGVLPNINPVLLPKKTAEKSTKEPKSPKKTAKSPKKA

SEQ ID NO: 12852 - protein, 457 aa, Zea mays
MDSMMTPEILSANLALVMDKFSDDDTDTELDLDSPTEGFASIADAIEDVRQGKLVIVVDDESRENEGDLIMAASLVTPEAMAFIVRHGTGIVCVSMKEDDLERLCLPLMVTTKENEEKLCTAFTVTVDAKEGTTTGVSAKDRAKTVMTLASPDSRPEDFNRPGHIFPLKYREGGVLKRAGHTEASVDLAMLAGLPPVAVLCEIVDDADGSMARLPKLRVFAERENLKIISIADLIRYRRKRDRLVERASVARLPSQWGNGHGYCYRSAIDGIEHLAMVKGDIGDGQDILVRVHSECLTGDIFRSARCDCGDQLAMAIEMIEKAGRGVIVYLRGHEGRGIGLGHKLRAYNLQDDGRDTVEANEELGLPVDSREYGIGAQILRDLGVRSMKLMTNSPAKYSGLKGYGLSIAGRVPLVTPITSENRKYLETKRTKMGHVYGLANAQVNQPSGSQSTEEKH

SEQ ID NO: 12853 - protein, 312 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRD

SEQ ID NO: 12854 - protein, 371 aa, Oryza sativa
MAAASLAPPTASFSPAPAPGRVKAAAPLLSRRPPGRFLLRVASESSSISGDTLLGLYEKERLSHSLYANEDYDKEMFWDNLDADLRYWTRSLRPVQWYPGHIAKTEKELKEQLKLMDVVIEVRDARIPLATSHPKMDAWLGNRKRIIVMNREDMVSNEDRNAWASYFANQGTKVVYSNGQLGMGTMKLGRMAKSLASTVNTKRREKGLLPRAVRAGIVGYPNVGKSSLINRLLKRRMCPAAPRPGVTRELKWVRFGSDLELLDSPGILPMRISDQTAAIKLAICDDIGERSYDFADVAAILVQLLVRHPAVGPEAFRRRYRLDMDSDCGKMFVTKLSVHLFNGDASQAAFRILSDYRKGKFGCVALERPPT

SEQ ID NO: 12855 - protein, 166 aa, Pseudo-nitzschia multiseries
GYSFTTTAEREIVRDIKEKLAYVALDFEAEMQTAASSSALEQSYELPDGQVITIGNERFRCPEALFQPSFLGMEAAGVHETSYNSIMKCDVDIRKDLYGNVVLSGGTTMFPGIADRMQKELTALAPSTMKIKIIAPPERKYSVWIGGSILASLSTFQQMWISKEEY

SEQ ID NO: 12856 - protein, 158 aa, Triticum aestivum
IDYWLTVGYLLGFIVIYAGARQPPYDGLGHLNHLTPLQLESLLTEEPTTRFWLVEFRTSFLTPCIQASSVMPELSNLYSNKNISFGLVDLGHFPNAAARFGISMWDHLPTYILFDKATEVARLPEIGNGTKVFVPKVTKKLLCHHFDLDRRLIEFLST

SEQ ID NO: 12857 - protein, 140 aa, Brassica napus
  misc_feature (134)..(134): Xaa can be any naturally occurring amino acid
  unsure (1)..(140): unsure at all Xaa locations
MRPLDEKETTQVFEKLFKFTGPNLKHLLERPAVEGPDAEPGRYCLRLHRNRVYYASEALVRRATAVSRPRLAGVGTPIGKFTHHGAFHLTVHALDLLAVHARRRVWLKPDTERSFLFGNSVPKSSLARITENTXAGDGVV

SEQ ID NO: 12858 - protein, 321 aa, Lycopersicon pimpinellifolium
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 12859 - protein, 150 aa, Symbiobacterium thermophilum IAM 14863
MERSFVMVKPDGVQRGLIGEVISRLERRGLKLVAAKLMRVSRELAEEHYAQLKDKPFFPSLIEFITSGPVMAMVWEGPNAISIIRKTMGATNPANAEPGTIRADFACDVSYNVVHGSDGPESAEREIRLWFGEVEPSYSRSVDRWIFPEG

SEQ ID NO: 12860 - protein, 169 aa, Malus x domestica
HGLWPSNSSGNDPIYCKNTTMNSTKIANLTARLEIIWPNVLDRTDHITFWNKQWNKHGSCGHPAIQNDMHYLQTVIKMYITQKQNVSEILSKAKIEPVGKFRTQKEIEKAIRKGTNNKEPKLKCQKNSQRTELVEVTICSDRNLNQFIDCPRPILNGSRYYCPTNNILY

SEQ ID NO: 12861 - protein, 446 aa, Tortula ruralis
MGQGQSGGLPKQGPGGERNKGDGQKKEKKYEPAAPPTRVGRKQRKQKGSEAAARLPVVTPATKCNLRLLKLDRAKDYLLMKEEFVRTQKRLNPQEDKTEKDRSKVDDLRGSPMSVGNLEEIIDENHAIVSSSVGPEYYVNILSFVDKDQPGPGCAILMHNKVLSVVGLLQDDVDPMVSVMKVEKAPLESYADIGGLDPQIQEIKEAVELPLTHPELYEDIGIKPLKGVILYGEPGTGKTLLAKAVANSTSATFLRVVGSELIQKYLGDGPKLVRELFRVADELSPTIVFIDEIDAIGTKRYDAHSGGEREIQRTMLELLNQLDGFDSRGDVKVILATNRIESLDPALLRPGRIDRKIEFPLPDTKTRRRIFQIHTSRMTMADDVNLEEFVMTKDEFSGADIKAICTEAGLLALRERRMKVTHADFKKAKEKVMYKKKEGVPEGLYM

SEQ ID NO: 12862 - protein, 463 aa, Rhodococcus sp. RHA1
MPPGGPMPKVLAAPPPQSTLQPISGNAGFPVIGHSLDYFRDPMGLLQSRWDRYGPVSWLSMAGKRWVTVLGPDGCQTVLQNKDRAFVNSDGWSVLIGPFFHRGLMLLDGDEHLAHRRIMQQAFTRDRLSRYTEALHPAVEKGLDGWQPTAGFAAYPALKELTLDLATSIFMGGAEGSTPREMAEINRAFIDCVQAATSVIRYPLLGTRWKRGIDGRARLEEFFRRYLPARRAGAGEDLFSALCHIESEEGQRFSDDDVVNHMIFLLMAAHDTSTITLSTMMQYLGQHPDWQERCRRQSAALGTSTPTYDQLDELTDLDLVMKECLRLVPPVPVVARRAVEDTEVLGHYIPRGTYMSVVVHFTHHMPEYWPDPERFDPERFAPERREDKVHRFAWEPFGGGVHKCLGMHFAGAEIKTVMHHLLRRFHWHVSPGYVAPLNYTSLPFPSDGQPVDLYHRVGGADTP

SEQ ID NO: 12863 - protein, 157 aa, Zea mays
LARYAIICQENGLVPIVEPEILVDGPHDIDRCAYVTETVLAACYKALNEPHVLLEGTLLKPNMVTPGSDSKKVTPEVIAEYTVRTLQRTVPAAVPAVVFLSGGQSEEEATRNLNAMNKLSRRANYPRQGLQVLSCFSLRARFGTPAYELGCGVWFAR

SEQ ID NO: 12864 - protein, 479 aa, Methanosarcina mazei Go1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 12865 - protein, 460 aa, Lactococcus lactis subsp. lactis Il1403
MCYNMDMTNFKKNDIFEAEVLDLTHEGQGVVKIDSFPFFVDNALPGERIKMHVLKVGKSFGFGRVDEFISQSKHRVTQLNLDYLRTGIADFGHLSYDEQVKFKHKQVVDILRKTAGKSDYPVLPVVEAIKTINYRNKAQIPVQMVDGLLTTGFYRKNSHTLIPVEDFYIQHPEIDAVVLFLRDEFRKINLQAYDEKTRKGWLRNIVVRRAFHTGEMMITLVVTSKKLPEKVELVIDHLVERFTNIKSVQLNINSGTGSFILGKEFILLYGKDFITDLMLDKTYQISAPAFYQVNTPQAEKLYETAYEFAGLKPGDVVIDAYSGIGTIGISMADRVAKVYGMEVVPAAVENAKRNAQLNELENTHYEVGTAEKIMPKWLSEGIKPDVIFVDPPRKGLDEGFIKAAAMMNPRRIVYISCNPATFARDVVRFEADGYLLDKVQPVDLFPQTHHIELVASFNKK

SEQ ID NO: 12866 - protein, 399 aa, Bordetella parapertussis
MRFADRMARIAPSPSSMAGQRMRELRAAGRNVIGLTAGEPDFATPDNIQQAALRAMRNGQTKYTDVGGVPELKAAVAEKFRRENSLAYRQDQIIVSSGAKQVIFNALLCLVQRGDEVVIPAPYWVSYPDMVRFAGGTPVAVACAQQHRFKLQPDELERAITPRTRCLILNSPNNPSGAAYDETELKALAQVLLRHPDICVITDDIYEHLLYDGRRFATIAAVEPALADRVLTVNGVSKSYAMTGWRIGYAGGPAALIANMVKLQSQSTSCPSAVSQAAAIEALTGPQDIIASSRKLFQARRDLLVRRINAIPGLHCDTPDGAFYVFASCAGLAGKRTPQGRTIDNDTDLALHLLDAEGVVVIQGDAYGMPGFFRLSIAASETLIEEAQRRIAAACAALH

SEQ ID NO: 12867 - protein, 324 aa, Gibberella zeae PH-1
MVNVPNIKLNSGFDMPQIGFGLWKVDDNCAEVVYNAIKAGYRLLDGACDYGNEKACGEGVARAIKEGIVKREDLFIVSKLWQTYHDKKNVEPITRRQLADWQIDYFDLFLIHFPVALEYVDPEVRYPPGWHYDDAGTEIRWSKATNQETWEGMEDLVEKGLAKSIGISNFQAQGIYDMLKYAKIRPATLQVELHPYHQQSELVSLAKAEGIALTAYSSFGPTGFIELDMDIAKSASPLMQHEVFTTLASKYNKTSAQVLLRWATQQGLAVIPKSTTPQYMAQNFDCFEWSIDEEDMKRISKMNLNLKFNKPTNYFPTEKLWIFG

SEQ ID NO: 12868 - protein, 799 aa, Yarrowia lipolytica CLIB122
MLNLEPIGKSTLLSFGETRVLIDFALDSQEAAERGDSFFETLNLVLFTHANAAHLGAYALACKLYPALAAVPAYGTLPVINMGRIATLEAYRSQGLLSSEHITATEIEIIFDNITSIKYLQPIGIGVRSKGEVATTATEDGNSTELTTTQVTTHETLTITAFNSGHSLGGTIWRLQHQQDNVVYAVDWNHAKDSHLSGAAFLQKGGQIVSALHRPTVMVCGSQTGLRLKRRDILLWSSIQKALKRGGSVLLPTSVGSRVLEVIHMLDDLWTNNQNSQQGVTLVLLTHLGARLLEYASSMLEWMSPSIIAEWEKKNESPFQTRNFKIVHSMDQFDKVVKGGNGQFVVVSVGEDLESGFSRLLFNRLASDERNSVLFTERSEGNSLATELQDKWEKTERDGNSAKMDFQTTLKMPTYTPLSEAEMKEYRTTVESQQKDLQMVKAMELRNKELLEEAEAEEMMDSSDDEDVSRMQGSGQEYGFLHGTVLDVDVRDAVGSLRNFPFYQKRQRVSEYGIPIHPSDFARVEERPEVAWKERDRNEFDSDEPRKRQRRRTKAAAEEQEERVVEDADDAPETITSLDNQPIRVSYEDVDLNIICHVDFVDLSGRIDERSLGMIMHSIHPKKLLLLDDSRRADDLCSYLKREDDTDVHVLRGLTTAGTHSFAVDIQLTPELSRLLNWQQLSGGLSLAHVVGKVAKNEDKSEDTPLAALALQPIVDAADLAVAPRIEPLRVGDIRLAELKQALGKLGFRAVFQAGGVLVVDGKVSIRKVDESNLVVDGGIGSDFYAIKEVVRAQLAQIG

SEQ ID NO: 12869 - protein, 506 aa, Yarrowia lipolytica CLIB122
MPKPKAPTSKRTSTRLREGIKKKAAAHGRKQRKLAKKDVTWKSKNKKDLGIPNSFPYKEQLLQQLDAQKQAEVAEKERKKEEARQARAEARSRGEDVPDEEEFEDNPMAALLASARAAAEEYDGSDDEDEEMESEVTELDVKVNPGDDVFNESSRKAFDKIFKTVVDQADVILYVLDSRDPEGTRSRAVESAILSNPDKRLIFILNKVDLIPAENLQNWVNTLRLTFPTLPLRAANSGPVTGRQLCNKNVTQQSTSTALLDALKKYAKDSQLKRSVIVGVIGYPNVGKSSIINALTKIHGGGRACPVGAQAGVTTALREVKIDNKLKILDSPGIVFPSEKANKVQEQARLVLLNAIPAKQMVDQVPAVQLLLKRLTNDESLLQQFMEHYSIPPLSHANFKDFTTNVLIHVARKTGRLGKGGIPNLEAASKNIINDWRDGRILGWTQAPEYTEALADEENRPGISSSKSLKAPAKQQDTKTVVQEWAKEFDLGGLWTPGEDDEDVDM

SEQ ID NO: 12870 - protein, 165 aa, Triticum aestivum
MAAGKRTIGLAMDYSPSSKAAMRWVFENLVKAGDRIILIHVLPKGADASHKGLWKSTGSPLIPLLEFMEMNVQARYGVNPDKEVLEILQAESKSKQVEILAKIYWGDAREKLCEAVDDLKVDSVVLGCRGLGPLKRALLGSVSNYVVNNATCPVTVVRGPNGSLA

SEQ ID NO: 12871 - protein, 223 aa, Picrophilus torridus DSM 9790
MIQEAVKSLRSGMPVLIFDSDDREGETDMVYASQFIRPESIRSMRKDGGGLICTTIKMEDALLTRLPYIEDLYKTLDIPNITNADDLKYDKNSTFSITVNSRETFTGIPDIDRAKTVKDISFYIDNLRRKKMDYNDFGRIFRSPGHIHLLIASDGYFKKRRGHTELSTYLVEISGLIPSATIVEMLSDTGRSMTMEEAMAYARNHNYTFITGDEIISHWSGSN

SEQ ID NO: 12872 - protein, 149 aa, Bacillus subtilis
MMEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 12873 - protein, 92 aa, Debaryomyces hansenii CBS767
MSKFILPNTLRELRFHLSQTGEASIPLRKFLTANYPSLKTQLNYKLPILIRESYGIPPSITARFEKGMEIKNNVEGLDEKGIEGIFKDLLKN

SEQ ID NO: 12874 - protein, 148 aa, Oryza sativa
  misc_feature (9)..(9): Xaa can be any naturally occurring amino acid
  unsure (1)..(148): unsure at all Xaa locations
MDHEADAYXTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTVRTHETTKPKR

SEQ ID NO: 12875 - protein, 307 aa, Arabidopsis thaliana
  misc_feature (17)..(18): Xaa can be any naturally occurring amino acid
  misc_feature (193)..(193): Xaa can be any naturally occurring amino acid
  misc_feature (213)..(213): Xaa can be any naturally occurring amino acid
  unsure (1)..(307): unsure at all Xaa locations
TRPRLSKVYSTLACLCXXAQPSFRKGVRQIARLKSDKQAISVGFVGYPNGGKSSVINTLRTKNVCKAAPIPGETKVWQYITLTKRIFLIDCPGVGYQSRDTETDIVLKGVVRGTNLEDASEHIGEVLRRAKKEHLQRAYKIKDWEDDHDFLPQVCTSSGNRLKGGEPDLMTGAKMILHDWQRGRIPFFAPPPXLANVASRIRSNSARPWLRKXIADNSQAAAALKAIAGIMSTQQQKDVPVQRDFYDEKDLKDDKKAKESTETDAENGTDAEEDEDAVSEDGVESDSDADEDAVSENDEEDESDSAE

SEQ ID NO: 12876 - protein, 432 aa, Schizosaccharomyces pombe
DREVDVGIPDPTGRLEILRIHTKNMKLADDVDLEQIAAETHGYVGSDLASLCSEAAMQQIREKMDMIDLDEDEIDAEVLDSLGVTMDNFRFALGSSNPSALRETVVEVPNVRWEDIGGLEEVKRELRETVQMPVMYAEKFLRFGVTPSKGVLFFGPPGTGKTLLAKAIANECSANFISVKGPELLSMWFGESESNVRDIFDKARAAAPCVVFLDELDSIAKARGASAGDSGGGDRVVNQLLTEMDGVNSKKNVFVIGATNRPDQIDPALMRPGRLDQLIYVPLPDEEARFSILQTQLRHTPVAEDVDLRAVAKATHGFSGADLEFVVQRAVKLAIKDSIEEDIKRENETGEAPADDVVMDEDASVSQVQRHHVEEAMKMARRSVSDAEVRRYEAYAHQLLTSRGLTGFQFDSADSNTNGPSFGNDGADDLYA

SEQ ID NO: 12877 - protein, 338 aa, Bacillus licheniformis ATCC 14580
MKAAVMTKPYSIEFHDIPRPEPASGEVLVKIKAAGICGSDVHFYDGSNPYAQYPQIFGHELAGIIEKTGAGVRGRSAGERVVIEPAIPCGGCYPCRKGRTNACMNIDMIGSVRRGGFADFIIVPETHVHPIPEQMDFATAALCEPFSIGAQAVRRADIQTGETIVILGMGPIGLTILAQVKKRFDVRVIAVDPVRERLELAEAFGADAVIQPGEEDAEQMILKLTGGEGAGIVFEAAGIPATIEQSVRLAAAAGRIVIVGLTGRNVTIPGLLLTKKDIEIYGTKHSVNQFPGVIQFLNENPEIARAFVTEIMPFMEIEEALKKAKNCPHQVTKIILSY

SEQ ID NO: 12878 - protein, 353 aa, Aspergillus oryzae
MPPKKQNNEPKKKKASVEDKTFGMKNKKGAQAKKQIEQLRTQEKSNKSADAKRKEAEKARREAEKKAAEQAKKEAAELFKPVQVQKIPFGVDPKTVLCVFFKQGNCEKGKKCKFSHDPNVERKAAKKDLYTDSRDVKATEEENKKKDTMDDWDEEKLRNVVLSKHGNPKTTTDKVCKFFIEAVENQKYGWFWVCPNGGDACKYKHSLPPGFVLKTKEQRAAEKALMDKSPLNTLTLEDWLESERHKLTGNLTPVTPQTFAEWKKQRLDKKQAEEQARKAKEATGRTLFESGNWRAEDESSDEEGDDDDTFNLAALRRETERIREQKEEERLARLHGAPVPISNDETIAQEGEG

SEQ ID NO: 12879 - protein, 393 aa, Staphylococcus epidermidis RP62A
MQFDTIELAIEALRNGESIIVVDDEDRENEGDLVAVTEWMDDNTINFMAREGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTNYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 12880 - protein, 1031 aa, Oryza sativa
  misc_feature (32)..(32): Xaa can be any naturally occurring amino acid
  misc_feature (139)..(139): Xaa can be any naturally occurring amino acid
  misc_feature (475)..(475): Xaa can be any naturally occurring amino acid
  unsure (1)..(1031): unsure at all Xaa locations
MHLRLLLLLVGVAAAAADADADADALLAAKAXAMSDPTGALASWGGNGTRTNTTAAAAAHCAWAGVTCSSRGAVVGLDVFGLNLSGALPAELTGLRGLMRLSVGANAFSGPIPASLGRLQFLTYLNLSNNAFNGSFPAXALARLRRLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVCTRAAPNLGEISLSNNQLTGAXPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENIIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 12881 - protein, 227 aa, Sordaria macrospora
IAAAETPVMDELSKSATGFTELDASSLAVGLPEGLMGNSEVGHLNIGAGRVVWQDVVRIDQTIKKGELGQNDVIKSTFERARNGNGRLHLCGLISHGGVHAKQTHLYALLRAAKEAGVPKIYIHFFGDGRDTDPKSGAGYMQELLDTIKEIGIGELATVVGRYYAMDRDKRWERVEVALKGLYLGEGEESTDPVKTIKERYEKGENDEFLKPIIIGGDERRIKEDDT

SEQ ID NO: 12882 - protein, 538 aa, Hypocrea jecorina
MSQISRTQSIMATTAQEHLETGGRINWLASLNTAFTPARNFRRTSIICTIGPKTNSVEALNKLRDAGLNVARMNFSHGSYEYHQSVIDNVRASVAAHPGRPVAIALDTKGPEIRTGNTAGDVDIPISAGTVMNFTTDEKYATACDTQNMYVDYKNITKVIQPGRVIYVDDGVLAFDVLSIKDDQTVEVRARNNGFISSRKGVNLPNTDVDLPALSEKDKADLRFGVKNNVDMVFASFIRRAQDIKDIRDVLGPEGKQIQIIAKIENRQGLNNFAEILEETDGVMVARGDLGIEIPAAEVFAAQKKMIAMCNIAGKPVICATQMLESMIKNPRPTRAEISDVGNAVTDGADCVMLSGETAKGNYPAESIHEMHEASLKAENTIPYVSHFEEMCTLVKRPVSTVESCAMAAVRASLDLGAGGIIVLSTSGDSARLLSKYRPVCPIFMVTRNPTTSRFSHLYRGVYPFLYPEQKPDFDTVNWQEDVDKRIKWAVTRAIELKTLTAGDTVVVVQGWKGGMGNTNTLRIVRADPDHLGIGQME

SEQ ID NO: 12883 - protein, 169 aa, Gibberella zeae PH-1
MENLSITDAPPQGRGAPQPLPQLPPQMFTTAAQLLDLTDKKLMVALRDGRKLIGVLRSWDQFANLVLQSTIERIFAPSPDSAGSDRPTGLYADINHGIFLVRGENVLLLGEIDLDRDDDPPPGFELAELEVVKKIAEEKKAADKARDKLRVKKLAKHGFEGENIGEIVL

SEQ ID NO: 12884 - protein, 402 aa, Pleurotus ostreatus
MLRLIILVAAASAGLASPFFSQPFDLTTRADSLTSSCSTTGSASCHNTSSVSNLCCFESPGGLLLQTQFWDTNPSTGPSDKWTIHGLWPDNCDGTFEQNCDPSRAYTNIASLLSSGGASDTLSFMQTNWVDINGQNEQFWAHEWSTHGTCMSTLHTSCIPSGSVRGTEAVAFFQTVVKLYKTLPTFDWLAGQGIRPSTTQTFTLATLTSALKTASGGFTPALDCSSGALNQISWYFNLRGSIIDGTFVPINAPKAGSCPSSGIRYPPKSGSGTPTTPPSNPGGLPARATIHAIKSGSQIGGLLSLGTWSTQTLATFTLTGTASSFTMTSSKGNCGVSGGSFSCGSGVNPTTFSAVTSGSDLLLASGGSTAWGSDGTPSGSTVFTVFTGSSHSQDYTLTIVGA

SEQ ID NO: 12885 - protein, 164 aa, Oryza sativa
MGRRAGSYPYYVEAAPPVDVNKNTEWFMYPGVWTTYILLLFFAWLLVLSVSACSPGIAWTVVNLAHFAITYHFFHWKKGTPFAADDQGIYNRLTWWEQIDNGQQLTRNRKFLTVVPVVLYLIASHLTDYKQPMLFLNTIAVLVLVVAKLPNMHKVRIFGINADI

SEQ ID NO: 12886 - protein, 197 aa, Momordica charantia
EAEAYVEFDSFWFVQQWPPAVCSFQKSGSCPGSGLRTFTIHGLWPQQSGTSLTNCPGSPFDITKISHLQSQLNTLWPNVLRANNQQFWSHEWTKHGTCSESTFNQAAAFKLAVDMRNNYDIIGALRPHAAGPNGRTKSRQAIKGFLKAKFGKFPGLRCRTDPQTKVSYLVEVVACFAQDGSTLIDCTRDTCGANFIF

SEQ ID NO: 12887 - protein, 900 aa, Debaryomyces hansenii CBS767
MGDYLTPSELPQPKLTRTNTGFTPNQIIALDTSIPESSKKIWKKHTHLKPFDVKEKRFKDEETKKNTPLNDNEKFEEEFIKHVEITLARNMYNCDNLGAYQAASNTIRDELLIDWANTQQKQTIHDGKRVYYLSLEFLMGRAMDNALINLKSREHTKSALRELGFNLEDVLDQEPDAALGNGGLGRLAACFVDSLSSKNYSGWGYGLNYQYGIFQQKIIDGYQVEQPDYWLEYTNPWEINRSEIQIPVDFFGYVYESYDTNTGRPKKIWNGGERVLAVPADYPIPGFNTENTNNLRLWNAKPTNEFDFNKFNAGDYQQSVASQQKAESITSVLYPNDNFMHGKELRLKQQYFWVAASLHDIVRRFKKNHKDNWKKFPDQVAIQLNDTHPTLAIVELQRIFVDLEELPWDDAWSIVTRVFAYTNHTVMTEALEKWPVELVSRLLPRHLEIIYDINFFFLKAVESKFPKDRDLLRRVSIIEEENGKSVRMAYLAIIGSHKVNGVAELHSELIKTTIFKDFVAFFGDDKFMNVTNGITPRRWLKQANPELAKLISEKLNDPNYSYLTNLGKLKELEQFVDDDEFLIKWDIIKFNNKVKLATLIKHLTGITIDPTVLFDIQVKRIHEYKRQQLNIFAVIYRYLHIKELLAKGVSVEEIKLKYYISKCSIFGGKAAPGYYMAKTIIHLINVVADVVNNDEEIGNLLKVVFIPDYNVSKAEIIIPASDLSNHISTAGTEASGTSNMKFALNGGLIIGTVDGANVEITREIGQENIFLFGNLAESVEELRHKNVYNGVNIPDSLKKVFNAIESGRFGNPDEFHTLIESIRDHGDHYLVTDDFDLFLDTHIKLENIYGHHGGDAKDKDHLHKWVKKSVLSVANMGFFSSDRCVDEYAENIWDVEPLNP

SEQ ID NO: 12888 - protein, 559 aa, Zea mays
MGSSGFSWTLPDHPKLPKGKSVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 12889 - protein, 219 aa, Shewanella oneidensis MR-1
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARQLVKLGGDPVYREGVITDNGNVILDVYNLKILNPKELEDKINAIVGVVTNGLFAKRGADVLLVGTPEGVKTFTA

SEQ ID NO: 12890 - protein, 243 aa, Triticum aestivum
CAWLEIQSLCTSSDILNNLNLKNHWMKDFFIASAHLELKMHEEALKRYERLMGVFRCSDYIQAQIATVQYSMRDLDEADMIFEELLRTDPFRVDSMDIYSNLLYAKESLTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYALYYFRKSSHLQPNDARLWIAMAQCYESDP

SEQ ID NO: 12891 - protein, 441 aa, Halobacterium sp. NRC-1
MSGSPYASPSEADTDAMLDAVGVDRVDELFDIPPEVSFDGEFGIDAKSEQAALRGVRRRLSDNDDLTEFLGRGHYEHYVPSLVDSVSQRSEFITSYTQYQPEITQGFLQVLFEYQSLLVELTGLGVANCSMYDAATALAEAALLAKRVRAADGNRVLVPGFVRDSHVDVLRNYTSGSDVVVERYATDAGNVDLDALEAAMDADVVMVYAENPTTCGTVEEQLCAVGDLADSHDALFCLGSDPVAMSILQRPVDVGADVVVGDASVLGMPTSYGTGLGVFATRKEFLRQVPGRLVGASEDDAGTRAFTLTLQTREQHIRKERATSNICTNQAWVALRAAIHAAWLGADGLVDLAERMVELPRDLAARLDDVSGVTAPVHDDRHHIREFQARTEQPAPAVASALEAEGFGVHAVDDHTIQVCVTDANEHATDAFVAAVREVSE

SEQ ID NO: 12892 - protein, 98 aa, Glycine max
MSNVTEKLGIKIERNPPEDKLTQLGVRQWPKWGCPPSKFPWTYESKETCYLLEGKVKVTPSGANESVEIAAGDFVEFPKGMSCTWDVSVAVDKHYNFE

SEQ ID NO: 12893 - protein, 998 aa, Arabidopsis thaliana
MRRCKNNTDKFSVITMRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQVETVAQFGVIFLLFALGLEFSAAKLRVVRAVAIPGGLLQIFLFMCLSGITASLCGGKLTEGIFVGAFLSMSSTAVVLKFLMERNSISALHGQITVGTLILQDCAVGLLFALLPVLGGTSGVLQGVLSMAKSLAILIAFLGALFVLSRTWVPWFLKLMTSLSSQCSDKLGLSLELGSFAAGVMISTTDLAQHTLEQARSQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEHNTQHEATFGLKVGKGNEWELPNIYTAIAMDNHLELAIKDAITADDLKRVDQETQHPLLAQELDLDSLENPPRATTHTYRLYSKGLVSEELIKDDTMLVVGLGLSLCDSHDYTKQEINKALRNQKLAAHPEAAELAAIIHGLKWALELGIERIQFFCDDSNILAYVTRKAAPNESIVAKLLEHVSLLQTRFTSCQALATVSRDDIVSVIKLAKDAIASQTRWCEGDTEYESCPVCYAYVSPNDKFEVQGCFHRICVTCMRKPFSSEQILRGNTAICPYPDCENDLVPEDCRAFADADAITLMIQRKKEKAIPVKDRVYCPNPSCSFLMSDLDLIRHISKNPRHSEEARKCMECGLSFCKKCHVPWHYKKTCDEFKKSESYLKSDAAILESFVKTQGWKKCSQCQSIVQHGGGCQQMTCRHCKHEFCYTCGAPCKKKKLTCKCSRSGK

SEQ ID NO: 12894 - protein, 267 aa, Dehalococcoides sp. CBDB1
MNIAFIGGGNMGEAILGALIQKNICPPQNITVSEIKAERRTYLETSYGIKTTASNPDAIKSAEVVLLAIKPQNLPELSAELKGKLADKQLVISIIAGATLSKLSGGLAHKAVVRVMPNTPAMIGMGMSVWTALPSVSPAQKDQAKAILSAMGKEIYTGKETMLDAATAISGSGPAYFFLFMEGLEKAALEMGFTPEEASILVSQTAAGSAIYAGKSGLALTQLRKNVTSPGGTTAEAIKAFEEAGLEATIIKAAKAAFNRSVELGKG

SEQ ID NO: 12895 - protein, 92 aa, Shewanella oneidensis MR-1
MVQATARHLLVSSEDQCQALKQQILDGADFAQIARAHSSCPSGAQGGELGSFGPGMMVREFDEVVFSAPLNVVQGPVKTQFGYHLLEVTSRG

SEQ ID NO: 12896 - protein, 452 aa, Cytophaga hutchinsonii ATCC 33406
MTEKEIVDYIKNNDIQKIKFAFADIDGVLRGKLIHTDKFLDGLKEGLGFCDVVFGWDSADAGYDNVSATGWHTGYPDKLAQIDLSTFRLIPWENNTPFFLADYKNNDQTALPICPRTLLKRIAQECSAMGYHAAFAQEFEWFNFRETQQSLVEKNFHDLTPLTNGMFGYSILRPSLEDAYYNDLFDLLGAFDIPLEGLHTETGPGVYECAYFHDEVVRAADKATLLKTAVKEIANKHGIIATFMAKISDKLPGCSGHIHQSLWNTGKTENLFYDPNQEHNMSDLFKHYVAGQLYCLPHIVPMLAPTVNSYKRLVEGAWAPTTLTWGFDNRTTALRVLNHSKKTARLEQRVSGSDTNPYLAIAASLASGLYGIKHKLSLDVPPTTGNGYANKSNGSIASNLMDATQLMKNSSIAKELFGEAFVQHFTATREWEWRQFSKHVSDWEMKRYMEII

SEQ ID NO: 12897 - protein, 570 aa, Triticum aestivum
  misc_feature (141)..(141): Xaa can be any naturally occurring amino acid
  unsure (1)..(570): unsure at all Xaa locations
MPAAHSLLHLAAPKSVAPTSTLSLAGAAHLRLLPSRRPQRLVASCSSAHPDLAAFPNPNGLLVAEPAAAAPIDIDVATEAELRENGSRSTRRTKLVCTVGPATCGPSELEALAVGGMNVARLNMCHGDREWHQKVISSVRXLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGSDIAVIAKIESIDSLTNLEEIIRASDGAMVARGDLGAQIPLEQVPSIQQKIVKLCRQLNKPVIVASQLLESMIEYPIPTRAEVADVSEAVHQRADALMLSGESAMGRYPDKALIVLSSVSLRIERWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 12898 - protein, 602 aa, Pseudomonas syringae pv. syringae B728a
MPHEGSLLQVAVVFLLAAVLTVPLAKRLKLGAVIGYLFAGVVIGPSVLGLIGDTESVSHISELGVVLLLFIIGLELSPKRLWVMRKSVFGVGMAQVLLTGLIIGGVAFAAFGQSLNTAAILGLGLALSSTAFGLQSLAERKQLNSPHGRMAFAILLFQDIAAIPLIAMVPFLAGADHAMDTGESINHGLRVLGSIAIVVIGGRYLLRPVFRIVAKTKIQEVSTATALLVVIGTAWLMELVGVSMALGAFLAGLLLADSEYRHELEAQIEPFKGLLLGLFFISVGMGANVGLLLSSPLIVLGLTLLLIAIKLPMLFLIGRTLGELNNRSALQLGLVLAAGGEFAFVVFKIGSAQGLFEAGLYDMLVLTITLSMAVTPLLFIALARWIKPKVKPVEVPEEYRDIQTDKPRVVIAGMGRMGQIVARILRAQKIPFIALDTAVESIEFSRSFGNVPVFYGDPLRPEILRAAKVDEAEYFVIATDDPDTNIKTAELIRKLYPHMKIIARARNRQHVHRLMDLGAHAVRETFYSSLEMSRQTLMGLGLSETQADARISRFKRHDEQVLAAQHEVYDDDAKVLQTAREARADLAQLFEADRLDEEAAKS

SEQ ID NO: 12899 - protein, 396 aa, Frankia sp. EAN1pec
MDGRPRGAHPQRLRRPVKPDRLQGLVRQLPEHALRPTLPLRRAGGCRSRPPETAVASARGYMGYMGAGSGAGHTAGSPGDGEIMATSGRITTPFTAESTAAEVVAGIDLGGRRVVVTGASSGIGVETARALAGAGAEVTLAVRDVEAGRWTADDIVAAMGNKEIHVAPLDLADRASVAAFVAGWDGPLHILVNNAGVMATPELRTPEGWELQFATNHLGHFAVASGLRGALAAAGGARVVSVSSSGHLRSPVVFSDIHFRERAYEPWAAYGQSKTANVLFAVEATRRWADDGITVNALMPGAIATRLQRHISTEDLDRLRGQINAPALVWKSVEQGAATSVLLATSPLLDGIGGRYFEDCNEALPNTPGVRGGVAAYALDPEAAARLWDVTVDTLT

SEQ ID NO: 12900 - protein, 289 aa, Candida albicans SC5314
MSAQLKTNNDRIALNNGNKIPVIGLGTWESNKDAFLTALKLGYRHIDTATIYKNEEQVGQAIKESGIPREELFITTKVWNNDHKNVEQALETSLKKLGLDYVDLYLVHWPVSIDKTTKEPYPDYDYVDTYKELQKIYKTTTKIKSIGVSNFTKSQLERLLSADGVDVVPAVNQVEAHPLLPQPELYEYLKEKGITLEAYSPLGTSSSPLIKNKTIVEIADKNGVDPAQVLISWAVQRKTVVLPKSVTESRLVSNLKTFELSAEDFDTLNKLSEKEGITRIINPFKNFQD

SEQ ID NO: 12901 - protein, 308 aa, Eremothecium gossypii
MLASRPIKAMALRRMYSIHSSSKQKTIPDIFKKYHAKEPISMITAYDYITATWAHAAHTDMILVGDSLAMSTLGHVSTVDLDLQEFQYHVRSVCRAPGSSFIIADMPYGSFERSIEQGVETAISLMKTSSRVGAVKLEVGAEENDYCLELAAELCRRGIPVMGHVGLTPQRMHALGGYKVQGAKDLGQALAAYHRAKDLQAAGCFSIVIECIPTKLAGIITEKLSIPTIGIGAGPQTSGQVLVQSDLLGMLPGKAPKFVQKYADFHGDAIGSLCSYVEDVRQGVFPKVGQHTFTVSEELLEEFSKQVD

SEQ ID NO: 12902 - protein, 471 aa, Burkholderia sp. 383
MNQRQGFDAIVEREKGLHRGLSTGQLSMIAIGGAIGTGLFLGSGFAIGFAGPSVLVSYAIGALIALLLMGCLAEMTVAHPTSGSFGAYAEHYVSPWAGFLVRYAYWASIVFAVGTEVTAIAVYMKYWFPAVPGWYWIVGFSAALIGINLVSVKVFGAVEYVFSMLKIAAIVAFIALGAVVVFGAPAGSGIGFANYTAHGGFFPKGVWGMWVAVIVSIFSYLSIEMIAVAAGEARDPHQAITRAFRATMVRLVFFYLLTLALMLAIVPWTAAGADESPFVKVMAATHVPGAAGVINFVILVAALSAMNSQLYITTRMMFSLSRAGYAPKALGRLTGHGVPAAALGLSAIGIALATVLNVLYPDTSFVMMMSVSMFGAMFTWLMIFVTHLFFRRHHRGQVLAFRMWGFPVTSLLGAALMFAALVTTYFTREFRMTLFCGVPFMIVLSVVYAVWYRGKGAEPAAGREGVHVPGQ

SEQ ID NO: 12903 - protein, 203 aa, Oryza sativa
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSLPVIGSSFLVFL

SEQ ID NO: 12904 - protein, 246 aa, Triticum aestivum
MMDLHIKPDPQQEAHESAPSTKSFQHSPEATGTELERALHGRHLQFIAIGAAVGTGLFIGTGNALATAGPVSLLIAFIFVGTLLFSVMTALGEMAAYIPVAGAFTTYATRFLDPTFGFAMGWIYWFSWSITFALELTAAGLIIQYWEKDLSIGIWITVFWFLFTAANFMPVRWFGEFEMWFSSIKVITIIGFIIFSICVNAGVGDQGYIGFKYWKDPGAFNEHIVEGDIGRFVGFWSVLITAGFSY

SEQ ID NO: 12905 - protein, 330 aa, Shewanella sp. ANA-3
MQTLAQHLTSKAVNESLSQLILTLADTSKAISHAVRHGALAGVLGATEQENVQGETQKKLDIITNDMLKDALKADGTVRGLASEEEDHVVEVCANGQYLVCFDPLDGSSNIDINSLVGTIFSVLPAPQGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGLDYSEEPSLD

SEQ ID NO: 12906 - protein, 262 aa, Legionella pneumophila str. Paris
MNISFIGYGNMAKAIARNLQKQNKYSLSAASPSLSVGISKENIRTHYDNKEVAKDADVIILAVKPTQMCEVINEINPFISSGCLLISVAAGLTLTWFAKYCKKGQAVVRTMPNTPAIVGFAATSMIANEFVNEKQKKWAEQLFSSIGITDWVKDEEDMDTLTALSGSGPAYVFLFLEAMINAGVQLGLEETTAKHFAIQTFAGSIQLAQHSQLSLTELRKKVTSPGGTTAAALEILHGDFDALIYSAMKAAKQKAHELGKVE

SEQ ID NO: 12907 - protein, 303 aa, Bifidobacterium adolescentis
MTENVNEHTQGHLLGAADIRRIAADAGISPTKKFGQNFVIDPGTVRRIVREAGVTADDHVLEVGPGLGSLTLAILETGATMTAVEIDPPVAERLPKTIAEFMPDAVDRFRVVNRDALTVNPENLPDFKDDDSFTLVANLPYNVATPILLTLLERFDNLGTFLVMVQKEVADRLSEKPGSKIYGTPSVKLAWYGTAERVGVIGRNVFWPAPNVDSALVLFKRYPGGHTPAADNADGSVVDRETVFRLIDAAFGQRRKTLHAALKKIVPSEAFEKAGIDPTRRGETLTIDEFVALARALDEVFAS

SEQ ID NO: 12908 - protein, 291 aa, Triticum aestivum
  misc_feature (196)..(196): Xaa can be any naturally occurring amino acid
  misc_feature (229)..(229): Xaa can be any naturally occurring amino acid
  misc_feature (237)..(237): Xaa can be any naturally occurring amino acid
  unsure (1)..(291): unsure at all Xaa locations
VTLPNKFVQKSRLAPVRNSRDIVDPRVREYNAQTKDNVIALMVDTKGPEVRSGDLPQPIFLETGQEFTFTIKRGVGTETCVSVNYDDFVNDVEAGDMLLVDGGMMSFLVKSKTEDSVKCEVIDGGELKSRRHLNVRGKSATLPSITDKDWDDIKFGVESQVDYYAVSFVKDAQVVHELKDYLRSSNADIHIIVKIXEVQILFQTLLSIITASDGAYVARGNLGAKLPIXEVPLLQEXIIKIGQNLGKSLSFAATNMLGKNDPFSQFPPGEKFPKLALTFSEKVLNCIFSFL

SEQ ID NO: 12909 - protein, 401 aa, Pyrococcus horikoshii OT3
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 12910 - protein, 1125 aa, Schizosaccharomyces pombe
MVQKVLSRQSDNSQDVSAEQLDVVESGSIDQQNIRAWVVRKVKENDKRTSTNQSFKWEAVKPASCLDAANEKFMYLHGGREKSGISNSLFKLDLDSCTVYSHNRGEDNDSPARVGHSIVCSADTIYLFGGCDSETDSTFEVGDNSLYAYNFKSNQWNLVSTQSPLPSPRTGHSMLLVDSKLWIFGGECQGKYLNDIHLFDTKGVDRRTQSELKQKANANNVEKANMEFDETDWSWETPFLHSSSPPPRSNHSVTLVQGKIFVHGGHNDTGPLSDLWLFDLETLSWTEVRSIGRFPGPREGHQATTIDDTVYIYGGRDNKGLILNELWAFNYSQQRWSLVSNPIPILLSDSSSYKIVSKNNHILLLYLNALDAPKQLLCYEADPKNLYWDKDKFSDIPVLQHISMKPSNASNHTVSLGYLNDRPNHSKKNSVTSTSSSQFNNFLEQNQKAVRSARHRHYASLDEQGLHSLRNLSKTSGMNHSADFSLHEFGQADPFAYEIEKPIASLPLPNGNDTISRSSESSSPINESESNSLLKLQSDFKFSNSDDRVAWLEEQLLYCMQQGYTLKPPNLFQHVDEKLRLEKKEQLSYLEILKVIEQMLESNEQKFKKQIVSLASENAKLAAQRDAAVENANYSRSLIQKKTTDETVGSLIEKVGKLEYEVQGTLEEATSYYQKNTELQQLLKQNESASELLKSRNEKLCVDYDKLRSVFEEDSSKILSLQKENENLQSQILQISEELVDYRSRCEALEYGNYELETKLIEMHDRVEMQTNVIEASASALDVSNTAILSFEDSLRRERDEKSTLQQKCLNLQYEYENVRIELENLQSRALELESALEQSVSDAKYSKAIMQSGLSKLLSSINENKDNLKEFSKSKQKISYLESQLEGLHELLRESQRLCEGRTKELLNSQQKLYDLKHSYSSVMTEKSKLSDQVNDLTEQAKITQRKLSEVQIALADSKMNQQLSGKDSTDVHLPTDFSASSSPLRSYFNEEDSFNNASAAHSSKESDIPSGGVFTKYRNHFGNLMTSEETKAPDNNDLHKRLSDVINSQQKFLSLSPQVSKDYYDVRSKLNDTAGSFSGEEMRAIDDNYYASRIKQLEDDYQKAITYANCSDESFQQLSHSFM

SEQ ID NO: 12911 - protein, 659 aa, Ralstonia eutropha JMP134
MHSPLELTLVLLAAAVFGVVAFRMLQLPPMLGYLAVGILIGPHALGLASDTAQTKYLAEFGVVFLMFSIGLEFSLSKLRAMKRLVFGLGGSQVVLSMLAVVPASWLFNWLFPLSWQASVALGGALAMSSTAIVSKMLSERVELESEHGRNIISVLLFQDLAVVPLLIVIPALSRDPGDLMVALGMATAKIAVALGVIFFLGQRLMSRWFHVVAARRSQELFMLNLLLVTLGMAALTERLGLSMALGAFMAGMLISETPYRHQVEEDIKPFRDVLLGLFFVTIGMLLNIQVVIEHIWLVLVLLGVPILFKLLLISVLARLFGSRQGVAIRTGLGLAQAGEFGFVLLNQIDGLNLVDPVLIQVILASMLLSMLAAPFLIQYSDAIVLRFAANEWLMQSLNMTRIAAQSLQTEKHAIICGYGRSGQNLAHMLERESITYVALDLDPDRVRDAAAAGDTVVYGDAGRREALIAAGIHRAAAVIITYANTPSALKVLHHVQELAPALPVIVRTVDDSELDTLQKAGATEVVPEIIEGSLMLASHALVLLGVPMRHVLRGVQEARDARYSLLRGYFHGRDDEEDMVERDSVRLHSVSLEPAATAVGRRLGALGLERIGAEVTAVRRRGIRAFDPEPDTILEVGDIIVLRGTPEALEAAETRILSD

SEQ ID NO: 12912 - protein, 479 aa, Ralstonia metallidurans CH34
MTRSTKIVATIGPASSTLEVLTRMIGAGVDVVRLNFSHGTAQDHIDRAALVREAAAACGREVAIMADLQGPKIRVGKFENGKITLKPGDAFILDSACQMGNQERVGLDYKDLPRDVGPGDLLLLNDGLIVLVVDRVLGNEIFTTVRIGGELSNNKGINRQGGGLSAPALTAKDMEDIKTAMALGADYVAVSFPKNATDMEMARQLTNVAGQPHNHKARMIAKIERAEAIRPGVLEEILLASDGIMVARGDLAVEVGNAAVPALQKRMIKLAREANKLTITATQMMESMIVNPVPTRAEVSDVANAVLDGTDAVMTSAETAAGRYPVETVEAMAAICLEAEKSEVVQLDTDFLNQTFARIDQSIAMGALFTAYHLGVKAIAALTDSGATALWMSRHRIHVPIYAMTPNLASQRKMQLYRNVVPLPLQSSADRDVALEQAEELLLSQGVVQRGDFIVLTIGEPMGQPGGTNTLKIVRVGTR

SEQ ID NO: 12913 - protein, 327 aa, Prosthecochloris aestuarii DSM 271
MNDSTIRILHCLRDADGFVSGETICREFGMTRSAVWKHISKLRALGYGIDALTGRGYRLSAMPGLPVGPEVEPLLDTSRVGRELFFYPIAVSTNALAKSFARNGAGEGAVVTADAQSGGRGRMQRVWSSPAGVNLYFSVILRPSVSPLRLPQIPLLVAAALHRALSFSVPGLQVLIKWPNDMLVNGRKICGILCEMESEADMAHFVIAGIGINVNLRELPHEIRGIATSLFLETGEEYSRSALLASFFNAFEPIYDAWLEEEDLGQVLECLDEYSYLKGRLVEVEQFNRRLRGRAAGISRTGELLLDLDNGERRVISSGEAHLFIEH

SEQ ID NO: 12914 - protein, 494 aa, Glycine max
  misc_feature (384)..(384): Xaa can be any naturally occurring amino acid
  misc_feature (403)..(403): Xaa can be any naturally occurring amino acid
  misc_feature (417)..(417): Xaa can be any naturally occurring amino acid
  unsure (1)..(494): unsure at all Xaa locations
MASDADMEDYGFEYSDEEQEEQDVDIENQYYNSKGMVESDPEGALAGFAQVVQMEQEKAEWGFKALKQTVKLHYRLGRHKEMMKAYREMLTYIKSAVTRNYSEKCINSIMDYVSGSASQNFGLLQEFYQTTLRSLEEAKNERLWFKTNLKLCKIYFDIGEYGRMSKILKELHKSCQKEDGTDDHKKGTQLLEVYAVEIQMYTETKNNKKLKQLYQKALTIKSAIPHPRIMGIIHECGGKMHMAERQWADAATDFFDAFKNYDEAGSQRRIQCLKYLVLANMLMESEVNPFDGQEAKPYKNDPEILVMTNLIAAYQRNEISEFEKILKSNRRTIMDDPFIRNYIEDLLKNIRTQVLLKLIKPYTRIRIPFISKVIMFPLPSNKLXNTQEKIVELKLMLLFHLIXDLFVKLNRYLWLIXTLYTTKKKKKELNVPEHDVEQLLVSLILDNRIQGHIDQVNRLLERSDRSKGMKKYTAVDKWNTQLKSLYQTISNRVG

SEQ ID NO: 12915 - protein, 131 aa, Morus alba
IYRVLKPGQYFAAYEWCMTNSFDPNNQEHQKIKAEIEIGDGLPDIRLTGKCLEALKQAGFEVIWEKDLAAGSPVPWYLPLDKSHFSLSSFRLTAVGRFITKNMVKALEAIGLAPKGSQRVQDFLEKAAEGL

SEQ ID NO: 12916 - protein, 506 aa, Cytophaga hutchinsonii ATCC 33406
MNKKVILMILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 12917 - protein, 180 aa, Carica papaya
FGSVYRGQLPNGQKIAVKRLSVGSGQGDLEFKNEVLLVAKLQHRNLVRLLGFCLERSERILIYEFMPNASLDYFLFHPTKRERLDWDNRYKIIGGIARGLLYLHEDSRLRIIHRDLKASNVLLDAEMLPKIADFGMARMSELDETQGNTSRIVGTYGYMAPEYAMHGQFSVKSDIYSYGI

SEQ ID NO: 12918 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 12919 - protein, 395 aa, Clostridium acetobutylicum ATCC 824
MNFSNRVHNMDFSPIRKLVPLSKAAEDRGIKVYHLNIGQPDVKTPDTFFQGITNYNEKIVKYSDSQGIDTLIDSFIRSLSDSNIYFEKDEIMITHGGSEAIQFAIMATCDPGDEILSPEPFYSNYNSFAKVSGAKIVPFETKIEDNFHLPKKEEIIAKITDKTKCIMLSNPCNPTGTVYSYEEMRMLGEIAKEYNLFIISDEVYRQFIFDNVPYTSSIHLTDILDRVILVDSISKHYSACGARIGLVASKNKDLMHQILKLCQARLCVSTIEQYAAANLINTMGSYITDVKMAYKKRRDIMYSGLSSIPGVICSKPEGAFYILAKLPVDDSDAFAKWLLTDFSYNNETVMFAPASGFYATLGLGKSEARFSYCTSIEDIENSIVILKKALEEYNK

SEQ ID NO: 12920 - protein, 237 aa, Prochlorococcus marinus str. MIT 9312
MNSQTQMKQIVAEAAIEEVKSDMILGLGSGSTAVLMIKSLADAIRSGKLQNIKGVATSFQSEVLALELDIPLIDLASVSQIDLAIDGADEVDPGFQLIKGGGACHVREKLVASKANQLLIVVDETKLVRKLNQSFPLPVEVLPNAWKQVQEVISEMNGISTLRMATKKAGPVVTDQGNLILDVLFNDGIKNPKDIEKSINNIPGVLENGLFIDLTDKVLVGKIENNIPVAYSPAKVG

SEQ ID NO: 12921 - protein, 253 aa, Glycine max
  misc_feature (235)..(235): Xaa can be any naturally occurring amino acid
  unsure (1)..(253): unsure at all Xaa locations
MSATFKYQPTGLHGWGAPRSSSRNLARFFSMRFACNSRHHKILHASVSHPSSLSISHDSSTETESTLILIRHGESLWNEKNLFTGCCDVPLTKRGVEEAIEAGKRISYIPVDMIFTSALIRAQMTAMLAMTQHHQEKVPIIIHNESERATAWTQVYSEKTTKQSIPVITAWQLNERMYGELQGLNKQETAERYGKEKVHEWRRSFDIPPPKGESLEMCSQRAVAYFKDFIEPQLXSGKHVMGAAHGNSLRAII

SEQ ID NO: 12922 - protein, 535 aa, Kluyveromyces lactis NRRL Y-1140
MEDTHLIEGSKAPLYIIESERDSTEDLSKNVSSLISDNEVPQGRHLGIFSTVILFVSRIVGGGIYSVPSSVFVNCGGNVSLFLFVWLCAAVMAFIGMSMFLELGTILPKSGGRKNFLEFLYDKPPMMTTVILCTYCLMTCFAMSPAMILGKYILYALGYGEDFVNKESYASNYIGIAAIMVIVFVHGLSLNHGLIIQNILGIIKLVIVLLMSLAGMYVTLFYHNASYDITQPSLLFSAAVQSSEAISSASLTSAFIQCFYCFAGWDTVHTVTSEIKDPNRTLKLAGPLSLLMALICYLSLNIAYIKVLTYEEIKNAGPLLGSVLFSKIFGKAVGAQFINISIILSAISNLFVTVYGISRMNQEIFREGLFPFSAQLARNWPCNSPLPSLLICGIVSSFWLYLLPGTGAAFDYLINFEGYGNQIMLLLVAAGLLVRRERLKRYQFPSRTPIVGVVAFLLLSVYLSVGPFFGNGTGNSVGKFPSYQYAAIFLFALSVGFWFMKFVLLPRLFKYTLRSTVVVQNDGLTVVDWRRHPVE

SEQ ID NO: 12923 - protein, 273 aa, Corynebacterium efficiens YS-314
MEGMTIIAVIGGGQIGEALVSGLVAADVNPQNIRVTNRREERGAELEERYGVVTMTDNAQAVDGADVVFLCVKPKMILDVLAEIATTVDNNSVSTVVVSMAAGINLASMEEKVSAGMPIVRVMPNTPMLVRKGMCTVTGGRFVDAEQLELVQELLTSVGDVMVVEESDLDAVTALSGSSPAYLFLVTEALIDAGVSLGLTRAAAKQLAVSAFDGAGTMLKETGREPSDLRAGVSSPAGTTVAALRELEESGIRGAFFRAAQACADRSAEMGRN

SEQ ID NO: 12924 - protein, 184 aa, Glycine max
  misc_feature (160)..(160): Xaa can be any naturally occurring amino acid
  unsure (1)..(184): unsure at all Xaa locations
LIKPSFYYHPAIYLICVLLCYQSQLSEFRSYEGQDMYAGEKIVPIKLDLRVNHTLVKDQFLWDLNNFESDPEEFARIFCKDTGIEDPEVGPAIAFAIREQLYEIAIQSVVSARESRMSKKGRRGAEYTPVSKGGAAAVDLVKLFGPKSSVVRKRKEWDVXEPIVDLLSNEEVDALEAKEERNFR

SEQ ID NO: 12925 - protein, 218 aa, Oryza sativa (japonica cultivar-group)
MAAAARATARVGLALLLAVVGVGAQDYDFFFLVLQWPGSYCDTKQSCCYPRSGKPAADFGIHGLWPNRDDGSYPQNCDPDSEFDPSKVSDLLGSMRSEWPTLACPSNDGIRFWAHEWEKHGTCAAAALGDEHGYFEAALRLRSRLPVLAALRDGGVSPDGGYYTLSQIKGAIQRGVGAEPFVECNRDESGNSQLYQLYFCVDAAGERFVDCPASPGGR

SEQ ID NO: 12926 - protein, 389 aa, Thermoplasma volcanium GSS1
MKYYRFGKPEGRFVGNTEKYSVYEHILSDQRREIPSESYRNLPGEFTFNYGPATGGLIESVAFDFHTPGELIKHVDVYPYIKTRKIKVRGLSPEDALLLVERINGFHAASHAVAFEMAVEDALNIDVPEEVQYSRIIMLELERMRSNLEVVKRLCEPAGFGVPQNQIAYLRENIARIITSFAGHRYFFSSSYVGGCQFNGLVLESVIEDVKEEFEGIFNDLLQSKIFLNRLQNNGKISSSDMLGPAARAAGIEVDARIDEKRLPYSKLGFKPIVFDEPDAFGRFYVRSKEILSSADLISKAIRFSGNSPPAKIEKTNGEGAARVESPQGDLFYYVKINDGKISDVQISSPSLLNIEAFKKSMIGNIFTDYHFNWESFGIWVSELAVVIQ

SEQ ID NO: 12927 - protein, 856 aa, Arabidopsis thaliana
MMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 12928 - protein, 240 aa, Streptomyces tubercidicus
MTATAKISLITGANKGIGFQAARRLGAQGAVVLLGTRDPARGEAAAKALREEGADAHAVHLDVTDAATIAAAAQHIGERYGRLDILINNAGINVEWPAGAPSEVSRDALWATLETNVFGLVEVTNALLPLIRRSAAGRIVNVSSEMGMPSWLAGSEMPAMTAYSVSKAAVNMLTVLYANELRGTAVKVNACSPGFVATDINRGVGERTAEEGAEIEVRLATLAADGPTGRFFNDGGPVEW

SEQ ID NO: 12929 - protein, 442 aa, Bacillus licheniformis ATCC 14580
MNAEANGLKKEIGLLFALSLVIGTIIGSGVFMKPGSVLSYSGNAQIALFAWLLGGILTLAGGLTIAELGAQIPKTGGLYTYLEEIYGEFWGFLCGWVQIIIYGPAIIGALGLYFGSLVANLFSWDKSWTALIGIITVAFLCIVNIVGTKYGGAVQTITTIGKLIPIVCIIVFGLWQGDEYIFSSVTESIASQNFGAAVLATLFAYDGWILLAALGGEMKNPEKVLPKAMTGGILIVTACYLFINLALLHILPADQIVKLGENATSTAATMLFGPLGGKLISIGIIVSIFGCLNGKVLSFPRVIFAMAEKKQLPFSRWISHVHPAFHTPWIAVIVQMIIAVILMIISNPEKLSEVSIFMIYIFYVMAFFAVFILRRRKNGQGRSYSVPLYPYLPVAAILGSLFVLVSTLITDFYSCLWSILIGLVGLPVYFWMKKRNKNGSAA

SEQ ID NO: 12930 - protein, 326 aa, Mycobacterium bovis AF2122/97
MTPRPRALVTAPLRGPGFAQLRRLADVVYDPWIDQRPLRIYSAEQLADRITAVAADVLVVESDSVGGPVFERGLRVVAATRGDPSNVDIPGATAAGIPVLHTPARNADAVAEMTVALLLAVARHLIPADADVRSGNIFRDGTIPYQRFRGAEIAGLTAGLVGLGAVGRAVRWRLSGLGLRVIAHDPYRDDAGHSLDELLAEADIVSMHAAVTDDTIGMIGAQQFAAMRDGAVFLNTARSQLHDTDALVDALRGGKLAAAGLDHFTGEWLPTDHPLVSMPNVVLTPHIGGATWNTEARQARMVADDLGALLSGNRPAHVVNPEVLGS

SEQ ID NO: 12931 - protein, 616 aa, Candida albicans
ARASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYSSVQKLMIWSAGVILGMSCCVVDYHSMTSSIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHRLVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRLRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 12932 - protein, 806 aa, Arabidopsis thaliana
MGKKRIVFFAYLPFFTIFMSFSFAGITKESPFSIGQTLSSSNGVYELGFFSLNNSQNQYLGIWFKSIIPQVVVWVANREKPVTDSAANLGISSNGSLLLSNGKHGVVWSTGDIFASNGSRAELTDHGNLVFIDKVSGRTLWQSFEHLGNTLLPTSIMMYNLVAGEKRGLTAWKSYTDPSPGEFVALITPQVPSQGIIMRGSTRYYRTGPWAKTRFTGSPQMDESYTSPFILTQDVNGSGYFSFVERGKPSRMILTSEGTMKVLVHNGMDWESTYEGPANSCDIYGVCGPFGLCVVSIPPKCKCFKGFVPKFAKEWKKGNWTSGCVRRTELHCQGNSSGKDANVFYTVPNIKPPDFYEYANSQNAEECHQNCLHNCSCLAFSYIPGIGCLMWSKDLMDTRQFSAAGELLSIRLARSELDVNKRKMTIVASTVSLTLFVIFGFAAFGFWRCRVEHNAHISNDAWRNFLQSQDVPGLEFFEMNAIQTATNNFSLSNKLGPGGFGSVYKARNGKLQDGREIAVKRLSSSSGQGKQEFMNEIVLISKLQHRNLVRVLGCCVEGTEKLLIYGFLKNKSLDTFVFDARKKLELDWPKRFEIIEGIARGLLYLHRDSRLRVIHRDLKVSNILLDEKMNPKISDFGLARMFQGTQYQEKTRRVVGTLGYMSPEYAWTGVFSEKSDIYSFGVLLLEIISGKKISSFSYGEEGKALLAYAWECWCETREVNFLDQALADSSHPSEVGRCVQIGLLCVQHEPADRPNTLELLSMLTTTSDLPLPKKPTFVVHTRKDESPSNDSMITVNEMTESVIQGR

SEQ ID NO: 12933 - protein, 127 aa, Brassica napus
MKKVTTATTKRAAKDQWVAAAMTDDQMVVELLIRLKHAGTTVSENPSTNLPPLQWGIRRRRSRPSRFGGGGGGGVLVTLKKDVDSARGSPHQFHRLQTTKLHRCLIRGWKTFHKIISTHFHFPFCLV

SEQ ID NO: 12934 - protein, 228 aa, Pyrus x bretschneideri
MGITRMIYMVTMVFSLLVSILSSSAVGFDYFQFTQQYQPAACNSNPTPCKDPPDKLFTVHGLWPSNWNLPDPIFCKNTTITPQQIGHIEAQLEIIWPNVFNRANHLVFWNKQWNKHGSCGYTTINDEIQYFETVIKMYITKKQNVSKILSKAKIKPEGKNRTRAEIINAISISTNNMTPKLKCQKNNGTIELVEVTLCNDHNITKFINCRHPYDPQSQFFCPKINILY

SEQ ID NO: 12935 - protein, 526 aa, Dehalococcoides sp. CBDB1
MKIPELHNYLAEFLSPAINPLKLEKGANKDYYLWLDWTEAAALYPKLAEDGFGLIGLFGVEGFRGYQGLSLLYIFEKRNYSGTLVIIRRADSPVSSIAAIFPSACYFEREIRDGYGCEFENAFDRRRLFLHETYPANFHPLANSFKNQPLSLPAGVENEALYPFKKISGEGVYEVGVGPVHAGIIEPGHFRFSAIGEPILNLEVRLFYTHRGLEKLAMGKDIDFGLKIAEGISGDESAANTYAYSSAVEHICSSRPPRRAEQLRLILLEMERLYSHLADLSGMLTDVGYPVGAASLSALREELMRWNKRLTGSRFLKGIIAPGGLLKDIPGELITELADYLYAFEGRFSEQVEKALAKTSVVDRFETTGIVNNRLLIPLNITGVTARASGEAIDTRLNQPYGFYPELSFKLPVLPEGDVMARFRVRLSEVQTSLGLILKTAAKLSAGEYAIPLKPVNGYSLVLVESPRGQSLHWLWLRDGKIERYKVRTASYCNWQAIEHAVLGDIIPDFPLINKSLNLSYAGTDL

SEQ ID NO: 12936 - protein, 235 aa, Lactobacillus sakei subsp. sakei 23K
MANLVIVRHGESVANQLKTYTGWSDVALTAKGRQQAHQVGRQIKDAGFQFSHVHTSLLKRAILTSYIVLEELDQLALPMTKSWRLNERHYGALRGLNKDTTRTIFGVHQVARWRRSYTALPPLLIRSSTARRYRLVPRKSRPRGESLAQATQRLLPYWQDQVVPGLLAGQDQLIVAHGSTLRALIKVIEQISDQAIDGVEVANGEALYYQFGTDLTVLKKGRLALGSETDEEKEN

SEQ ID NO: 12937 - protein, 682 aa, Eremothecium gossypii
MYRVVIPLLLEPVSCPPVSFRCRKRSVAAAWPFPCRWHEALLNFCVKTTVYTGEEININNQRTTAGNTMEPLIEIRSRLRKSSQDLLQLKLYQSARWSSEALIGMCEGGVEDTTADEGSPLRNRRGKGDTGIQVSMDSEPFGERQYDLFLLASSLFDCKEYDRCAYFLRNEKHPRLKFLRLYSRFMSWDKKTQESSSDVLTKPADIAQKDPGVGTNVVDWIDERNVDTRKEANIQSQMVVDLGTGEKISITLILRELELYLVEQLANSKEPADVGYALLYYLRGILEKKQGLASEAIKSFVRSLELYPYNWTCWCELATCITRTDESLLLVKHLRDLFPANGERGDNAVMLRFFKISIFKDFGGDFDHFMDELDYLMGLFPNFSFLKSELALLNYHYMDYVNAELIFDEIVKLDPYRLDDLDIYSNILYVIQKPHKLAYLSQFAADLDAYRPETCCIIANYFSAKQQHEKAIMYFRRALTLNKTCTNAWTLMGHEFVEMKNSHAAIECYRRAVDINPCDFKAWYGLGQAYEVLDRHLYALYYLQKACSLKPLDKRMWQALANCYDKLDRPNQAIKCFQRASQLSNDQDITILYYLATLYERVQDAISCKNYMLKCIEVESANQGIILDECAKARLWLARHEVKHRNFTAAYNYASGVTHGTSQEIEAAIVIARECRKRMEYQ

SEQ ID NO: 12938 - protein, 218 aa, Vibrio vulnificus
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 12939 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 12940 - protein, 251 aa, Ashbya gossypii ATCC 10895
MSLSREDSVYLAKLAEQAERYEEMVENMKAVASSGQELSVEERNLLSVAYKNVIGARRASWRIVSSIEQKEEAKEKSEYQVKLIRTYRSKIESELTKICDDILSVLDTHLIPSATTGESKVFYYKMKGDYHRYLAEFSSGDVREKATTSSLEAYKSASDIATTELPPTHPIRLGLALNFSVFYYEIQNSPDKACHLAKQAFDDAIAELDTLSEESYKDSTLIMQLLRDNLTLWTSDMSEAGQEEQPADAHE

SEQ ID NO: 12941 - protein, 89 aa, Arabidopsis thaliana
GNPGRTTPVRAVVVPSPVKATMVVQFTGWRESVEFPATRRTNKAIISIEGNGGGVSCMKGWPPMGKKKLGTLFYLPDLSAVELVKEVDY

SEQ ID NO: 12942 - protein, 506 aa, Wolbachia endosymbiont of Drosophila ananassae
MGIKSVVLCILDGWGNGVENSKYNAISNANPPCWQYISSNYPKCSLSACGTDVGLPGGQIGNSEVGHMNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 12943 - protein, 173 aa, Medicago truncatula
MVGVISLITGMAGPSGFGSASTAEQVTQGIDASNLTAIITGGASGIGLETTRVLALRKVHVIIAARNIESAEEAKQQITQENKSARVDIMKLDLCSTKSVRSFVDNFIALDLPLNILINNAGIMFCPFKISEEGIEMQFATNHLGNVSFIIHDIIVLKMFYGHPLFHTFAASS

SEQ ID NO: 12944 - protein, 223 aa, Streptococcus agalactiae NEM316
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNSMVNKVIVAGKNGLDILEK

SEQ ID NO: 12945 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISEPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYEEIKKAIKEESEGKLKGILGYTEDDVVSTDFVGDNRSSIFDAKAGIALSDKFVKLVSWYDNEWGYSSRVVDLIVHMSKA

SEQ ID NO: 12946 - protein, 1008 aa, Glycine max
MRVLVLFFLFLHSLQAARISEYRALLSFKASSLTDDPTHALSSWNSSTPFCSWFGLTCDSRRHVTSLNLTSLSLSGTLSDDLSHLPFLSHLSLADNKFSGPIPASFSALSALRFLNLSNNVFNATFPSQLNRLANLEVLDLYNNNMTGELPLSVAAMPLLRHLHLGGNFFSGQIPPEYGTWQHLQYLALSGNELAGTIAPELGNLSSLRELYIGYYNTYSGGIPPEIGNLSNLVRLDAAYCGLSGEIPAELGKLQNLDTLFLQVNALSGSLTPELGSLKSLKSMDLSNNMLSGEVPASFAELKNLTLLNLFRNKLHGAIPEFVGELPALEVLQLWENNFTGSIPQNLGNNGRLTLVDLSSNKITGTLPPNMCYGNRLQTLITLGNYLFGPIPDSLGKCKSLNRIRMGENFLNGSIPKGLFGLPKLTQVELQDNLLTGQFPEDGSIATDLGQISLSNNQLSGSLPSTIGNFTSMQKLLLNGNEFTGRIPPQIGMLQQLSKIDFSHNKFSGPIAPEISKCKLLTFIDLSGNELSGEIPNKITSMRILNYLNLSRNHLDGSIPGNIASMQSLTSVDFSYNNFSGLVPGTGQFGYFNYTSFLGNPELCGPYLGPCKDGVANGPRQPHVKGPFSSSLKLLLVIGLLVCSILFAVAAIFKARALKKASEARAWKLTAFQRLDFTVDDVLDCLKEDNIIGKGGAGIVYKGAMPNGGNVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDSRLPSVPLHEVMHVFYVAMLCVEEQAVERPTMREVVQILTELPKPPSSKHAITESSLSSSNSLGSPTTASKEPKDNQHPPQSPPPDLLSI

SEQ ID NO: 12947 - protein, 168 aa, Medicago truncatula
MKQTAKTTGIEGRIINLSSIAHRYTYFRKGIKFEKINDKKGYSSKKAYGQSKLANILHANELSRRLQEEGVNITVNSVHPGVIMTPLMRYSSYTMHLLKIFSFYIWKNVPQGAATTCYVALHPSVKGVTGKYFVDCNEFKPSAYAKNKLLAKKLWDFSNKLINSISKA

SEQ ID NO: 12948 - protein, 294 aa, Zea mays
MPGGEDVRKVSRQDIQLVQNLIERCLQLYMNQKEVVDTLSFQAKIEPSFTELVWQKLEEENRDFFKAYYVRLMLMNQITAFNKLLEQQYEIMTKDHPSGMPSVPSTAPNGSNSNMLNQAVPFLPDTIPSTAMQDNLWSNGSSSSIVNGAPSDDQCGYSGKVAHGLPGVMDASSSLLAAHKSTVGQFNGHDGTTTKTESDYSSNSDFGFGNETVFLEQSVGDISGGSFSSSELNGQPVGSSSYGFLSQIPCNFSLSDWTDCFSQSSEIFENYGGSPFIPSDANNIPESSARENTG

SEQ ID NO: 12949 - protein, 284 aa, Symbiobacterium thermophilum IAM 14863
MERMLTGNVGFLGAGAIAEALIRGMLNAGVVQPEQVLVSNRSDRERLADLNRRYGVRTAGSKGYVVDVCQVVVLACKPKDVAGLLAEVGGRFRPGQIVLSLAAGIATSFIEERVADGVMVVRAMPNTSCQVGESATAVCLGRAATPEAMRLVTEMLASVGQVYTVPEEQMDAVTGLSGSGPAYVYYIVEAMIEAGEAVGLAPEVARALTLQTLKGAALTLATTGADPAVLREQVTSPGGTTAAGLQVLREAGFAQALISAIVRATERSRELGRMPAQAATEVGD

SEQ ID NO: 12950 - protein, 101 aa, Oryza sativa
  misc_feature (88)..(88): Xaa can be any naturally occurring amino acid
  misc_feature (94)..(94): Xaa can be any naturally occurring amino acid
  unsure (1)..(101): unsure at all Xaa locations
ELPLMVTTKENEEKLRTAFTVSVDAKEGTTTGVSAKDRANTVLALASPNSKPEDFNRPGHIFPLKYREGGVLKRAGHTEASVDLAMLXGTPAAXPCEIVDV

SEQ ID NO: 12951 - protein, 275 aa, Xerophyta humilis
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 12952 - protein, 329 aa, Glycine max
KNNYWMELARPASSRRKLKDLLHQSGNRLCADCNAPDPKWASANIGVFICLKCCGVHRSLGTHISKVLSVTLDDWSEDEIDAMIEVGGNVSANSIYEAYIPEGYTKPGPDAGHEQRSKFIRSKYELQEFLKPSLRIVSGKSSLQSSSAKSSFMDSFKSTSSSQRMEGMVEFIGMLKVKVIKGTNLAIRDIKSSDPYVVLSLGQQTVQTTIIRSNLNPVWNEEYMLSVPEHYGQIKLKVFDHDTFSADDIMGEADIDLQSLITSAMAFGDAGMFGDMQIGKWLKSDDNALIEDSTVNIVDGKVKQMMSLKLQDVESGELDLELEWIPLEQ

SEQ ID NO: 12953 - protein, 937 aa, Oryza sativa
MATASAPLQLATASRPLPVGVGCGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 12954 - protein, 620 aa, Shigella flexneri 2a str. 301
MDSHTLVQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 12955 - protein, 702 aa, Oryza sativa (japonica cultivar-group)
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALAQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSCKSAKNYDSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 12956 - protein, 1038 aa, Arabidopsis thaliana
  misc_feature (509)..(509): Xaa can be any naturally occurring amino acid
  unsure (1)..(1038): unsure at all Xaa locations
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFXASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 12957 - protein, 227 aa, Glycine max
MEAVCGSGSSVWVTSSLTRSPKITLPLFRASYQHLTAFPSQSLLFSYHPSRYANARTLRARTSSKPIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCDWTPVQSPWLRE

SEQ ID NO: 12958 - protein, 227 aa, Streptococcus pneumoniae R6
MENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 12959 - protein, 334 aa, Erythrobacter sp. NAP1
MSKQALPKPFLPLIGERTLFQQSIDRVSGRPNFAKPTVVAGEAHHGLIADQASGDIRIVIEPCARNTAAAIAIAAHSLSPDDIMLVCPSDHHISDESTFHSAAMAAARLASQDWLVSLAIEPTGPATGYGYLQTGEALGGGNRIGRFVEKPDLETAKRFLASGNYSWNAGIFAFRAGFLLDELNSHRPEMAALVAESFRKGQKTDTTFRPAPSPFEQIAGESIDYAVMENTSRAAMVAADMGWSDIGDWDSLAKAICEDAGRANEDGNVAKGRADFLDSEGVLTFSDGPRVSVVGLENICVVVDGDEVLVTSRDQAQLVGKLPGASSKGGAKCR

SEQ ID NO: 12960 - protein, 351 aa, Triticum aestivum
MQGGSSGIVYGGLKYQARCITDVRADAGSTTFLAGTLSLKEENEVHLIRLLPGENELVCDGLFYHPNEIWDLKSCPFDHRLFSTVYTSGEGYGASVWKIPELYGQSNSPQLEQLFTLDDHTDKIRCVLWWPLGKHDKLISIDDRNIFLWNIDPSNKSAKVISQGSADMLPNLRGGAWDPHNHNAVATITDSSLHFWDLRSMKRSNAIEHAHIRDVDYNPKKQNIIATAEDEFGIRLWDLRMLKHPLKDLPGHSHWTWAVRHNPEYDELILSAGTDSAVNLWLAKVGTDDSGPESPSGSPTRQEEPLLHSYTDYEDSIYGIAWSSHDPSLFASLSYDGRVVLESVKPHLQRK

SEQ ID NO: 12961 - protein, 175 aa, Triticum aestivum
MAPTVMASSATSVAPFQGLKSTAGLPVSRRSNGASLGSVSNGGRIRCMQVWPIEGIKKFESLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 12962 - protein, 311 aa, Prochlorococcus marinus str. MIT 9312
MVELFLPFFLLVLFLLALFFVWRINPRKYISSGTVASAYDAWTQDKLLERLWGEHIHLGFYPSDGKNIDFRKAKVQFVHELVKWSGLDKLPKGSRILDVGCGIGGSSRILAKYYGFNVTGITISPAQVKRAKELTPLGLNCNFQVMDALNLKFKDGSFDAVWSVEAGAHMNDKTKFADEMLRTLRPGGYLALADWNSRDLRSYPPSFFEKLVLKQLLDQWVHPDFISINEFANILSTNKNSAGRVVSENWNFYTNPSWYDSIIEGIRRPSAILTLGPLAIVKSIREIPTILLMNWAFRKGLMEFGVYKCRG

SEQ ID NO: 12963 - protein, 449 aa, Bacillus clausii KSM-K16
MPKFTKEDIVRQAQDNNVRFIRLQFTDLLGTIKNVEIPVDQLSKALDNKMMFDGSSIEGFVRIEESDMYLYPDLDTWVVFPWTPEKGKVARLICDIYQPGKPGEEPKPFEGDPRGILKRVLKEAQELGFTDFNIGPEPEFFLFKNDEKGEPTLELNDRGGYFDLAPTDLGENCRRDIVLELEDMGFEIEASHHEVAPGQHEIDFKYADAVSTCDNIQTFKLVVKTIARKHGLHATFMPKPLFGVNGSGMHLNMSLFTQEGNAFYDKNTESQLSKTAMQFLGGILKHAEGFTAITNPIVNSYKRLVPGYEAPVYIAWSMRNRSPLVRIPSSRGVSTRIEVRSPDPSANPYLAMAVMLASGLDGIKKKINPPEATDRNIYIMSKEERLDEGIKDLPSTLKEAIDSLLKDEVLVKALGEHALEHFVEAKEIEWDMFRTQVHPWEREQFMQNY

SEQ ID NO: 12964 - protein, 253 aa, Glycine max
MASSPTFALRTISSFSVKPVTTTRSSLTTSSTTTLLPFTSTNSSLPRTLKLNTSSPHPHLSLPHKSFTCRSQAEPSSDSAKVQELSVYEINERDRGSPAYLRLSQKTVNSLGDLVPFSNKLYSGCLQKRVGITAGICVLIQNKAEKKGDRYEAIYSFYFGDYGHISVQGSYLTYEDTYLAVTGGSGIFEGAYGQVKLHQIVFPFKLFYTFYLKGIKDLPQELLSQPVEPSPAIEPSPSAKACEPHAVIAGFTD

SEQ ID NO: 12965 - protein, 148 aa, Nicotiana tabacum
MEQTFIMIKPDGVQRGLVGEIIGRFEKKGFSLKGLKLITVDRAFAEKHYSDLSAKPFFNGLVDYIISGPVVAMVWEGKGVVTTGRKIIGATNPLESAPGTIRGDYAIDIGRNVIHGSDAVESARKEIALWFPEGVAEWQSSLHSWIYE

SEQ ID NO: 12966 - protein, 324 aa, Magnaporthe grisea
MASPTMKLNNGLDMPQVGFGLWKVENSVCADVVYNAIKAGYRLFDGACDYGNEVECGQGVKRAIDEGLVKREELFIVSKLWNTFHDGERVEPIVKKQLADWGIEYFDLYLIHFPVALEYVDPSVRYPPGWHYDDAGTEIRPSKASIQETWTAMEKLVDAGLSKAIGVSNFQAQLLYDMLRYARIRPATLQIEHHPYLVQQRLIEACKTEGIVVTAYSSFGPASFKEFNMEHAEALTPLLEEPTIVKLAEKYGKDPGQVLLRWATQRGLAVIPKSSREKTMKSNFEAVGWDMEDSDIKTISALDKGIRFNQPANYFSTDKLWIFG

SEQ ID NO: 12967 - protein, 276 aa, Silicibacter pomeroyi DSS-3
MPSLAFALVMALPVAAETKAEADTVVARVNGEEITLGHMIIARASLPQQYQQLPDDVLFDGILDQLVQQTLLKQQQKGETPKQIVLSLENEERSLLAGETIEEIMAVATTETAIQAAYDAQYADGFGGEEYNASHILVPSEDEAKAVKELLDNGADFAATAKEKSTGPSGPNGGALGWFGAGAMVPEFEQAVVALNAGQVSDPVQTQFGWHVIILNDKRKSEAPALDEVRDELAGRIQQDAIEARLAELTKDSEIEKPELTGVEPAVLRQLELVRE

SEQ ID NO: 12968 - protein, 785 aa, Arabidopsis thaliana
MLTRVWKDPWIPTILARPAKSILNIRDSLLYVNDLIDQNTNLWKLDRLQALIDPVDIPLILGIRPSRTYLSDGFSWSHTKSGNYTVKSGYWVARDLSRPTCDPPFQGPATCQRLTYRHMGTDKGCPRCEEVEETINHLLFHCPPSRQIWALSPIPTSGNIFPRNSLFYNFDFLFWRDREFGIGEKNFREPPPETLVLALQETAVWKQATLKEDDSTRPIVFVGSSQTPSTLLPECQLDASWHVDDTLSGHGWAMECMISIGDTSGTFASDCSDLIAILDNQDDWLTFAAELASYLSSKLVVSLFKTPVKMASLTLRCDSTHLLPSRDVVKGTKPFGTSLVYPRIISKKFNVRMRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 12969 - protein, 231 aa, Kineococcus radiotolerans SRS30216
MTTTFITGANKSLGYETARRLVEAGHTVLLGARDPGRGRAAADALGVRFVQIDVTDDASVEAAAADVAAHEGAIDVLVNNAGVVGPHAAADELTAADALAVYDVNVFGVVRVTRAFLPLLRKSANPVVVNVTSGMGSFAATHDPDRVESTFAAPLYTSSKAALTMLTTQYAKALPDVKFNAVDPGYTATDFNGHSGPQTVTEGTDAIVELATIGADGPTGQFRDRHGVVAW

SEQ ID NO: 12970 - protein, 274 aa, Oenococcus oeni
MIENEKQLKRNFGFFGTLSLVIGTVIGSGIFFKQGRVLQEAGSAKMALLAWVVGGVLTLSSAMSVAELGSEMPQTGGIYIYISKIFGKFWGFLAGWMQISFYGPALIASVSYFFSTLFVTFFKLPTKITFFSFSMRSVVAVSILACILIALMNMLENRVSRTFAITTTVIKMIPIFALILFGLFFGKTGATGSAISVLSEQVDKGNFGVAVLSTLFAYDGWVIISNLGGEIKNAQKNLPRAVTIGIFIVLLAYMGVSFGVFSSLPGKEIVSLGD

SEQ ID NO: 12971 - protein, 273 aa, Shigella flexneri 2a str. 301
MNNRVHQGHLARKRFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDIRVLSRITTEAFNQRRKTIRNSLGNLFSVEVLTGMGIDPAMRAENISVAQYCQMANYLAENAPLQES

SEQ ID NO: 12972 - protein, 263 aa, Corynebacterium diphtheriae
MTRPVRLQDLRDYKKNNRPWAMLTTYDYSTTRAFVDAGIEVFLVGDSAANTMLGYSGTNQVSFEEMVMLTAAVVRGAGPAMVVADLPFGTYEASDEQAVRSATEMVRRTGAHVVKLEGGVRMASRIRAITDAGVPVCAHLGFTPQSMNQLSGFKVQRGAEKLTADVDAVVEAGAEMVVFEMVPADLAAELTARCPIPVIGIGAGNATDAQVLVWHDIANLPKGDHRARFVKTYAEVGSQLTCAARFYRKDVEARRFPAEEHTF

SEQ ID NO: 12973 - protein, 277 aa, Magnetospirillum magnetotacticum MS-1
SERQPRSQGRLEALLNFQQVVEDLTGLDVANASLLDEATAVAEAVALMWRASRAKSGYVVLDADLFPQTLAVTLGRAQAVGLPVVVADLSGGLQAGLAAARAAGAFPTVLDDDAHLVGVVVQQSGASGRVVDWRPVVAEAKDAGALVTVASDLLALTLLVSPGELGADVAVGSAQRFGVPLFYGGPHAAFMAVRKGLERSLPGRLVGVSIDADGDTAYRLALQTREQHIRREKATSNICTAQALLAIVASMYAVYHGPDGLRAIAERTHAHATTLAE

SEQ ID NO: 12974 - protein, 225 aa, Archaeoglobus fulgidus
MDSSGKYNAAKLALELVKDGMVLGIGSGSTVEVFLNLLGDKIREEGLEIYGIPSSYQSYFAAIRNGVEIVDLVEFEPDLCIDGADQVDAKLNCIKGGGGAMTREKIVAKASRKVVIIVDESKLVEKLSMPVPVEVLPFAYGWVLREIEKMGCKARLREGKGKIGPVITDNGNFVVDCDFGVIEEDRVEGLEGEIKLISGVVENGIFSKELIDAVIAGSSRSARFL

SEQ ID NO: 12975 - protein, 102 aa, Brassica napus
  misc_feature (85)..(85): Xaa can be any naturally occurring amino acid
  unsure (1)..(102): unsure at all Xaa locations
AEKEDSEASEAYASKERPLFKAPSKLYPHGLKTLIEECWQDKPAKRPTFREIIKRLESILHHMGHKRQWRMRPLTCFQNLEHKKXHNWDMSSHDGSSSGSHL

SEQ ID NO: 12976 - protein, 643 aa, Oryza sativa (japonica cultivar-group)
MACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 12977 - protein, 652 aa, Methanopyrus kandleri AV19
MSERRGGEKTLEEVKKKVMERVEEVLPSDVVVTDVDFEGPEVVLYTNSPHSFVKDDSDLVTRLAKALRKRVKIRPNPAALSPAKEAKKVILKIIPEEAGVSERDLLFLDTGEVVIFSKKPGLVIGKRGKNVHRISRDTGWVPRIYRQPPIPSKTVNTTRRLILSDDSRRKFLRNVSARIFCGRTRSRGTESRWARVSALGGFQEVGRSSLFLHTEESRVLLDCGVNVAANGTDAYPHFNVPEFRMDDLDAIVITHAHLDHCGFLPYFYRHKVIESRVPVYCTPPTRDLMYLLLTDYIKVLEKRGQEPPYTEKDVKKVIKRTITIDYREPTDITPDMSITFYNAGHILGSASVHVFLQDKGHNFVYTGDINPTPSRLLEGADNRFKRVDSMVVEATYGDSRHGSRRKEENRFRKIVRDTLKKGGKVLIPSFAVGRAQEVMLVLEDMHRKDELEGPVYLDGMIYEATAIHTAYPEYLNRRLQHRILHEDDDPFTSEVFEPVEGSDHRQAIMEDDEPAVILSTSGMLEGGPILEYLRELSDDPKNTLIFVGYQAEGTLGRQIQEGAKEVPLPTPTGKTETLRIELRVETVSGFSGHGDKIELTKYVRSIRPSPPSKVFTNHGEPRACKYFSNHLRRTVRKVFSMAPENLECFRLT

SEQ ID NO: 12978 - protein, 210 aa, Arabidopsis thaliana
MGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 12979 - protein, 140 aa, Pinus pinaster
ELQDLQRDPPTSCSAGPVGEDLFHWQATIMGPTESPYAGGVFFVMIHFPPDYPFKPPKVNFQTKVYHPNINSNGSICLDILKEQWSPALTISKVLLSICSLLTDPNPDDPLVPEIAHIYKSQRSRYEETARAWTQKYAMN

SEQ ID NO: 12980 - protein, 406 aa, Yarrowia lipolytica CLIB122
MQFSLATIATVAAAVSALVCPYTKRDAVAAFTSPPLSSADHKSCPADTPVSCSSGAGSADLCCTESPGGVLVLTQFWDWTPAIGPDDLFTLHGLWPDNCDGSYAQFCDKSMEVQSVAAVLQQLGETELLDKMNKIWIPNRGSTDSFWTHEWNKHATCMSTLKDKCYSSDAPQYQSLADWAHTVVNVFETVNTYKFLEAAGITPDSSKTYAKTDFLNALNSNFDGKQVHISCKSGYISEVWYYFHLKGSVVSGQYLPIDDIGSSSCPDQIKFPPKDGSGGTPPPTDPSDPPTGGSKGFINISGQSGCLISNGNWYTSGTCATYTLGESQYGGVTLTSSKGPCDVVNGKFSCASGNNAGQFTQDGSNIVYGGKSDWSAPSVPSGSQQVGVSPGSAGGSVSFNLVFAAK

SEQ ID NO: 12981 - protein, 1459 aa, Penicillium chrysogenum
MDFEQYGQSSQQPRQRRRRAGKRRLNNKTPIAARLALDPQLRGKVGILSEDLANDLFQQQALQDVTTSDDGVLYVAIAPHTPTYTSVEDQAWTILPVRIQPTERSPVAMSHSTVLFPESADSLQPFLQALGKVDSSRNSLQAHRSVEIRILDVAPIHLDTIFVTVERHLLRNHDDVQTKFGGGFTNAQGPNGLWGKTGKSVEAKKYSKRAAADAEQRLTAAVREALGAQRIVHTGDVLPLPLPSHPITYAPPPPARISFCEPVSQGLLMSTTKIVLVQARPQGIRAQQTMPSRSALLKQVAEDEADDTSNEQFYSAAEDKPGESGTEMEVTSAAEESETEGSAGSMSDSSDDSLEDMISLSAPELPQPPSGVMSSLTSATPRAGGRRSDGIHTPGSVASNFTSATMRPGRGGGKTFKVEGLLQQVPNEVLHPRPRDDEDVDSFVFVDISTLAKIGCFSGDWVRIEAAEEPQLNMFASLKFGSFNDSPEDSGDWRPVKIFGLSGLPSSKPRYAINHSGERRPSISQRPPTRLTPSVFVPPLLLGNIENPKYLRISPMTFATPNGSSKPGILQHMKNTAAKNPPLAKEVTLLKVSTPLSMDRVLQPALFAGLKQYFESRRRILKSGDLVGISVDEGLGRAVFSGTGSGDSASQEEDITIRLGQGANATNAGTRKIGVAWFRVGQVAPTTVEELEETGEDQWGGVAVLDPATTRMVQAGSDVSRVPGVLGNGWEYWLGVKTIPKTVHDAPTPHGIVADPPQSVIPPLQQRIRDLMSAATSPRAIQLGMKPVFILLRSQQRHIGKATVATRACSDIGIHTFPIDAYDILTEGGANGGDVKTEAYLKARAERAFHCGANCTALLIRHIEVLTADRIVTAMSDILNDARVVIATTTDVETIPEGIRSLITHEFEMGAPEEKEREGILQNAVTERGIRLSADVDLGSIALKTAALVAGDLVDVVERAAGARTARLESLAEASKKISGSEVFVRDVLLAGGDGARGVTKADFDAAVEAARKNFADSIGAPKIPNVGWDDVGGLTNVKDALVETIQLPLERPELFAKGMKKRSGILFYGPPGTGKTLLAKAIATEFSLNFFSVKGPELLNMYIGESEANVRRVFQRARDARPCVVFFDELDSVAPKRGNQGDSGGVMDRIVSQLLAELDGMNGGEENSGGVFVIGATNRPDLLDTALLRPGRFDKMLYLGVSDTHRKQATILEALTRKFALHPDVSLDRVAEQLPLTYTGADLYALCSDAMLKAITRKATAVDEKINALPNGPVSTAWFFDHLATKEDVNVMVTEEDFLSAQGELVPSVSAKELEHFERIRQTFEAVDKSKQDPAAAAPQTIAEAMEAFSLGGSAIPEEAPTINGDSLTPGGIHGRIKGLNRWPGNPVRSTSGQSTTSSKGKGKSVSKKGKSRTGAESDGSVDGDDEDMADANSKEDEDEDDYVVRTDHLRNPMEEVE

SEQ ID NO: 12982 - protein, 261 aa, Maackia amurensis
MASSKERETFVYVAKLAEQAERYEEMVDSMKNVATLDVELTVEERNLLSVGYKNVIGARRASWRILSSIEQKEEAKGNEVNAKRIKEYRQKVESELTNICNDVMRVIDEHLIPSASAGESTVFYYKMKGDYYRYLAEFKTGNEKKEAGDQSMKAYESATAAAEAELPPTHPIRLGLALNFSVFYYEILNSPERACHLAKQAFDEAISELDTLNEESYKDSTLIMQLLRDNLTLWTSDIPEDGEDAQKANGTAKLGGGEDAE

SEQ ID NO: 12983 - protein, 154 aa, Ashbya gossypii ATCC 10895
MVPLPKRIIKETERLVSDPVPGISAEPHEDNLRYFDVSIEGPQQSPYEHGVFRLELFLPDEYPMEPPKVRFLTKIYHPNIDRLGRICLDVLKTNWSPALQIRTVLLSIQALLATPNPNDPLANDVAKDWIADEAAATAKAREWTALYAKPAAPQ

SEQ ID NO: 12984 - protein, 475 aa, Thermus thermophilus HB27
MEVKEAPTEALIGGAWRRLERRFPVVSPATGERVAEVADCGEEEAREALEEAVLAFPAWSRATAYERAQVLRRWYERILEHQEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYGEAAKTLKRVSLELGGGAPVLVFADADLDRAVEETLRAKFRNAGESCVAANRIFVQAEVAEAFAEAYARRVQALKVGDPLSEETDVGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSLGL

SEQ ID NO: 12985 - protein, 1085 aa, Frankia sp. EAN1pec
MECRTPAGRRRARGPRPAGAMPVNSPNAQRLPDADPVGRVQPQPVAGLGAEDVVELVEVAHDVGAQVRRAVRVGGQVLPLQLEPALGAPHVGPVHEQPTSVLPRRLAVLGDDVGLVGDGQAAEVADVLPDSERAVHLLARQVARLEPVVLLDQRLRLHLEGRLVGGRPPVVEVAGAVVLRALVVEAVTDLVADHRADAAVVLGRVAVRAEERLLENGGREADLVGARVVVGVDGLREHEPLVAVHRRADLGQLPVGLERGGCAGVAHQVAAADRQRRVVPEPVGVADLRPERLELLVRPLLGLLRHPVQLGDRRAVGREQVRDEVVHLRLGVRREVPGDVLPADRLPDRALDERHRALPAGPQLGRAAERAAVEVEVGLGEHVGQVGRGRAQHAADQPVAPHVDRRVGQHGRQVLEERRLPHARLRQRRVRAGQRPTETGDVGVPVERRAERGQLSARHQVVGLLDVAGLGPLPVALREQGFHVEDPLRGALGVGVPAQPEHPGQVVDVLLAGRGELVVVVVRLVRQAEAALAQVEQVAVRVAVVGVDVGAEQSGAADPLELAEERGEAADVAQPARAVQQRPHRAQAERLERLGVHEGVVEVADLPRVLALGGLVPRGEVGDDVADLPLGVIGQLHERAPARPVGRDLRLGEPPAVHVAEQVVLRSDVEVHALAGVVEDVHRTEVSNRLPPGHGATPSCPARPVHPLDGICPHVGIRSVRGHPLSITGGRRAARDQALSGLTNDTLWVSLWPGARSTPAARTRPHCSGPRCGTPPFACSATASGPADLMEMFLPPYADRPVAVVTGASSGIGRATARTLAEQGWQVIGVGRDPVRSAATEAEIAAAARKDGGFTMLRGDFTLMADVRRVAGEIQHLTPRLDILINNAGGVRDRQIISAEGTEATFAVNHLAPFLLTRELTPLLRASAASLPAGSTRVIAVSSSGHRAVDGLDWDDLQSLGEFRPAVAYCRAKLANILFTRELARRAGPDGIVAQAMHPGVVASNFSAHGDAAMRAHMAAADTVPPDEPAETLAWLATEPEGGRTGGRYFHRRAEELPAEAARDDAAAARLWTESERLLDGLGFR

SEQ ID NO: 12986 - protein, 450 aa, Lactobacillus sakei subsp. sakei 23K
MIDIKTQTPPQELNRTVGFTAALSTVMGTVIGAGVFFKASSVTEVTGSTGLTILAWLLGGIITICAGLTAAELAAAIPETGGMMRYIEKTYGSVAAFLLGWAQTTVYFPANIAALSIIFATQCLNLFGWAPSWQIPVAVIVATSLTIMNFFGSRVGGFVQSFTTVFKLIPLAIIIIFGLINPGTNASHVSLFTVAGTGTSNNVLSALGNGVLATLFAYDGWIHVGNIAGEMRHPEKDLPKSILLGLFGTMVVYLLVNAVFLLVLPISQIAGNENAAAEVAGHLFGGFGGKLVTIGILVSVYGAINGYTMTGMRVPYAMATEQHLPFSKQLSCLSKAGIPILCGILQLVIAIGMIFVGGFNTLTDMLIFVIWIFYVMTFAAVIILRKREPEMKRPYKAVLYPVVPLIAILGGTFIVINTLFTQTILALIGLGITLIGLPIYYYLEKKYHQD

SEQ ID NO: 12987 - protein, 157 aa, Triticum aestivum
  misc_feature (113)..(113): Xaa can be any naturally occurring amino acid
  unsure (1)..(157): unsure at all Xaa locations
MSSSEQTFIAIKPDGVQRGLVGPIISRFENRGFKLAAIKLVTPGKEHLEKHYADLAGKPFFPGLIEYMNSGPICAMVWEGRDAVKTGRAILGATNPLASSPGTIRGDYAIDVXRNVCHGSDSVENPEGDALWSRRPSRLLEVRQLMGHRRLNFVLYP

SEQ ID NO: 12988 - protein, 340 aa, Bradyrhizobium sp. BTAi1
MEERVKSLVVERPGRLSIETRAIPEPASGEIRIKVERAGICGSDIHILHGSNPFARYPRVIGHEFFGRIDKLGDGVHARLGARIVVDPVVACGTCYPCSVGRPNVCAQLAVLGVHRDGGFSEYACVPAENAHLLPDSVGDDQAPLVEPFSIAANITDHTSVFASDIALVYGAGPIGLTVIQVLKHVYGVKELIVTDRIDQRLEAARNNGADRVINTAQTALPAALADAGVTPTLIIDAACHPSILAEAIEIASPAARIGLLGFSAEPSTIVQQKVTAKELAIHASRLNSGKFAKVIDWFASGTLQPERLITHRFGLDDYAIAFDTFEHNPTECCKVQLIF

SEQ ID NO: 12989 - protein, 292 aa, Bacillus subtilis subsp. subtilis str. 168
MNKDIATPIRTKEILKKYGFSFKKSLGQNFLIDTNILNRIVDHAEVTEKTGVIEIGPGIGALTEQLAKRAKKVVAFEIDQRLLPILKDTLSPYENVTVIHQDVLKADVKSVIEEQFQDCDEIMVVANLPYYVTTPIIMKLLEEHLPLKGIVVMLQKEVAERMAADPSSKEYGSLSIAVQFYTEAKTVMIVPKTVFVPQPNVDSAVIRLILRDGPAVDVENESFFFQLIKASFAQRRKTLLNNLVNNLPEGKAQKSTIEQVLEETNIDGKRRGESLSIEEFAALSNGLYKALF

SEQ ID NO: 12990 - protein, 528 aa, Zea mays
MLEDGGIEESPRRSFEDCGDSDEEDDDGDNDEERDGDGVGSPRSFQSHKWPQSYRETTDTYTIAASPSFGYLGPSTSKYSLLDLGRSGLGSDLKLPLLSDKADGKQDSVKTLPKTLGSIRDERVSFQLQHTGELYITQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTTIFPKAGIDWFGIHVDGKHFFGVLTAILVLPTVWLRDLRVLSYLSAGCVIATLLVFLSVGLVGATDGIGFHSTGKVVNWSGMPFAIGIYGFCYSGHSVFPNIYQSMSDRSKFPKALFICFAICTAIYGSFAVIGFLMFGENTLSQITLNLPKHSIASKVALWTTVINPFTKYALLLNPLARSLEELRPEGFLNETSCSIILRTALVASTVCIAFLLPFFGLVMALIGSLLSILVAVIMPALCFLKIAQNKATCPQVIASVGIVILGVVSAALGTYSSVKKIAENY

SEQ ID NO: 12991 - protein, 446 aa, Corynebacterium diphtheriae
MNSQQEFVLQEIEERDVRFVRLWFTDILGFLKSVAVAPSELESAFEEGIGFDGSAIEGFSRISEADTIALPDPSTFKMLPSLNSDPTMRSARMFCDILNPDGQASNSDPRQVLHKQVQLAADEGFHCVVSPEIEFFLVQNLRTNGLPPVPTDNGGYFDQASQNDAPMFRREAMLALDRMGIPVEFSHHETAPGQQEIDLRHADVLTMADSIITFKHLMKQVAIDNNIGATFMPKPFRDHAGSAMHTHMSLFEGDINAFHDPDDEYGLSVTAKRFIAGIIHHANEISAVTNQWTNSYKRILFGNEAPTAATWGASNRSALIRVPTYRLAKAESRRVEVRSPDSACNPYLAFSVLLGAGLKGIREGYEIPDAAEEDISSLTRRERLAMGYKDLPTSLDQALREMERSELVADILGEHVFEYFLRNKWREWHDYQQQITPWELRNNLDN

SEQ ID NO: 12992 - protein, 260 aa, Shewanella oneidensis MR-1
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 12993 - protein, 510 aa, Nicotiana tabacum
MALLDLQPSTSLLFCLVPLLFLFFIKFNKTITNTLLSSNSSKIPRSYPLIGSYFSILANHDQRIKWISDIILSTPNLTFTLIRPLNFHTIFTANPSNVQHMLKTNFQVYQKGHNSNTTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFILPFPLIWKMKRALNIGSEKKLRFAVEQVREFAKEIVREKQRELKDKSSLDSADLLSRFLSTGHSDENFVTDIVISFILAGRDTTSAALTWFFWLISKHPEVESQILKEIGEKSESLLLYDEVKNMIYTHASLCESMRFYPPVPMDTKEATKDDILPDGTFVKKGNRVTYHPYAMGRVEKVWGKDWAEFRPERWLDKDEVTGNWTFVSKDAYTYPVFQAGPRVCLGKEMAFLQMKRVVAGVLRRFKVVPVVEQGAEPVFISYLTAKMKEVFPVTIEERI

SEQ ID NO: 12994 - protein, 512 aa, Vicia sativa
MELETLVAWLLFSATLLWLLLLATKTQSKSLKSPSSTTNSTIPKSYPIFGSIFSIAANFHRRVQWISDILQTTPSSTFILHRAFGSRQVFTANPLVVQHILKTNFPCYPKGLTLNRSLGDFLGNGIFNADGETWKLQRQISSHEFNAKSLRKFVETVVDVELSGRLLPILSEASKTEKILPDFQDILQRFTFDNICIIAFGFDPEYLLPSLPETAFAKAFDYGTRISSLRFNAAVPLIWKVKKILNIGTEQRLKEAVAEVRGLASRIVREKKQELLEKSALESLDILSRFLSSGHSDESFVIDIVISFILAGRDTTSAALTWFFWLLSKHSHVETEILKEVTAKSESVSYDEVKDMVYTHAALCESMRLYPPVPVDTKEVAYDDVLPDGTFVKKGWRVAYHIYAMGRSEKIWGSDWAEFRPERWLRRDEDGMWSFVGMDPYAYPVFQAGPRVCLGKEMAFLQMKRVAAGVLREFRVVPAMENGIEPEYTAHLTALMKGGFPVRIEKRSHTDE

SEQ ID NO: 12995 - protein, 160 aa, Triticum aestivum
SIVRRDVQENDEEAVRVKEQSILELGTLLAKTGQAAELGGLLKFVRPFLISISKAKAARLVRSLLDLFLDMEAATGQEVELCLECIEWAKAEKRTFLRQALEARLISLYFDTKRYQEALALGTQLLQELKKMDDKALLVEVQLLESKTYHALSNLPKARA

SEQ ID NO: 12996 - protein, 393 aa, Triticum aestivum
METVAAAGYARGAATRSPACCAAMSFSQSYRPKAARPATTFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISQLDERTQVAYGSKNEIIRFEETLYGSSRLAASATVGATA

SEQ ID NO: 12997 - protein, 151 aa, Geobacter metallireducens GS-15
MLNLRKKILVAIDGSPFSDKAAEEAVRMAAGNPSQFKSKIYAMLVLPNAPRSTFTDFVPPPPITETKEWDELRERVFYVIEKNAREADIPLEIKVVYGDPADELIDFAEKEQIDVIVIGSSGKGFLKRKLLGSVSHKVVKNSPCSVYIVRG

SEQ ID NO: 12998 - protein, 488 aa, Bacillus cereus ATCC 10987
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 12999 - protein, 663 aa, Oryza sativa (japonica cultivar-group)
MRRRSTFAVLLFAAAALPLAAGQPWQLCGRRGGGGGGTYTANSTYDTNLQSLIAALQQNASTSPTLFAAGALGAAPDAVYGLILCRGDVSSSDCYDCGTRAGQDVAPACNRTRDAILVYNQCYTRFSAAGDFLASANNSGQAPLMNSDNVTTADVAGYDRAVTELLSATLMYAVVNTTRLFATGQRVGADPGFPNIYSAAQCTPDLSPALCRSCLEDLVARWWKTFPRTTVGARIVGTRCSLRSEVSQDKFYTGAPMLKLWADGLSPAAAAASPDAAPGTTGVKNNSANKILEIVLPIVAVAIVAAVSILLWNIRKKRRRGKAEHFTGPDAAEDFESVKSTLLSLASLQVATDNFNESMKLGEGGFGAVYKGLLFRQDVAVKRLAKGSNQGLEEVKNELVLVAKLHHKNLVQLVGFCLEEGERMLVYEYMPNKSLDTFLFDEEKRRQLDWTTRFRIIEGIARGLQYLHQDSQKKIVHRDMKASNILLDADMNPKIGDFGLARLFGQDQTREITNRIVGTFGYMSPEYVTHGQYSTKSDVFSFGILVIEIVTGRRRNNGPYFFEPNEDIISIVWRHWAEGNIKEIIDHSLGRNYPEGEVLKCVNIGLLCVQQNPIDRPTMADVMVLLNSDATSTLPAPVVHIPVASFSDGSSGYSQTVTQLSPR

SEQ ID NO: 13000 - protein, 243 aa, Arabidopsis thaliana
  misc_feature (109)..(109): Xaa can be any naturally occurring amino acid
  misc_feature (150)..(150): Xaa can be any naturally occurring amino acid
  unsure (1)..(243): unsure at all Xaa locations
DQVKSSLTDRIDISGQNSGVEKRGSCESLSRNRDSQYGGGGGSESDTWGRRREESGAANGSPPPSGGSRPRLVLQPRTLPVAVVEVVKPESPVLVIVEKPKGANPFGNXRPREEVLAEKGQDWKEIDEKLEAGKLKDIAPAMEKPNEKSXGKMGFGLGNGRKDEERIEKSWRKSTEHSEEDAQEEEPAVEGAKKEETEDKPAVEEAKKEETEGEQAVEEAKKEETGGEPAVEEAKKEETEDKI

SEQ ID NO: 13001 - protein, 462 aa, Thermoplasma volcanium GSS1
MSYFKNKNINDECSYATMPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 13002 - protein, 536 aa, Oryza sativa
MAFSSILQLTLCFLCFSVFYYYHIKSKRKNPAIPVCWPLVGMLPDLLVNRHQLHDWITSFLTASQLNFRFIGPTMSSNMRFFFTCDSANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKANEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDDGKLRYVPSYKFTPFITGPRTCLGKDMALVQLKVVAATVVKNFEIEAVPGHIVEPKLSMVLHMKNGLMVRVKRSLLGPSFSSCLDLIGCTRALYLYLQKLFVRCNG

SEQ ID NO: 13003 - protein, 494 aa, Beta vulgaris
MAASDMGVMQEREVFKKYWIEHSVDLTVEAMMLDSKASDLDKEERPEVLSMLPPYEGKSVLELGAGIGRFTGDLAKKAGQVIALDFIESAIKKNECVNGHYKNVKFMCADVTSPSLNISPNSVDIIFSNWLLMYLSDEEVQRLVERMLKWLKPGGYIFFRESCFHQSGDHKRKSNPTHYREPRFYNKVFKECHMLDESGNPYELSLIGCKCIGAYVKNKKNQNQIGWLWQKVDSEDDKGFQRFLDSSQYKCNSILRYERVFGPGYVSTGGFETTKEFVSKLDLKPGQKVLDAGCGIGGGDFYMAENFDVEVVGIDLSINMISFALERSIGLKCAVEFEVADCTKKPYPEQSFDVIYSRDTILHIQDKPALFRNFYKWLKPGGKVLISDYCKSSGPPSAEFAMYIKQRGYDLHDVEAYGQMLKDAGFVDVIAQDKTDQFIQVLQKELDSLEKEKDKFIADFSEGDYNDIVDGWKAKLIRTKVGEQRWGLFIANKK

SEQ ID NO: 13004 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 13005 - protein, 274 aa, Campylobacter upsaliensis RM3195
MRKSIINFQKQKENQDKITMVAAYDYPSAKALDEAGVDVILVGDSVAMMLLGHEDTLSISVEEMLVFTKAVSKASQNAFVLADMPFMSYQSSVYDALQNAAKLMKEGRANGVKLEGGREFSACIKALNRASIPVIAHIGLTPQSINTMGGYRVQGKSKEAAEKLIDDAKAVQDAGASMVLMECVPSKLAKKITQILEVPTIGIGAGKHCDGQVLVYHDFLGINQSFKPKFVKQFANLNPNEGIKAYINAVKSGEFPSEEYSFSLENDEWIEELY

SEQ ID NO: 13006 - protein, 170 aa, Oryza sativa
MASGGGKAKASSWAAAMSVGTVEALKDQAGLCRWNYAFRTLQQRGRQQAVAGTSGAKSGGGARALQPAAAAAARRKAQQQEEELRTVMVLLRAAAQAMRAARQPAPAVAKPVPAAKPSAVAPGTAQRQQARRLSGGVAEPAEKAAVAERMRRRRREKSENVMQLVCWGPS

SEQ ID NO: 13007 - protein, 312 aa, Medicago truncatula
MGSVEIPTKVLTNTSSQLKMPVVGMGSAPDFTCKKDTKDAIIEAIKQGYRHFDTAAAYGSEQALGEALKEAIELGLVTRQDLFVTSKLWVTENHPHLVIPALQKSLKTLQLDYLDLYLIHWPLSSQPGKFTFPIDVADLLPFDVKGVWESMEEGLKLGLTKAIGVSNFSVKKLENLLSVATILPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 13008 - protein, 406 aa, Arabidopsis thaliana
MAENRQLVCRIGGGAGAELDDMDEGEIQRIGNEDEDDDEFIQVHANNSSAASPERWDVLGLGQAMVDFSGVVDDEFLKKLGLEKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 13009 - protein, 472 aa, Clostridium acetobutylicum ATCC 824
MQKTKMIFTIGPSSDSEEKLKELMNAGMNAARLNFSHGTHEDHKEKIDIIKKLRKELNKNVAIVVDIKGPKIRTHNFENDKAEIKKGQTFTVMCGSEILGNSEKCSVSYDDLYKDVKKGGLLLVDDGLLEFEITDVQDKNIICKAKNNGIISNHKGVNVPGVSIGLPAVTEKDVLDLKFACKMQADLVAASFIRKAEDVSVVRKVLKENGGEDIRVISKIETQEGVDNIDKILELSDGIMVARGDMGVEIPIEDVPSIQKMIIRKCNDAGKIVITATQMLDSMIRNPRPTRAEASDVANAIYDGTDAIMLSGESASGLYPIEAAETMAKIAQKTESQIDYTKALNERKGEIITKISDAISLAACSTAAELKAAAIITATQSGITARMVSKFRPTCPIIAVTPHDDVARRLALNFGITPITSEKVVSTDELISVSIKRALNENLIKKGDLVVVVAGVPVGESGTTNMLKIQYT

SEQ ID NO: 13010 - protein, 511 aa, Nicotiana tabacum
MMIDLELSTSLLFCLIPFLFLLFIKTTLANLFSSNKSTSKIPKSYPIIGSCFSILANKERRIQWTSDIMQNTSNLTFTLNRPFGFRQIFTANPANVQHMLKTQFHIYQKGDVFKTTMADFLGDGIFNVDGDIWKYQRQVSSHEFNTKSLRKFVETVVDTELNERLIPILATAAVEKTVLDFQDILQRFAFDNICKIAFGYDPAYLLPSLPQAKFAVAFEEAVKLSSERFNAIFPFVWKIKRNFNIGSEKKIRVAVNEVRQFAKELVKEKQKELKEKSSLDSVDLLSRFLSSGHSDEDFVTDIVISFILAGRDTTSAALTWFFWLIFEHPETENQILKEAKAKSESPVYDEVKDMIYTHASLCESMRFYPPIPIDTKAATEDNILPDGTFVKKGTRVSYHIYAMGRVENLWGKDWAEFRPERWLDKDEASGNWTFVARDTYTYPVFQAGPRICLGKEMAFLQMKRVVAGVLRRFKVVPLAEKGVEPVFLSYLTAKMKGGFPVTIEERNGTDI

SEQ ID NO: 13011 - protein, 511 aa, Nicotiana tabacum
MALLDLQLSTSLLFCLVPLLFLFFVKFKKTITNTLLSSNNSSKIPRSYPLIGSYFSILANHDRRIKWISDIILTTPNLTFTLIRPLNFRTIFTANPSNVQHVLKTNFQVYQKGHGSYSTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFIVPFSLIWKIKRALNIGSEKKLRVAVEQVREFAKEIVREKQKELNDKSSLDSADLLSRFLSTGHSDEDFVTDIVISFILAGRDTTSAALTWFFWLISKHPEVESQIMKEVGEKSESLLLYDEVKNMMYTHASLCESMRFYPPVPMDSKEATKDDILPDGTFVKKGTRVTYHPYAMGRVEKVWGEDWAEFKPERWLDKDEVTGNWTFVPKDAYTYPVFQAGPRICLGKEMAFLQMKRVVAGVLRRFKVVPVVEQGVEPVFISYLTAKMKGGFPVTIEERI

SEQ ID NO: 13012 - protein, 160 aa, Triticum aestivum
  misc_feature (77)..(78): Xaa can be any naturally occurring amino acid
  misc_feature (136)..(136): Xaa can be any naturally occurring amino acid
  unsure (1)..(160): unsure at all Xaa locations
LVPNSARGLLDEDEAFESDVSDDEASPHTAPESTRPRFSHFIKALSADFERNRGKDNSDRPIEWQKSNTAAQAVEFXXLEFKRAGDENMNITINLFRDETPERFLLRPALAEILDTDVATRAEALMGVWDYIKVMXLQDDDEKRSFECDKRLKSPSPNVI

SEQ ID NO: 13013 - protein, 455 aa, Synechococcus elongatus PCC 7942
MSSSAVLTWRQGDRLSLTIESLCDSGDGLGRVEGRVVFVPDTVPGDRIQAKLLQVRSRYARAELEEVLEASPDRIRPACIVADKCGGCQWQTVDYPAQVEAKTVIVQDAMQRLGQLETEVQPTIAAPYPLGYRNKVSYPLRRSDRGEVQAGYFRKGSHRLINLNQCPVQDDRLNPLLAGIKADIAARDWPIYDEQTRSRGLRHLGLRIGQRTGEILITLIATDDQLPEVEAQAEQWLTDYPNVVGVCLNLNPSHGNRILGDETHCLAGRPYLIECLDDLEFAIGPETFFQVNTEQAERLLPILKDFLRGSDRLFDLYCGVGTLTLPLASEVGSVLGLEILPESVVQAQQNADRNGISNVEFRAGAVEILLAQIPESPDAVLLDPPRKGCEPAVIEVLRDRQPQRIAYVSCNPATLARDLQALCAGDRYRLLLVQPLDFFPQTAHVETVALLELQD

SEQ ID NO: 13014 - protein, 434 aa, Thermobifida fusca YX
MTTPTETYVDASGGDWDEVVAAAQRSQTDRLVINMGPQHPSTHGVLRLILTLDGETVTEARVGIGYLHTGIEKNMEYRTWTQGTTFVTRMDYLTPLFNETAYCLAVEKLLGITDQVPERANVIRVMMMELNRISSHFVAMATFGMELGATTVMTNGFREREMVLDIFEMVTGLRMNHAYIRPGGVAQDLPPGTVGKVRELLTEMPKRLKDMRKLLDANPIYLARTRDVAYLDVTGCLALGVTGPILRAAGLPWDLRKAKPYCGYENYEFDIPVSDGADVYARYRVRMAEIEQSLKIIEQCLDKLKPGPVMIEDPKIGWPAQLALGPDGMGNAPSHIAHIMGKGGSMEALIHHFKLVTEGFRVPPGQAYAAVESPKGELGCFAVSDGGPRPYRVHFRDPSFTNLQAVAAMCEGGTVADVIAAVASIDPVMGGVDR

SEQ ID NO: 13015 - protein, 437 aa, Synechococcus elongatus
MRELTLTTTVFQTTKSQEIFAAAQKLMPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 13016 - protein, 415 aa, Symbiobacterium thermophilum IAM 14863
MQVRDPVHGDIYLTDVEVRVLDTREMQRLRSIKQLGTAHLVFPGCVHTRFDHSLGALHMAHRLMESLRLNGFTIAPEDAQLVRLATLVHDVTHIPYGHTFEDERQIFPRHDAGPRLEHFLGIQSELGRVLAASGYLDGVKAILTGRPPAPWMGQIVSSTIDADLLDYLRRDSFFAGLRMNYDDRVLSYFIKEDGRLLINMVKHGLDRPDARTEIIHLLRMRYVLTERLYLHHAKIAAGAMISKAVELHTRHTGLREEALYGLGDQTFLDLLARLPGPGIIQQLVEGVIERRLYKRAYVLSGDTLGPERDAFIARYGGQSAAREELEEQIAKKARLKPGQVIVYCPKASYFKEVQVPVRSRHGVGPLLELDRSGEVAAMARQYEGLWRTYVFCPADKVDAVQRACEKVFGYESEYR

SEQ ID NO: 13017 - protein, 956 aa, Rhodobacter sphaeroides 2.4.1
MSFTPTDYNAYDFANRRHIGPSPSEMEEMLRVVGVSSLDQLIEETVPASIRQETPLDWAPLAEHELLARMREVAAKNRVMTSLIGQGYYGTVTPPAIQRNILENPAWYTAYTPYQPEIAQGRLEALLNYQTMVADLTGLPVANASLLDEATAAAEAMTMAERASKSKARAFFVDADCHPQTISVIRTRAEPLGIEVIVGHPAQLVPEDVFGALFQYPGTYGLVRDFTRDIAALHEAKALAVVATDLLALCLLKEPGAMGADIAIGSSQRFGVPMGYGGPHAAFMSCKDDLKRSMPGRLVGVSVDARGNKAYRLALQTREQHIRREKATSNVCTAQALLAVMASFYAVFHGPRGLRAIAERVHLNTVRLATALKEAGARVSPEAFFDTITVEVGVGQAGILAAARHRGINLRKVGRDRVGISLDETTDAGVIARVLDAFGIHEPAPAKVGLGFPEPLLRETGYLSHPVFQMNRAESEMMRYMRRLSDRDLALDRAMIPLGSCTMKLNAAAEMMPITWPEFGTLHPFAPADQAAGYHEAIGDLAQRLCRITGYDAMSMQPNSGAQGEYAGLLTILAYHRARGDAERTICLIPVSAHGTNPASAQMAGMKVVVVKSAPNGDVDLEDFRDKAAAAGDRLAACMITYPSTHGVFEETVREVCRITHEHGGQVYIDGANMNAMVGLVQPGAIGGDVSHLNLHKTFAIPHGGGGPGMGPIGVKAHLAPYLPGHPEVTGPLTGGHDEAADEGPVSAAPYGSASILLISWAYCLMMGGEGLTQATRVAILNANYIAARLRGAYKVLFMGNRGRVAHECILDTRPFAEAGVTVDDIAKRLIDNGFHAPTMSWPVPGTLMVEPTESETKAEIDRFVAALLAIREEIRAVEEGEIAAADSPLRHAPHTVEDLVADWDRKYPREQGCFPPGSFRVDKYWPPVGRVDNAWGDRNLVCTCPPVESYSIAAQ

SEQ ID NO: 13018 - protein, 360 aa, Flavobacteria bacterium BBFL7
MRMSNKYAVIMAGGVGSRFWPVSKQSFPKQFHDMLGLGKSLLQMTFTRLQAQIPANNILILTNEAYVDLVKEQLPEVLPENIVAEPAMRNTAPCILLAALKIQKMNPEASMIVAPSDHYIAEEDLFNEDLATTFAFCEQHPQALMTLGIQPTSPNTGYGYIEYNHETTAVKKVNQFREKPNLETAQQFLDAGNFLWNAGIFIWSVDAVVNAFAKAQPTMTQLFTNGMQVLNTEEEVSFLESEYPKAENISVDYAIMENSEEVYVLPARFSWNDLGTWGSLYDKLDKNEESNAIVNASVTAIASHGNMVRTAPGKKVILQGLEDYIVVDQDDVLMIIPKNAEQEIKEIRNTAMDKYGEEIG

SEQ ID NO: 13019 - protein, 425 aa, Kluyveromyces lactis NRRL Y-1140
MSLEEARNLVGKEDYEKAEAQFLAVLNHQDAAQPQSISNKDAQEKEQCILELGQLYGTTHQLKKLAEFVPRSREYMMKVAKSKIAKVLKTLLNDFELIPDSLDTQIEICEDSIDFATKEKRIFLKHSLSIRLATLYYQKTHYNESLQLINDLLRQFKKLDDKSSLLEVHLLECKVYHKLRNLTKSKAALTSARTSANSIYCPTLTMAELDLMSGILHCEDKDYKTAFSYFYESFEAFHSQTGSNTFGKACQVLKYMLLSKIMLNLIDEVKTILNAKYTKETYQSRGIDAMKAVAEAYNNRSLLEFNTAMQNYKTELMGDELIRSHFNALYDTLLESNLSKIIEPFECVEVSHISKIIGLDAQQVEGKLSQMILDKVFFGVLDQGNGWLYIYETPQQDATYDSSLELINQLNGVVEQLFEKAAVLY

SEQ ID NO: 13020 - protein, 389 aa, Pyrococcus horikoshii OT3
MALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMDRMERVLKERKLV

SEQ ID NO: 13021 - protein, 431 aa, Staphylococcus aureus subsp. aureus Mu50
MTNAYVDLKLVEEKVFKDPIHRYIHVEDQLIWDLIKTKEFQRLRRIRQLGTLYLSFHTAEHSRFGHSLGVYEIVRRLIDESFIGHDAWDNKDRPLALCAALLHDLGHGPFSHSFEKIFNTDHEAYTQAIITGDTEVNAVLRKVSPEFPREVAEVINKTHHNKLVISMISSQIDADRMDYLQRDAYFTGVSYGAFDMERILRLMRPSKDEVLIKESGMHAVENFIMSRYQMYWQIYFHPVSRGGEVLLNNCLKRAKQLYNEGYEFKLHPHDFIPFFEETVTIEQYVELDEAVVTYYLEKWTKEDDAILSDLASRFINRDLFKYIPFDGSIITISELQELFEAGGINPDYYFVSEAFSDLPYDYDRPGSNRKPIHLLRQDGTIREISNQSLVIHSITGINRQDYKLYYPREMVAKIKDKTIREAIENLINELN

SEQ ID NO: 13022 - protein, 336 aa, Staphylococcus aureus subsp. aureus Mu50
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMEKGTITGRMVIKF

SEQ ID NO: 13023 - protein, 229 aa, Pyrococcus horikoshii OT3
MNVEEMKKIAAKEALKFIEDDMVIGLGTGSTTAYFIKLLGEKLKRGEISDIVGVPTSYQAKLLAIEHDIPIASLDQVDAIDVAVDGADEVDPNLNLIKGRGAALTMEKIIEYRAGTFIVLVDERKLVDYLCQKMPVPIEVIPQAWKAIIEELSIFNAKAELRMGVNKDGPVITDNGNFIIDAKFPRIDDPLDMEIELNTIPGVIENGIFADIADIVIVGTREGVKKLER

SEQ ID NO: 13024 - protein, 365 aa, Ralstonia metallidurans CH34
MKAAVMEKAGAPLVIHDVAIAEPGPREVRVRTAAVGLCHSDLHMMQGTYPLPLPAVLGHEVSGVVEAVGTQVSGLKAGDHVVGCLSVYCGHCSVCASGHQVLCQNPEVKLPPGKANRLRLAGNPLSQVFNLSGFAEEILVHENALVKIRDDMPLDRAALLGCAVITGTGAVFHSAKVPPGSTVVVVGCGGVGLSVINGAVIAGASRVIAVDMLPAKLELARKFGATDVVNAGDGDPVAQVMQLTGGGAEFAFECIGLKQTAEQCYAMLAPGGTATVIGLFRPDARIELPALDFLKEKRIQGSFMGSNRLSLDIPRLVELYMQGKLLLDDLISQRISLEDINEGFIAMQSGSVARSVITFPGVGGL

SEQ ID NO: 13025 - protein, 577 aa, Nicotiana glutinosa
MKMVVEKKFDQEQVIEEFEDLTKDAGKIQEETLKKILEQNGGTEYMQQWGLNGRSDPQTFKNCVPIVTHNDLEPYIQRIADGDLSPILTGKPIETISLSSGTTQGKPKFVPFNDELMESTMKIFKTSFAFRNREFPIGNGKALQFIYSSKQFKTKGGLAAGTATTNVYRNAQFKKTMKAMCTPCCSPDEVIFGPDFHQSLYCHLLCGLIFRDEVQVVSSTFAHSIVHAFRTFEQVWEALVVDIREGVLSSRVTVPSIRLAMSKLLKPDPELADTIYNKCSRLSNWYGLIPELFPNTRYIYGIMTGSMEPYLKKLRHYAGELPLLSADYGSSEGWVGVNVNPKLPPELVTYAVLPNIGYFEFIPLGGNLNGVEQADSPVDLTEVKVGEEYEIVFTNFAGLYRYRLGDVVKVKGFHNGTPELQFVCRRNLLLSINIDKNTEKDLQLAVEAASKRLVDEKLEVVDFTSQVNVSADPGHYVIFWELSGEATDEMLQDCCNCLDKAFIDTGYVSSRKVNAIGALELRIVKRGTFHKILDHFVGLGGAVSQFKTPRCVGPKNSSLLQILCSNVVENYVSTAFC

SEQ ID NO: 13026 - protein, 633 aa, Oryza sativa (japonica cultivar-group)
MRRRSSVLHAVLLLLLVAAVALPLAAAQPWPVCGTSGGNYTAGSTYESNLLRLASTLRANASASPTLFASGVRGAGPDAVYGLLLCRGDMNPSDCFDCGTRVGDDVAQACNRTKDAILVYNQCYAQFSDTGDFLAATNNSGAYSLLISGTNISSADVAGYDRAVTELLNATVRYAVENSTRLFATGQRVGADPGFRNIYSMAQCSPDLSPAQCRSCLDGLVGQWWTGFLFPRNGEGARVAGPRCYLRSELGSGFYTGAPMVLLRADGLSPASAPAPDVVPATTLVKKNSASKILLIVLPIVAVAIVAAISVCMWTVRKKSRATKAEHLSELDASEDLESVKSTLLTLGSLQVATDNFDESKKLGEGGFGAVYKGHLFGQEVAVKRMAKGSNQGLEELKNELVLVTKLHHKNLVRLVGFCLEDGERLLVYEYMPNKSLDTFLFDVEQRRQLDWATRFRIIEGVARGLQYLHQDSQKKIVHRDMKASNVLLDADLNPKIGDFGLARLFGQDQTRDVTNRIVGTFGYMAPEYVIRGQYSTKSDVFSFGILILEIVTGQRNSGPYFAEQNEDLVSLVWRHWTEGNIVEMVDYSLDRNYPEAEVLKCVNIGLLCVQQNPVDRPTMADVMILLLIYSHD

SEQ ID NO: 13027 - protein, 525 aa, Graphium sp. ATCC 58400
MMDPFYLLGGCCVFGIVYKSVATLYVNYVHGKTARELGCKPLPKERTRFFGLDILRREMKADREMYLPSDIMTRFEEVGATTYEYQMLNEKHIATCDPLVIQTVLATQFKEFTFGNRPWGTVLGNGIFSIDNIGDNKEWLHTRAMLKPQFLRNQVSDLELEEGHVRNFMSVLKVGDDGWTPKVNLQHMFFNFTLDSATEFLFGKSADCQLLFAPGGDPKGVSKPLRAFLKALDVAKETVNTKWFLGNNGWIADSPTFRKNCAYVNDFMDALIAKTKAELEAKPKGSKPSGGREKYHFLHAMLDETDDKVELRGQALNILLAGRETTASLLGWLWYYLARHPIEFQKLRAAVLKDFGTAENPKPMSFESLKACDQLQYCNNEILRLFPLVSYNSRMALTDTTLPRGGGPDGNSPIFVKKGQQIVYHPHAMHRRKDIWGQDADEFRPDRWKTLRPGWEYIPFNGGGRICMGQQFALTEASYLTVRLLQRFDRIENLDPNPVLKQKFRIVNTPGEGVLVRLHEAAAGA

SEQ ID NO: 13028 - protein, 333 aa, Oryza sativa
MASPGSSGRCSRTPGFPAGPLGGGGRAVPAVGLGTASLRSVGEESFRGALLAALEVGYRHIDTASVYGSERVVGEAVAGAARRGVIACREEVFVTTKVWCTQCHPDLVLPSLRESLQNLQMEYVDMYLVHWPMSVKPTKPHYPMKREDIMPMDLRGVWQAMEECHQLGLAKMIGVSNFTTKKLQELLAFAKIPPAVNQVELNPVWQQKKLMEFCKAKGIHVTAYFPLGGRHSTSTVNPVLDSDVLKEIAAAKGKSVAQISLRWIYEQGASMVTTSTKRERLKENIDIFDWQLSDEDRLKISQIPQHKTVSVLSILCPDGVSSVELSEVDVVEV

SEQ ID NO: 13029 - protein, 288 aa, Moorella thermoacetica ATCC 39073
MDSVATPGRTLALVREKGLVPRKSRGQNFLVDANIVRKIARAAEVGPGDTVVEIGPGLGALTQELAARAGLVIAIEIDRELFAALEETLAGRDNVRLVAGDALKVDFDRLVAGILGTGEGRLPTYKVVANLPYYITTPILMHLLTSRFRIAELVLMVQAEVGYRMLARPGGKDYGALSVVVQYYTEPAVVLKVPRTVFYPRPEVDSLVLKLTCRTRPVVQVEDEDFFFRVVRAAFNQRRKTILNALGSLGFEKSKIMEALAGAGIDPRRRGETLGMEEFASISRTLQH

SEQ ID NO: 13030 - protein, 451 aa, Streptococcus agalactiae A909
MNVVLKQRIPLKIKRMGINGEGIGFYKKTLIFVPGALKGEEVFCQISSVRRNFAEAKLLKINKKSKNRVDPACSIYKECGGCQIMHLQYDKQLEFKTDVIRQALMKFKPEGYENYEIRKTIGMPEPEHYRAKLQFQVRSFGGNVKAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKDDDDLIDAYCGVGTIGLAFAGKVKSVRGMDIIPEAIQDAKENALHMGFTNTHYEAGKAEDIIPRWYSEGFRANALIVDPPRTGLDDKLLNTILKMPPEKMVYVSCNTSTLARDLVTLTKVYHVHYIQSVDMFPHTARTEAVVKLQRKV

SEQ ID NO: 13031 - protein, 349 aa, Lactobacillus rhamnosus
MKASMLEDLNKFSVKEIDIPSPKKDEVVVKVMAAGTCGSDSHKMISGWKYGYPAVMGHEFSGIVTQLGENVSNVSVGQHVAVAPFIPCFKCHYCQIGLFQMCENYSMLGQQKFGGFEQYVSVPARNVLDIGKMSFEEGALIEPMAVAAHAVMGIKPELGDTVAVFGLGTVGDLVVRLLISSGATNVIGIDIDDQKLEKGLDEGCTHVINSAKESLEEKIMEYTDGLGVDISMECAGSKITEEQTLLVTKRRGKVGFVGIAYSDVLLHQKAFENIFRHELTVTGFWNSYSAPFPGREWTNSIQLVNRGRIKIKDLITHRFELEDMQKAFNMITTRSESFNKVMFFPNGIN

SEQ ID NO: 13032 - protein, 264 aa, Triticum aestivum
  misc_feature (253)..(253): Xaa can be any naturally occurring amino acid
  unsure (1)..(264): unsure at all Xaa locations
NKFVQKSRLVPVRNSRDIVDPRVRSPAVRQAVSALLAGPNPELADAVARKCAGLSNWYGVIPALWPNAKYVYGIMTGSMEHYVKKLRHYAGGLPLVAAEYGASEGWIGANLEPAMPPESATFTVLPDIGYFEFIPLRPGCTAAPGPDACYGESEPVGLTDVVVGEHYEVVMTTFAGLYRYRLGDVVRVAGFHNATPKLKFVCRRNLALSINIDKNSEQDLQLAVDAAAAKFLAAEKLEVVDYTSHADMSSDPXHYVVFVELNAG

SEQ ID NO: 13033 - protein, 594 aa, Zea mays; identical to SEQ ID NO: 361

SEQ ID NO: 13034 - protein, 241 aa, Prochlorococcus marinus str. MIT 9312
MRKSVIAGNWKMHMTCAEAKSYLEEFIPLIKNIRDDRKVVIAPPFTAISTFSKHSDFDYLDISSQNIHWEDEGAFTAEISPKMLIEHGVSYAIVGHSEPRKYFSESDEQINKRAVFAQCSGLTPIVCVGETLEQRERGEADRVITRQVEQGLENTDPSNLIVAYEPIWAIGTGKTCEAKDANNICSLIRKLIGFDDVIIQYGGSVKPNNIDEIMSMSDIDGVLVGGASLDPNSFARIANYQ

SEQ ID NO: 13035 - protein, 388 aa, Thermotoga maritima
MEELREAFEEGKPVILIDRNRENEADFVFPAQLITEDVVSFFVTYGKGLFCVTADEEDLLKRGFVKLSSNYGANYFVPVDWGTGTGISALERAETCRKLAEGRYFHEFRYPGHVTVIGGIGFQRRKGHTEASLEISELAGFSRHAVIVEILDEKGNSHNLDYVLKLSEKFSLPVLEMDDVWREFVKRKLLMKKKAEATLPTDFGVFKVVSFENHLDGKEHFAIVKEPLEDPVAVRIHSECVTGDVLSSLRCDCGSQLANFLRYMSAHGGILIYLRQEGRGIGLSNKIAAYSLQDKGLDTVEANRVLGFSEDERDYAPAAQILKALGIERVLLFTNNQRKTVGLEKYGIEVVETKRLYGRVTPHNRFYLSTKMKKLGHELEEIFREVNS

SEQ ID NO: 13036 - protein, 497 aa, Streptomyces nodosus
MTPQPPPPKADNGQAGRTGPTSPAEHGSGLQAGLKNRHLSMIAIGGVIGAGLFVGSSSGIATAGPGILLSYALVGTLVVLVMRMLGEMSAANPTSGSFSAHADRALGSWAGFSIGWLYWFFWVVVLAVEATAGAAILSSWVPAVPQWGWALIVMIVLTATNLISVGSYGEFEFWFAGIKVVAISIFIVIGLLAVFGVLPGVHADKAGLGNLTDHGGFLPHGLSAIFTGVLLVVFSFMGSEIATLAAGESEDPQRAVTKATNSIIWRIGVFYLGSVFVVVTLLPWNDKAIAEKGSYVAALDSLGIAHAGEIMKFIVLTSVLSCLNSGLYTASRMAFSLGERGDAPKAFARTNSRGVPMAAILSSVVFGFVAVFFNYRFPDSVFLFLVNSSGAVALFVWLVICFSQLRLRRIIQSEAPEKLIVKMWLYPYLTWAAAFLIILVFGYMLTDTEHDGRETVLLSMLVAVIVLAVAFIKQRVEGGRAKATEPAAAEAEKVSAG

SEQ ID NO: 13037 - protein, 432 aa, Nostoc sp. PCC 7120
MVNTTIKTTKSQEIFAAAQNLMPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 13038 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIAKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 13039 - protein, 454 aa, Bacteroides thetaiotaomicron VPI-5482
MAAEGKAIAKVNDLVIFVPYVVPGDVVDLQIKRKKNKYAEAEAVKFHELSPVRAVPFCQHYGVCGGCKWQVLPYSEQIRYKQKQVEDNLRRIGKIELPEISPILGSAKTEFYRNKLEFTFSNKRWLTNDEVRQDVKYDQMNAVGFHIPGAFDKVLAIEKCWLQDDISNRIRNAVRDYAYEHDYSFINLRTQEGMLRNLIIRTSSTGELMVIVICKITEDHEMELFKQLLQFIADSFPEITSLLYIINNKCNDTINDLDVHVFKGKDHMFEEMEGLRFKVGPKSFYQTNSEQAYNLYKIAREFAGLTGKELVYDLYTGTGTIANFVSRQARQVIGIEYVPEAIEDAKVNAEINEIKNALFYAGDMKDMLTQEFINQHGRPDVIITDPPRAGMHQDVVDVILFAEPKRIVYVSCNPATQARDLQLLDGKYKVKAVQPVDMFPHTHHVENVVLLELR

SEQ ID NO: 13040 - protein, 266 aa, Pseudomonas fluorescens
  misc_feature (185)..(185): Xaa can be any naturally occurring amino acid
  unsure (1)..(266): unsure at all Xaa locations
MPAITLTTLQGLKQKGEKITMLTCYDATFAHACNEAGVEVLLVGDSLGMVLQGHDSTLPVTTAEMAYHVAAVKRGNTDALILADLPFMAYATLEQTMTNSAMLMQAGAHMVKVEGALWLADSIRLLAERGIPVCAHMGLTPQSVNILGGYKVQGRNENQARQMRADAIALEQAGAAMLLLECVPXELAEEITQAVKIPVIGIGAGHATDGQVLVLHDMLGLSITGRVPKFVKDFMAGQTSIQGALSAYVAEVKAATFPGVEHGFSA

SEQ ID NO: 13041 - protein, 541 aa, Geobacter metallireducens GS-15
MKIIVTDEVAQEGLALLAQDPRVEINIKLGLKKEELLAIIGNYDAIITRSGTTVDKNLLDAGTKLRLIARAGVGIDNVDVDYASSRGVIVVNAPFGNTNSAAEHAMALLLSFCRNVPRANGSLKSGEWKRAPFTGYELKGKTAGVIGLGKVGGRVATRLKAFECEVLACDPYIAVKRAHDLGVKLVSHDEIYRNCDIITVHTPLTDETRNMIGERELAMMKDGVIIVNAARGGIIEEEALLKYLESGKITGAAIDVFSVEPPKTDVLQKLIAHERVIVTPHLGANTFEAQVNVAVDVSKEILNYLDDLPLENAVNIPRFDLALMDQMRPFLNLMSVMSDFVIQLVDANIDTVTFSYAGNIAHYDCTPLSVCGLSSILNRLVEQDVNMVNATLIADQMGITVEENKSTQSPSFSNMITLTIEGKGEKRTIAGTLFEGSPRIVKLRDYQVDFAPDEHMLSLTYEDRPGMIGKIGTIMGAHDINIASMNLGRREKRGEAMVILSLDSAVPPFVVEEVRKATDATFIKPIHMPGVKCSRGCGCGI

SEQ ID NO: 13042 - protein, 132 aa, Vigna unguiculata
YATSLESMVDFSTSKLGKNVAVLSTEVDQETGLQQYTIAPGVKKVSGDNAVVCHKQSYPYAVFYCHKTETTRTYPVPLEGANGIRVKAVAVCHTDTSQWNPKHLAFEVLKVKPGTVPVCHFLPEDHVVWVQK

SEQ ID NO: 13043 - protein, 264 aa, Thermobifida fusca YX
MIAIIGAGRMGEALLAGILHTGRDAAEVLISEAREDRAAELCQRYGVAAASPAEAAARADTLLLAVKPQDMVAALNEIAPALPPGRLVISVAAGITTAVLEKHLPAETAVVRAMPNTPALVGQGMTAIAAGTHTLEEHLDRAETLLRSVGEVVRVPEKHLDAVTALSGSGPAYFYLVAEAMIEAGVLLGLPRPTAERLVTQTAVGSAAMLRDSGDHPTLLREAVTSPGGTTAAALRELERHGLRSAFADAVEAACRRSAELAEG

SEQ ID NO: 13044 - protein, 237 aa, Triticum aestivum
  misc_feature (159)..(159): Xaa can be any naturally occurring amino acid
  unsure (1)..(237): unsure at all Xaa locations
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFRCTGRHTVLNEVEEVKKEYPDAYVRVIGFKTWPQGQGVXFIPFKPPGCQGTREGPNHKTKTRAQYPEEGLFENLPILAQKPRLGRNLDFRPRRTNTFRSKIRYRGKRTAPKQKSLLE

SEQ ID NO: 13045 - protein, 473 aa, Candidatus Kuenenia stuttgartiensis
MKTFILAGGGGERLWPLSRNNFPKQFLKLNGSMSLLQQTVDRLLGAVSPEDIIVITNHNYQFHVSSALNSLPGMNGSVSGAHTILEPLSRNTAPAIALGVKYCKEILRCTEDEIIFLSPSDHIIKPTEAFAERVRHAEEIAQKGYIVTFGIKPDKPETGYGYLKFSDQSSGNCAKKFFKVERFAEKPDRDTAKQYIHEGNYYWNSGMFAFSIQTIMEELQRYAPEITEIYHLGYEEMLLQFQHMPDISIDYAVMEKSDKVVALPFDLYWNDVGSWDSLFDILDKDANGNVLQGDVMAIDTKDSFLLGKKRLITTVGLENCLVVETDDAILIAKKGEAQKVKDIVKKLRENSRPEAVEHVTTYRPWGSYTVLENGPRYKIKRIVVNPKEKLSLQMHYHRSEHWVVVKGSAKVTTGDKESFIHENESAYIPKSTIHRLENPGKIPLEIIEVQNGEYLGEDDIVRCDDVYGRTQGA

SEQ ID NO: 13046 - protein, 390 aa, Campylobacter upsaliensis RM3195
MLSKKSQVLEESITLAITALANELKAKGEDVLSFSAGEPDFDTPQTIKNAAIKAIENGCSKYTPVAGIKDVLNAVATKLKRDNDLSYETSEIITNVGAKHSLFQCLECLVDEGDEVIIPSPYWVSYPEMVKFAGGKCVFVDTKEENGFKITADELKGALSEKTKVFILNTPSNPVGCVYTKEELRALAKVLEGTRVVVLSDEMYEKLCYDGVKFHAFASVSEDAMKRTVTINGLSKCGAMPGWRFGYMASKIKGLVPAVKKLQGQSTSNICSISQHAAIPALLGECDEDIEMMRKAFERRRNVALEMLSKMENVSIYKPSGAFYLFINISKLEKDSMKFCQKLLEEKKVAVVPGIGFGMDGYLRLSYATSEENIIKGLERFGEFVENYKA

SEQ ID NO: 13047 - protein, 215 aa, Yarrowia lipolytica CLIB122
MWGFFGGAKKQDPKDTIISLRQQIIVLNKKNDNLIVQIQEQENLARKHVTTNKLMAKNALKKKKNLEKQQETVQGSIDSLQTSINTLETANLNLETMKAMQEGAKAMKQIHGNMNIDKVDKIMDETRDQVALSEEVSEAISRPYANAYDDEELEDELEALEQETLEGELTNAGHVKQDGVQVTPHDLPAAPNQVPAEEEDDEEEELRRLQREMAL

SEQ ID NO: 13048 - protein, 393 aa, Calycanthus floridus var. glaucus
MNVPATRKDLMIVNMGPHHPSMHGVLRLIVTLDGEDVIDCEPVLGYLHRGMEKIAENRTIIQYLPYVTRWDYLATMFTEAITVNAPEQLGNIQVPKRASYIRVIMLELSRIASHLLWLGPFMADIGAQTPFFYIFRERELLYDLFEAATGMRMMHNYFRIGGVAADLPHGWIDKCLDFCDYFLTGVVEYQKLITRNPIFLERVEGVGIIGGEEAINWGLSGPMLRASGIQWDLRKVDHYECYDEFDWQVQWQKEGDSLARYLVRISEMTESIKILQQALEGIPGGPYENLEGRRFDRESDSEWNDFDYRFISKKPSPTFELSKQELYVRVEAPKGELGIFLIGDNSVFPWRWKIRPPGFINLQILPHLVKRMKLADIMTILGSIDIIMGEVDR

SEQ ID NO: 13049 - protein, 402 aa, Aspergillus oryzae
MIMNSSHYPVALLAGAPARTTVNRYIFTTDGDHWAQSRAMIRPNFVKDQVAHLDIFEELMADLLALIPTDGTTVDLQDLFFCYTIDSATEFLFGHSVQSLKKRLSGVKLDDNDFASSFNYAQDAIAKNTRLGPLRHFFRDTKAEHCNQVCHELVEQFVEKALKYRANYDEEKAATDDDKKQRYLFLQGLAQQTGDPKRIRDELMNVLLAGRDTTASLLSNMFFMLAKNPHIWNKLREEVASLEGRAPTYEQLRNLTYLKYCMNESLRLHPVVPSNARFAINDTVLPVGGGPDGNAPVFVPKGSIVAYSVYSMHRREDFYGPDANEYRPERWADLRPSWEYLPFNGGPRICVGQQYALTEAGYVTVRLAQQFSVLESRDPGPWEENLTLTLCSRNGTKVALRH

SEQ ID NO: 13050 - protein, 523 aa, Aspergillus phoenicis
MRITSAIASLLLVGTATSLQNPHRRAVPAPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 13051 - protein, 273 aa, Erwinia carotovora subsp. atroseptica SCRI1043
MQQRKIAFIGAGNMAQAIIAGLVNGGYPAQHISVCAPSGKNRDVLAAQYGVISSADNVRCAQEADVIVLAVKPQMMATVCEPLHEQVNVAGKLVLSIAAGINIARFQALLGEPLNIVRIMPNTPSLVGKGMSGMYAPASVSQADKDFTAQLMQSVGKICWVDSEQGINSVIAAAGSAPAYFFLFMEAMQQEAIRQGFDQETARLLVQQAASGAAALVEANPDTPLSTLRENVTSKGGTTAEALRVFNEQQLTQTVAEAMQAAIARAQEMETLF

SEQ ID NO: 13052 - protein, 205 aa, Pseudomonas aeruginosa PAO1
MSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQKGLNKHNRRYLATKAGKLGHMLGSLHQGEAETT

SEQ ID NO: 13053 - protein, 247 aa, marine gamma proteobacterium HTCC2207
MGKPLIAGNWKMHGTAESARKLATEVSHHNAQETAAEIIIFPPLVHISAVSDALSDSSISVGAQNVSQYSNGAYTGEVSAEMLLDQGCKYVLVGHSERRAILGESDQTVAEKFRAAQNAGLIPILCVGESLQQRQQDATLEVVAKQISAVIDLVGLDRVCQSVIAYEPVWAIGTGETASPEQAQDVHAVIRTQLGEAGRSTTLLYGGSVNKSNAAELFKQPDIDGGLVGGASLEADEFLNIAQLVEA

SEQ ID NO: 13054 - protein, 456 aa, Salmonella typhimurium LT2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 13055 - protein, 365 aa, Pseudomonas aeruginosa PAO1
MALNTIDELIEDIRQGKMVILMDDEDRENEGDLIMAAECVRTEDINFMVKHARGLVCMPMTRERCERLGLPLMVQRNGSGFGTKFTVSIEAAEGVTTGISAADRARTVQAAAAKNAVAADIVSPGHIFPLMAQPGGTLARAGHTEAACDLARMAGFEPSGVICEVMNDDGSMARRPELEAFAAEHGIKIGTIADLIHYRLIHERTVERIAEQPLDSELGHFNLITYRDSVEGDVHLALTLGKVCAEEPTLVRVHNMDPLRDLLQVNQPGRWSLRAAMTKVAEAGSGVVLLLGHQIGGDDLLAHVREIASAPAPAPKATTTYSTVGAGSQILRDLGVRKMRLLSAPMRFNAISGFDLEVVEYLPAE

SEQ ID NO: 13056 - protein, 457 aa, Rhodobacter sphaeroides 2.4.1
MSADPPRTAGVAEDRLAAFLADETARFERENPRSKEALQRGAQSYLGGVPMHWMKDWPSPFPLVAAEAQGARLTDLDGHRLDDFCLGDTGSMFGHSPAPVARAIRRQARQGLTYMLPTEATFEAGQLLNRTFGDFRWQVALTATDANRFALRVARAVTGRRKVLVFNGCYHGTVDDTMVMLENGRTRARPGLVGMVADLASKAVAVEFNDVAGVEAALATGEIAAILTEPVMTNSCMVLPEAGFHDALRTLSRRYGAVLILDETHTLSSGLGGYGRVHSLSPDILVVGKCVAGGTPTAVWGLTPDLGARFAAYNATRPAGHSGMGTTLSANPMQFACLCATLSEVMTPEAYAHMERGAKRLAKGLAAAIARVGAPWHVVRVGARVEFICAPGPLRNGTEAAAAHQPRLEGAVHLGLLNRGSLIAPFHNMMLVSPMTRTRQIDRLIAAFDAILTDLFA

SEQ ID NO: 13057 - protein, 393 aa, Solibacter usitatus Ellin6076
MPTLASSVEIVPRSRIRELAEIAMTMDGVLRLYFGESNLPTPEYIKQAAVRALADGFTFYTENAGLPSLRRALAANYERLHGVTLDPGSEIVVTASGVQALNLGIRCVLNPGDEAIALTPAWPNGSSSIMMANAAVRQIPHPLCGERYRVDFDALEAAVTPRTRLLLYTSPSNPLGWVATGEEQQGLLDFARRHNLWLMADEVYDRLYYAGERLGDPVPSILQRATREDAVMVVHSFSKSYCMTGWRVGWLVARRDLAAKATQLNEFIISHAPTFAQKAAETALAEGEPELARMLERLKENRDLCLEALRGLPGITVPKPDGAFYLFPRVEGMTDSFGFCRGLLEETRVGLAPGVAFGEGGEGSFRICYAAERSILEPAMERLTKFLRKGAHR

SEQ ID NO: 13058 - protein, 468 aa, Vibrio angustum S14
MLLPVIMAGGSGSRLWPLSRTLYPKQFLALTSNATMLQETVKRLDGIDHQAPLLICNEEHRFIVAEQLRKGGMDNSGIILEPVGRNTAPAIALAALKAVVNDEDPLLLVLAADHVIQDTDAFLASVQHAKAEAEKGKLVTFGIVPTHPETGYGYIARGDAINNNAYYVNAFKEKPVLELAKKYVNSGEYYWNSGMFLFKASRYLAELEKYSPDILKACQAAINTATQDLDFTRLDKDIFECCPDDSIDYAVMENTKDAVVVPMDANWSDVGSWSALWEVNEKDASGNATRGDVLVENTSNSYIFSQNKLVATVGVDDLIVVETKDAVLVAHKDKVQDVKGIVGQLKQASRYEYLQHREVYRPWGTHDEIAEGDRFHVKHVMVKPGERTATQMHYHRAEHWVIVKGTAKVINGDKSYLLSENESTYIPIGSPHSIANPGQIPLELIEVRSGAYLSEDDVVRLEDYGVGY

SEQ ID NO: 13059 - protein, 351 aa, Oceanobacillus iheyensis HTE831
MKAAVWYGKHDIRVENKEEPIIKPGKVKIKVAWTGICGSDLHAYHGAEGVVQVGEPHPVTGEMAPLTLGHEFSGVIHEIGEGVSGLSVGDRVAIEPAIKCGKCENCVRGNYNLCEHNGFVGLQSDGAFAEYAIVDPHMVHKLPDNISFEEATAIEPTAVSFHALKLSNMKAGDTVAVFGVGPIGLTAILCAKAAGASRIYAIDVSNERLEMAQKLGATTVINAIEENAAEKIYAETGSGVTIAFDCAGAEATVNSAIDSLAKGGQLVIVSIIPEPIKVNLLQANLKEINILATIGYRDVYKDVIAMVESGQLDLKPIITKKIGLDDIIEEGFHALTNDKSQAKILVSPTGV

SEQ ID NO: 13060 - protein, 279 aa, Silicibacter pomeroyi DSS-3
MSATARKTAPNAQDIRARKGGVPLVSLTAYTTPMARLMDGHCDFVLVGDSVGMVLHGLNSTLGVTMEMMILHGQAVARGLDRAMLVIDMPFASYEEGPAQAFRNAARLMAETGAGAVKLEGGVEMAETIRFLVKRGIPVMAHIGLTPQSINTLGGYKVQGRDDQAQAVLADARAVADAGAFSVVLEKVPATLADRITAEVAIPTIGIGASAGCDGQILVVDDMLGFFTAFKPKFVKRYADLGPLAEAAIAEYAAEVRARSFPAAEHVFGDQAPAKGAKA

SEQ ID NO: 13061 - protein, 1207 aa, Lycopersicon esculentum
MKAHKTVFNQHPLSLNKLFFVLLLIFFLPPASPAASVNGLYKDSQQLLSFKAALPPTPTLLQNWLSSTGPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPIPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 13062 - protein, 218 aa, Vibrio cholerae O1 biovar eltor str. N16961
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLESKINGIAGVVTVGLFAHRGADVVITGTPQGAKIEE

SEQ ID NO: 13063 - protein, 497 aa, Salmonella typhimurium LT2
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQKMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 13064 - protein, 837 aa, Shewanella sp. MR-4
MSHNSELSPNTSGVPPKKRATKAAPSQPKATLDPCEPCDALPATFNRHVRYGLSRGEVAHGELFQALALSVKEQMLDEWRETRIKDSCYDNKQVAYLSLEFLMGRALGNALLNLDLEQDSREALSQYSVSLEELEEAEHDAGLGNGGLGRLAACFLDSCASMDLSVTGYGIRYEYGMFAQKIVDGYQVERPDRWLREGNPWEVRVPHHNVTVKFFGHTESYVDKQGRRHMIWVDTQDVLAVAYDMPVPGYRNGRVNSLRLWKAEATDDFDLAEFNQGDYTEAVACKNLAEQITMVLYPNDASENGKELRLRQQYFLSSASLQAILKRWVHHHGHDFSDFAAKNVIQLNDTHPSIAVPELMRLLVDEYGLEWDAAWAITSQTMAYTNHTLLPEALERWPVRMMALMLPRILEIIYEINARYLDLVAHHWPGDGAKLASMSIIQDGPDPHVRMAYLAIVASFSVNGVAALHTQLLKSGLFKDFYSLWPEKFNNRTNGVTPRRWLAHCNPALAKLLTSHLGKGWVTDLSQLTALNALTQDASFIQKWREVKQANKVQLAKMIAKECGVEFDPAMLFDVQVKRIHEYKRQLLNILHVIHLYHQIQQGHTEHLVPRCVLIGGKAAPGYFMAKLIIKLASNVAHMVNCDPVVAPYLRFAFLPNYNVSAMEKICPGTDVSEQISTAGKEASGTGNMKFMMNGALTIGTLDGANIEMLEEVGEDNFFLFGLNAEQVTQMRCDYQPQRIIAESHALSEVMALLKSGHFNLLEPGIFDPIIASIESADDQWMTAADFDSYRLAQEAVAKAYKDPKKWTQMSIRNTAASGRFSSDVTIAGYRDDIWKL

SEQ ID NO: 13065 - protein, 561 aa, Synechococcus elongatus PCC 6301
MTLPEDFQFDAIADAIAEIKAGRSVVVVDDENRENEGDLICAAQFATPEKINFMAVEARGLICLAMTGDRLDQLDLPLMVDRNTDSNQTAFTVSIDAAPHLGVSTGISAEDRARTIQATINPLTKPHDLRRPGHIFPLRSREGGVLKRAGHTEAAVDLARMAGLYPAGVICEIQNPNGSMARLPDLIDYARQHRLKLISIADLISYRLQHERFVIRETIATLPSEFGQFTIFAYRNSLDGSEHVALVKGDPSRFSQQPVMVRVHSECLTGDAFGSLRCDCRMQLQAAMKMIENAGQGVIVYLRQEGRGIGLINKLKAYSLQDLGLDTVEANARLGFPADLRNYGVGAQILNDLGVTRIRLITNNPRKIAGLKGYGLEVVDRVPLLIEATPYNSSYLATKGEKLGHLLLKTHLAAIALHLTPELQNNPYRQTLIGQIRSLVQGEGLFLQEELRSVASALFGPQVLTLQVGLAQSEAIAADWYRSPDSPLADQLQHCLEQMAAIDGLEDLEFLLADGHDPLTSLQVQLDRQSLPLPDLSRQFKTLKLQQIYHLQLQERPSFVS

SEQ ID NO: 13066 - protein, 453 aa, Methylobacillus flagellatus KT
MKSPAEVTSIQNAMKDKGIKYCIGAYVDIHGVPKAKVVPIDHLPQMAAGSERYTGYALDGLGQAPSDDELTSIPDLDHIIQLPWEPKVAWMPADNGFQGQPYALNTRVALKNVLAQAAAMGFGMNLGIECEIYLLKQEADGKLAIPNPDDKLVKPCYDVRGFMDNFGWLDKMATAINSLGWDLYSFDHEDGNSQFEFDFNYSDVLTMCDRFTFFRYMAKHYAKEEGLLATMMPKPFADKTGTGAHFNMSLYDLDTGKNLFACDPKDDPRGLGLTPLGYHFIAGILKHGAALCAVFAPTVNSYKRLVRRGAMSYFSWAPVFNSYGSNNRTNSVRVPQGGGRCESRNADGAVNPYLAAALVLAAGLEGIREKLDPGAPNEDNLYAINDEEREKRGIHFLPQTLQEAVACFAADGLMEKTLGKELRDEFITYKSQEWDAYHLSISQWEVERYSYMF

SEQ ID NO: 13067 - protein, 497 aa, Ralstonia solanacearum
MTRTDLPPAPITLNDPALWRTQAFLAGAWTDADDGSTRDVTDPATGRVIGTVPAMGAAETRRAIEAAQAAQRAWRKVTARERARILRKLADLMLEHQQDLARILTAEQGKPLPEATGEIAYAASFIEWFAEEARRVYGDTIPAPQGDRRIVVNKEPIGVTAAITPWNFPIAMMTRKVGPALAAGCAMVVKPALETPYSALAFAELAARAGVPAGLLSIVTGDAQGIGGELTANPVVRKLSFTGSTAVGRLLMRQCADDVKKLSLELGGNAPFIVFDDADLDAAVEGAMVAKYRNAGQTCVCANRFYVQRGIYDAFAARLSEAVRALRVGNGAEPGVQQGPLIHQRAMDKVRAHVDNAVAQGARVLVGGKPHALSAQGGAFFEPTVIVDARPGMLVAHEETFGPLAALIPFDTEDEAVAAANDTEFGLAAYFYTRDLGRAWRVSEALESGMVGVNTGLISTAEAPFGGVKQSGLGREGSKYGIDEYLEIKYVCMAGLG

SEQ ID NO: 13068 - protein, 449 aa, Streptomyces avermitilis MA-4680
MSQHTFVAGTAPGAVPVVGHAWQMMRRPLHFMSSLSAHGDLVKIRIGPTSAYVPCHPELLRQVLTNDRVFDKGGVFYDRARDIAGNGLVTCPYRDHRRQRRLMQSAFQRTQLERYSTAMRAEIDATAARWHDGTVIDAFPELYGMALRTVARTLYSTPVTEELAQRVEQAFDTVLNGLFRQMFLPHSLRRLPTPANLRYRNNLRFLHDTVQDLITEYRRDDTQRDDLLSALLASRDEDGGRLGDTEIHDQVITVMAAGTETVAGTLTWIFHLLSRHPEIEARLYEEIDTVLDGKPPHWDDLPSLSLTDRIITEALRMYPPAWIFTRLTASDVDLAGVRLPEGTTIVFSPSSVQRHSEAYDDASRFDPDRWLPDRTSAVARQAFTAFGTGARKCIGDLFARTEATLALATMLSQWRVTVEPDADVRPVALATVYHPRRLRLRLTARTPGQ

SEQ ID NO: 13069 - protein, 145 aa, Glycine max
  misc_feature (29)..(29): Xaa can be any naturally occurring amino acid
  unsure (1)..(145): unsure at all Xaa locations
WSFPHRSLLQTNELYQLASVAFCLLVAWXDKLGLSLELDSFATGVMISTTDLGQHTLEQVEPIRNFFAALFLASIGMLIHVHFLWNHVDILLAVVILVIIIKTIVTISVVKGFGYNNKTSLLVGMSLAQIKEFAFVLLIVLQYSF

SEQ ID NO: 13070 - protein, 252 aa, Aspergillus oryzae
MPQTLVLITGANQGLGYSTAEQLAKTGKYHILLGARTKSKAESAIQRLASDPTIDSSTLTPLVIDANDDTSITAAAKSVSDQFGSLDILINNAAISKPQDPNLSLRDNFRAVFETNVFGVAVIVDTFLPLLRASKYHDRRIVNVTTGLAQMSVAYSPTSEYGARRTPLPVYRSSKAALNMLTAVEGVTLEKENILVVSTSPGYCRTNFTGGHGVKDASQGAMNIVRAATEGDPKTLLGTIVAEEYRVEDIGW

SEQ ID NO: 13071 - protein, 976 aa, Arabidopsis thaliana
MGFFSTILGFCGFGVGISLGLVIGYVLFVYLLPNDVKDPEIRSIADQDPKAMLRMLPEIPLWVKNPDFDRVDWINRFLEYMWPYLDKAICKTAKNIAKPIIEEQIPKYKIDSVEFETLTLGSLPPTFQGMKVYLTDEKELIMEPCLKWAANPNILVAIKAFGLKATVQVVDLQVFAQPRITLKPLVPSFPCFANIYVSLMEKPHVDFGLKLGGADLMSIPGLYRFVQEQIKDQVANMYLWPKTLVVPILDPAKAFRRPVGIVHVKVVRAVGLRKKDLMGGADPFVKIKLSEDKIPSKKTTVKHKNLNPEWNEEFKFSVRDPQTQVLEFSVYDWEQVGNPEKMGMNVLALKEMVPDEHKAFTLELRKTLDGGEDGQPPDKYRGKLEVELLYKPFTEEEMPKGFEETQAVQKAPEGTPAAGGMLVVIVHSAEDVEGKHHTNPYVRIYFKGEERKTKHVKKNRDPRWNEEFTFMLEEPPVREKLHVEVLSTSSRIGLLHPKETLGYVDIPVVDVVNNKRMNQKFHLIDSKNGKIQIELETNEEFAKSHVEEALNIPGTFKTDEGRVINPDFLSQVASVCKKDKHLIVACNAGGSRACVELLNEGENYEDWAKHVRNASRTKQKLGFIDGTLEKPTKEDDMEQVEEAQVLWDDLKLTFSPGNEPVCCERCAMKMMIGAGEECGDVYVFRGEQIKDQVVNIALRRHVGILHVKVVKAVVQRKKVQMGMINPYVQIELSEDKISSKKTTVKHKNLNPEWNEEFKFSVRDPKTQVLEFNVYGWEKIGKHDKMGMNVLALKELAPDERKAFTLELRKTLDGGEEGQPGKYRGKLEVELLYKPFTEEEMQAVQKAPEGTPVAGGMLVVIVHSAEDVEGKHHTNPYVHIYFKGEERKTKNVKKNKDPKWNEEFSFMLEEPPVHEKLHVEVFSTSSRIGLLHPKETLGYVDIPVVDVVNNKRMNQKFHLIDSKNGKIQIELDWQTAF

SEQ ID NO: 13072 - protein, 334 aa, Xanthomonas axonopodis pv. citri str. 306
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 13073 - protein, 186 aa, Carica papaya
FGSVYKGFIDDKLRPGLKAQPVAIKLLDLDGSQGHKEWLTEVIFLAQLRHPHLVKLIGYCCEEEHRLLVYEYMPRRSLENQLFRRYSVSLPWSTRMKIAHGAAKGLEFLHEAENLVIYRDFKASNILLDADYNPKLSDFGLAKDGPEGDDTHVSTRVMGTQGYAAPEYIMTGSHLTAKSDIYSFGI

SEQ ID NO: 13074 - protein, 921 aa, Arabidopsis thaliana
MDLEEQERDILIQTDDDDCHVDVSYVNDDDDSNASFSLSQNDSAFWPQSYRHSVDLLTGVTPPMVSFIQGRSTETSFSSSIASLYKRRPTSIANSFVSSTSKQPLLSEKDDVSFLSSQVGLSNTDLSYGEPNFCSFPQSVLNGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKALDLANLPVAIGIFGFGFSGHAVLPSIYSSMKEPSKFPLVLLISFGFCVFFYIAVAICGYSMFGEAIQSQFTLNMPQQYTASKIAVWTAVVVPMTKYALALTPIVLGLEELMPPSEKMRSYGVSIFIKTILVLSTLVVALTFPFFDWNMRFHHNLWHCKRLLRDVLRHWKISRRIELDETTTMELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSSLYFGCRTYIPILRDHGGFDGIIPRNAYSNWNMRIHHNLWHCKRLLRDVLRHWKISRKTGL

SEQ ID NO: 13075 - protein, 501 aa, Xanthomonas axonopodis pv. citri str. 306
MCVKFRGFYREAIMKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGARIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 13076 - protein, 365 aa, Zea mays
  misc_feature (67)..(67): Xaa can be any naturally occurring amino acid
  misc_feature (92)..(92): Xaa can be any naturally occurring amino acid
  unsure (1)..(365): unsure at all Xaa locations
CHRFYLQLYTKNLHLDEKVDLQTVAVFLHGYVGADLKALGRGAAKLCISINGKLIGRGDKVLKLLFXDWECARSMVGPSITRGVTKEISIVXWDDIGGLKDLKKELQKAVEWPIKHAAAFSRLGIPPVRGVLLHGPPGCSKTTLAKAAAHAAQASFFSLSGADLYSKYVGEGEALLRRTFQKARLASPSIIFFDEADAIAPKRTGPGGNSSGNATVGERLLSTLLTEMDGLELATGIIVLGATNRPNAIDAALLRPGRFDKVLYVPPPDVEGRHEILRIHTRKMKLGEDVDLWKVAECTELFTGADLEGLCREAGMAALREDISASLIHDAHFQAARSSLSPSLTKAVVDEYSKVDINDPSSRKH

SEQ ID NO: 13077 - protein, 332 aa, Polaromonas sp. JS666
MTIKVGINGFGRIGRNVFRSAVQSFSDIEIVGINDLLEPEYLAYMLQYDSVHGRFKGEVSVDGNTLIVNGKKIRLTQERDPANLKWNDVGAQVVIESTGLFLDKTSAEKHLAAGAKKVIISAPSKDDTPMFVFGVNDKTYKGEAVISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTCELSKEATLKEICAEMKAQSEGALKGVLGYTEDKVVATDFRGDARTSIFDADASIALDSTFIKVVAWYDNEWGYSNKCLEMVRVVAG

SEQ ID NO: 13078 - protein, 444 aa, Moorella thermoacetica ATCC 39073
MDDKEKRAAVLQQAEEWGVKFVRLQFTDIFGVLKNVAIPVDQLPKALNNELMFDGSSIEGFVRIEESDMYLRPDPDTFVVFPWRPHEGSVARLICDVYNPDGTPFAGCPRSTLKRVMAEAAEMGFTMNAGPEAEFFLFHTDADGRPTLETQDRAGYFDLTPVDLGEDARRDMVLTLEQMGFEIEASHHEVAPGQHEIDFKYAEALTTADRIATFKFVVRTIAQRHGLHATFMPKPIYGINGSGMHANLSLSKDGKNAFDDPSDELGLSQVAYHFIAGIMAHARALTAVTNPTVNSYKRLVPGYEAPVYIAWSPRNRSPLIRVPAKRGASTRIEVRHPDPSCNPYLALAVLLKAGLDGIKKGLTPPPPTDKNIFAMTPAELKAEGIGVLPGSLEEALAALEQDEVIREALGPHIYERLTLAQKMECEEYRTRVHQWEIDQYLTKF

SEQ ID NO: 13079 - protein, 515 aa, Zea mays
MAARFLLVVAVALLLRPGDASVHEYRGLSFANKGNAFILHAGSEGLYAASHANTTAEDAAAVAEAFIRFDKITFRRSEDTNNSVKETSSAKVQVLVFEIEDREMIGGSAYGGQKAICCSSDLAKLGACTEGSVIYRPSQVNPGWPKLFVASFEGSDLIATLPSRTIQITKTGMYNMYFIHCDPSLASLEIEGKTIWKNPTGYLPGRMAPLKNFFGLMSFAFVVLGIYWFYQYMKSWKEVLPLQNCITLVITLGMLEMALWYFEYAEFNETGVRPKGITFWAVTFGTVKRTAAEVIVLIVSMGYGVVAPTLGGLTSKVVMLGGTFFLATEILELVENLGAVNDLSGKARLFLVYPVAILDAAFVVWIFISLAKTIGKLQARRLMAKLDIYRKFATALIVSVLVSVGWIGYEIYSKSTDVFNERWQHAWIIPAFWHVLSFLLLCVICYLWAPSQNSMRFSYDASEFFDRKDNLSLIRPATSASKNGWSLSSAPEAKATKDVNTVADFEGDDEENKRE

SEQ ID NO: 13080 - protein, 443 aa, Moorella thermoacetica ATCC 39073
MNEQLTKEDVLQMVEEMNVRFIRLQFTDIFGVLKNVAITPAELEKALDGELMFDGSSIHGFVRIEESDMYLRPDPTTFAIFPWRPMDGAVARLICDVYNPDGTPFAGCPRGVLKRVLAEAEAMGYTMYAGPEAEFFLFHTDGQKPTLVTHDQAGYFDLSPVDLGEDARRDMVLSLEAMGFEVEASHHEVAPGQHEIDFKYDNALATADKIATFKFVVRTIAQRHGLHATFMPKPVAGINGSGMHTHQSLFKEGQNAFYDPDDPLQLSKVAYYYIGGLMHHARALAAITNPTVNSYKRLVPGFEAPVYIAWSPRNRSPLIRVPAKRGASTRIELRNPDPSCNPYLALAVMLKAGLDGIKKQIQPPAPTERNIYEMTPAERRDLGIGSLPGDLKDALAELSRDEVIREALGDHIYQHFVEAKEKEWEQYRIQVHQWEIDHYLTLF

SEQ ID NO: 13081 - protein, 346 aa, Coccidioides immitis RS
MNTDIGQHVLKNPGVAQAIVDKADLKQSDVVLEVGPGSGNLTVKILEKAKKVIAVELDPRMAAEVTKRVQGKPEQKRLEVLLGDVIKTDLPYFDVCISNTPYQISSPLTFKLLATTPAPRVCILMFQREFAMRLFAKPGDKLYSRLSVNAQMWAKIDHIMKVGKNNFKPPPAVESSVVRIVPKTPRPDISYDEWDGLLRIAFVRKNKTLRSSFLGTSSVLSMLESNYTTWCAQNDIPVEVGPDDDVEDEGMDIEYGQENDGFDELMDVDDEGDIPDFFKDKPDPTTQVPKTKPTKKHGKVAKLVRKKVRQVLEDDTGLADKRARMCDEGDFLKLLWSFNQRGIHFN

SEQ ID NO: 13082 - protein, 954 aa, Vibrio sp. Ex25
MTELLQSLSTQNEFVGRHNGPSKSDQQKMLDAINAVSLDALIEETVPAQIRLEQPMTLAEAKSEADMLVTMKQFAKQNQIKRTFIGQGYYNTFTPNVILRNVLENPGWYTAYTPYQPEISQGRLEALLNFQQMIIDLTGMEIANASLLDEATAAAEAMTLCKRAGKSKSNVFFVADDVHPQTLEVVKTRAKFIGFEVLVGSLESLPEQDVFGALVQYPSTTGEVRDLTDIIAKAQANKTLVTVATDLLASTLLKPAGEMGADVAIGSAQRFGVPMGYGGPHAAFMATRDKHKRTMPGRVIGVSIDTNGNQALRMAMQTREQHIRREKATSNICTAQALLANMASFYAVYHGAEGLRTIARRTHHMTAIIAAGLTKGGFELAHNSFFDTITINTGSKTEELYAKALSADINLRLLPGKLGISCDETTTVADVEALFAVFGVKEDVAALSTEIGGNEFAAIPEALRRTTEYLTHPVFNTHHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDEEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIEDGVEGEDFAVSAADMGSASILPISWAYIAMMGEAGLTDATKVAILNANYVMETLRQHYPVLYRGKNGRVAHECIIDIRPLKEETGISEEDIAKRLMDYGFHAPTMSFPVAGTLMVEPTESEDLEELDRFCDAMIAIREEMEKVKNGEWPLENNPLVNAPHTQVDLSAEEWDRPYSRELGCFPSKATKSWKYWPTVNRVDNVYGDRNLICSCPSIDNYED

SEQ ID NO: 13083 - protein, 409 aa, Vibrio cholerae O1 biovar eltor str. N16961
MAKVSLEKDRIKILLLEGLHPSSVEVLQAAGYSNIEYHKGSLEEAELIKAIKDVHFVGIRSRSNLTEKVINAAEKLVAIGCFCIGTNQVDLNAAAKRGIPVFNAPFSNTRSVAELVLGEILLLLRGIPEKNALAHRGIWKKSADNSYEARGKRLGIIGYGHIGTQLGIIAENLGMHVYFYDIESKLSLGNATQVHTLSELLNKCDVISLHVPETAGTKNMMGAEEFARMKPGAIFINAARGTVVDIPALCNALESGHIAGAAIDVFPEEPASNKEPFESPLMKFDNVILTPHVGGSTQEAQENIGIEVAGKLAKYSDNGSTLSSVNFPEVSLPEHRSCSRLLHIHANRPGILTQINTIFAEEGINIAAQYLQTTAEIGYVVIDVETARSEEALTKLKAIDGTIRARILH

SEQ ID NO: 13084 - protein, 430 aa, Thermobifida fusca YX
MATHLKSHELFNRARSVIPGGVNSPVRAFKAVGGTPPFMVSGKGPYLTDADGNTYVDLICSWGPLILGHAHPAVVEALAKAAAQGTSYGAPTEAEVELAEEIVSRTPVEKVRLVNSGTEATMSAIRLARGATGRAKVVKFAGNYHGHVDALLAAAGSGVATFALPDSPGVTGASAADTIVLPYNDIAAVEAAFAEAGDEIACVIAEACPANMGVVPPRDGFNAKLREITARHGALLILDEVLTGFRVSPSGWYGLEGVAPDLMTFGKVMGGGLPAAAFGGRADLMDQLSPEGSVYQAGTLSGNPLATAAGLATLRNATPEVYAHIDAAAARVSAAVSEALTAEGVPHRIQHGGNLFTVFFTDTEVVDFDGARAQNTARYAAFFQAMLEQGVYLPPAAFEAWFFSAAHDDAALDRVVSALPAAAKAAAQVA

SEQ ID NO: 13085 - protein, 97 aa, Glycine max
  misc_feature (72)..(72): Xaa can be any naturally occurring amino acid
  misc_feature (86)..(86): Xaa can be any naturally occurring amino acid
  unsure (1)..(97): unsure at all Xaa locations
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 13086 - protein, 961 aa, Streptomyces coelicolor A3(2)
MTAHRTPLSELEQAMPFEQRHIGPDHEARAKMLAQVGYGSLDELTAAAVPDVIKNADRLDLPGARSEAEVLAELRSLADRNQVLDSMIGLGYYGTFTPPVILRNVMENPAWYTAYTPYQPEISQGRLEALLNFQTMVAELTGLPTSGASLLDEGTAAAEAMALSRRMGKNKKGLFLVDADALPQTVAVIRTRAEPTGVEVVVADLSEGIPAEVAEREINGVLLQYPGASGAVRDIKPVIDRAHELGALVTVAADLLALTLLTSPGELGADIAVGTTQRFGVPMGFGGPHAGYMAVHEKFARSLPGRLVGVSVDADGNKAYRLALQTREQHIRREKATSNICTAQVLLAVMAGMYAVYHGPEGLRAIARRTHRYATITAAGLAAGGVEIVHGSYFDTVTARVPGRAAGIVHAARENGINLRLVDADHVSFACDETTTRAQVGGVWHAFGVEGDIESLDAEAGETLPEALLRTDDFLTHPVFHQHRSETAMLRYLRRLADRDYALDRGMIPLGSCTMKLNATTEMEPVTWPEFGALHPFAPAEQAQGYLTLIRELEERLAEVTGYDKVSLQPNAGSQGEFAGLLAVRGYHRANGDEQRTVCLIPSSAHGTNAASAVMAGMKVVVVKTAEDGEIDVEDLRAKIDKHRDELAVLMITYPSTHGVFEEHVADICAQVHDAGGQVYVDGANLNALVGLAKPGHFGGDVSHLNLHKTFCIPHGGGGPGVGPVGVRSHLAPYLPNHPLQPAAGPQTGVGPISAAPWGSAGILPISWSYVRLMGGEGLKRATQVAVLSANYIAKRLEPHFPVLYNGPGGLVAHECIIDLRPLTKATGVSVDDVAKRLIDYGFHAPTMSFPVAGTLMIEPTESEDLAELDRFCEAMIAIRAEIEKVGSGAWPADDNPLRGAPHTADALGGEWDHAYTREEAVFPAGVSAADKYWPPVRRIDQAYGDRNLVCSCPPLDAYED

SEQ ID NO: 13087 - protein, 226 aa, Enterococcus faecalis
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 13088 - protein, 294 aa, Lactococcus lactis subsp. lactis Il1403
MTENNIDRISNIIRTQDILRRHDFNFKKKFGQNFLTDHNILTKITQTAELSKEVNVIEIGPGIGSLTQYLLEEAAEVMAFEIDKSLIPILEETMAPYDNFTLVSADILKVDLLSEIQKFKNPNLPIKVVANLPYYITTPILMHLIESKIPFSEFVVMMQKEVADRIAASPKTKAYGSLSIAVQYYMEASVAFIVPRTVFIPAPNVDSAILKMVRREAPLVEVEDEEWFFKTMHSSFVHRRKTLMNNLQAAFGKESKPEIEKLLAQAEISPTIRGEALSIEEFAKLADALLPLKK

SEQ ID NO: 13089 - protein, 345 aa, Aspergillus oryzae
MFTKSSFSRLASLRHSWRPRYSVPPRFPLFNSILVRYSSYSPMGKTQSDSRKKVTIQTLQSLYTKSEPITALTAHDFPSGHIADAAGMDVVIVGDSLSMVALGMEDTNEVTIEDMLLHCRSVSRAVKYAFTITDLPMGSYELSPEQALQSAIRMVKEGGMQAVKLEGGEQMAPTIRRITQTGIPVLAHIGLTPQRQHSIGGFKVQGKSVAGAVKVLRDALAVQEAGAFMVLLEAVPGEVAALITERLRVPTIGIGAGVGCSGQALVQVDLIGNFPPGRFVPKFVKTYADVWGEAVRGIEEFKRDVKSRAFPSGEYTYPISEQEMAEFRSLMGEVGQQGVGMASRA

SEQ ID NO: 13090 - protein, 416 aa, Burkholderia xenovorans LB400
MPAVKPILKSNKLLNVCYDIRGPVLEHAKRLEEEGHRIIKLNIGNLAPFGFDAPDEIIQDMILNLPGSSGYSDSKGVFAARKAIMHYTQQKGVHGVELDDIYIGNGASELIVMALQGLLNDGDEVLLPAPDYPLWTAGVSLSGGTPVHYICDESNSWMPDLDDIRAKITPNTRALVVINPNNPTGALYSDELLLGLIEIARQHGLVIFADEVYDKIVYDGKKHTSMAALSEDVLTVTFNSLSKSYRSCGYRAGWMFISGLTAGENRRHAKDYFEGLGILASMRLCPNVPGQYAIQTALGGYQSINDLIVPSGRLYKQRELAYDMLTAIPGVSCVKPEAALYMFPRLDPKIYPIQDDQQFILDLLLEERVLLVQGTGFNWPTPDHFRVVFLPNVDDLADSINRIARFLDGYRKRHTA

SEQ ID NO: 13091 - protein, 236 aa, Myxococcus xanthus DK 1622
MSQQGDGAATARYKQAAAEWAVDGFLQPGMVVGLGTGSTAAFAVQRLAALRAQGRLLDIVGVPTSRATEALARSLGVPVSTLDAHPVLDVTLDGADEVAPDLSLIKGGGGALLREKIVAQASRRVVIVVDAGKLSPVLGTHWPVPVEVMSFGWRSQARFLESLGARVTVRQGAGGEPFLTDQGNLVLDCAFGPIDAPAALAASLGARAGIMGHGLFLNLATDLVVAGPEGVEHRAR

SEQ ID NO: 13092 - protein, 263 aa, Neisseria meningitidis Z2491
MITVNTLQKMKAAGEKIAMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVPAELAKKVTESVSCPTIGIGAGVDCDGQVLVMHDMLGIFPGKTAKFVKNFMQGQSSIQAAVRAYVAEVKAKTFPAAEHIFAD

SEQ ID NO: 13093 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQEVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 13094 - protein, 91 aa, Cryptococcus neoformans var. neoformans JEC21
MDVDKTTLSVEQRMDQKLRSSLEIHHLEFVDTSGNCGMSYAVTIVSPNFAKKITLQRHKLVNQILAEEIAQLHAFSQKTLTPEQWEKEKTK

SEQ ID NO: 13095 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 13096 - protein, 404 aa, Neisseria meningitidis Z2491
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLDDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 13097 - protein, 204 aa, Triticum aestivum
  misc_feature (21)..(21): Xaa can be any naturally occurring amino acid
  misc_feature (45)..(45): Xaa can be any naturally occurring amino acid
  misc_feature (67)..(67): Xaa can be any naturally occurring amino acid
  unsure (1)..(204): unsure at all Xaa locations
APLFLGKHKGPPKPPAPPFWXFFKEVRGPLRPNFFLWDIALLESXLPFSLRNLPKPKAPLTAARTAXANAIYVPPAQQGTIDLQSGILHAEEKDYKTAYSYFFEAFEAFNALDDPRAIFSLKYMLLCKIMVNHADDVAGIISSKASLKYVGPDVDAMKAVADAYSKRSLKYFETALRDYKAQLEEDPIVHRHLSSLLIPWTNSQ

SEQ ID NO: 13098 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 13099 - protein, 238 aa, Hordeum vulgare subsp. vulgare
MAVRPSSVSVRAGASVSAKLTPWRAARAGLGGRVSVSSGRRCGGPVRASLFSPKPAVAMDARPSKVQELHVYELNERDRESPAYLRLSANQSQNALGDLVPFTNKVYNGSLDKRIGITAGICILIQHVPERNGDRYEAIYSMYFGDYGHISLQGPYLTYEESYLAVTGGSGVFEGVYGQVKLNQIVFPFKIFYTFYLKGIPDLPKELLCTPVPPSPTVEPTPAAKATEPHACLNNFTD

SEQ ID NO: 13100 - protein, 358 aa, Pandanus amaryllifolius
MSCFIGKYADELIKTAKYIATPGKGILAADESTGTIGKRLASINVENIESNRQALRELLFTSPGALEYLSGVILFEETLYQKTRDGKPFVDVLTENNVIPGIKVDKGIVELAGTNGETTTQGLDSLGARCQQYYKAGARFAKWRAVLKIGATEPSELAIQQNAQGLARYAIICQENGLVPIVEPEILTDGTHDINKCAAATETVLAAVYKALNDHHVLLEGTLLKPNMVTPGSDSPKVAPEVIAECTVTALRRTVPAAVPGIVFLSGGQSEEEATLNLNAMNKLEVLKPWTLSFSFGRALQQSTIKKWAGKKENVPAAQAPFLARCKANSEATLGKYGGAAPADAAASESLHVKDYKY

SEQ ID NO: 13101 - protein, 589 aa, Shewanella sp. MR-4
MEESSLLTSVLLFLLAAVIFVPLGKRFGAGPILSYLAAGGILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTTVLMLLGRLRHHTWRPSIALGLILAEGGEFAFVLLSQAQLSSIVDDKIAQILVLAIGLSMAVTPMIFTLFRATKPKVVDTRSPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASAAHQHDLAKLIDLSTKGKAELESLMRGDRENVS

SEQ ID NO: 13102 - protein, 469 aa, Pseudomonas syringae pv. tomato str. DC3000
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 13103 - protein, 331 aa, Vibrio angustum S14
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 13104 - protein, 540 aa, Arabidopsis thaliana
MARSVDTEAMTTRDPSSKRGGWKTFPFMIATLLGLSIASFGWVMNLVVFLIKEFNIKSIAATQNSNIVNGCVSMLPVVAAILADSFFGNIPVISVSAFISLLGIILLTMITSLDHLRPPPCETGSILCESPSKLQLGILYIALALVIIGSAGTRFTLASAGANQYEKPKEQGSFFNWYFLTLYTGAITGATAIVYTQENASWKLGFGLCAVANLISFIVFVSGKRYYKHDKPMGSPFTNLIRVVVAATRKRKAVISSREEDYHHGLGREGKTSSAMPSKSFRFFNRAALKTEDDSVNNNWRLCSVQEVEDFKAVFRVLPLLLAIIFVSTPMVTQTSLIILQALVTDRGLGPHFKIPAGSLQVIVIITACIVILMNNCLVYPMYQKLAHKPLTPLQKVGIGHVFIILSMAISAIVEAKRLKTVTNGHSMSVLWLVPPLVIVGIGETFQFPANIELFYREFPESLSMVIGISFYLSTALITLIQKTTKWLPNDINHGRVDNVYWLLVIVGVLNYFLVCAWFYRYRNLNDDDDQEQDPKDDTT

SEQ ID NO: 13105 - protein, 395 aa, Streptococcus pneumoniae R6
MKLSNRVLEMEESVTLAAGARAKALKAEGRDILSLTLGEPDFTTPKNIQDAAIASIRDGRASFYTVTSGLPELKAVVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTAILEEAEVALVTGAGFGAPENVRLSYATDLDTLKEAVERLKAFMGSEND

SEQ ID NO: 13106 - protein, 480 aa, Azospirillum brasilense
MTNASQNSRIHPVILSGGAGVRLWPMSREQYPKQFLPLCSERSMLQDTAGRVSDAARFADPLIVCNQEHRFVIAEQMRQTGRGTARIVLEPVGRNTAPAAAVAALIVAEQDPDGQILLLPADHAIQDQDAFLQAVATAAAAAASGHLATFGIVPTAPETGYGYIRRGGAVEGHGGAFRVAAFVEKPPREQAERYLAEKDFFWNSGMFLLPVRQYLAELERWAPAVLEACRTALARGRSDLDFFRLDEEAFAASPNISIDYAVMERTEAAAVVPCSIGWTDVGAWSALWEIGVKDQGGNVCHGDAVAWDSRGCYVRSEDGALVALLGMEDTVVVATEDAILVAAKDRAQDIKPLVEHLKTQGRSEPLLHRRVHRPWGFYQSLHAGDRFQVKRLTVSPGARLSLQKHYHRAEHWVVVNGTALVTRGDEQILLRENESVYIPLGTPHRLENPGKVPLNLIEVQSGSYLGEDDIVRFDDHYGRS

SEQ ID NO: 13107 - protein, 547 aa, Photobacterium profundum SS9
MSMKMTPKWWHDAVVYQVYPRSFCDSNNDGMGDLQGIISKLDYIKKLGVNVVWLSPVYRSPMDDNGYDISDYQDIAAEFGSMEDMQQLLAEAKQRDIRIIMDLVVNHTSDEHPWFIESRKSKDNPYRDYYIWRQPNEDGSVPDDQGSVFGGGAWEFDDTTGEYYYHIFSKRQPDLNWENPKIQEEVHKMMNWWIDQGIGGFRLDVIDLIGKEIDKKITGNGPRLHPLLQEMNKATFGDKDLLTVGETWDATPETAKLYSNPARNEFSMVFQFEHISLTWKQGDKWNPIALDLPKFKNALTKWQIELADEGWNSLFWNNHDLPRAVSKFGDDGQYRVESAKMLATTLHMMKGTPYVYQGEEIGMTNVAFDSIDDYRDIETLNFYKERTENGVAPETMLAAVHENSRDNGRTPMQWNNNKNAGFSEQQPWLQVNPNYPEINVDAALEDQNSIFYHYQKLIQLRKSLSVIVHGAFEPVFEDHEQVFGYLRSDSQHRLFVLNNFTGEEVTVSMPEPLQTEHAECIICNYESHQQLSSTLTLKPFESFAVLI

SEQ ID NO: 13108 - protein, 379 aa, Triticum aestivum
NKFVQKSRLVPVRFHPRPPLPLRTSRRSAPPPPPSSPPHSRSPLPIDLVPGFAAPADVRGEGSTRAWWAEGRMGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRLTILRGNHESRQITQVYGFYDECLRKYGSANVWKTFTDLFDYLPLTALVESEIFCLHGGLSPSIETLDNVRGFDRIQEVPHEGPMCDLLWSDPDDRCGWGISPRGAGYTFGQDISEQFNHTNSLKLIARAHQLVMEGFNWAHEQKVVTIFSAPNYCYRCGNMASILEVDDCKEHTFIQFEPAPRRGEPDVTRRTPDYFL

SEQ ID NO: 13109 - protein, 296 aa, Capsicum annuum
ISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 13110 - protein, 381 aa, Listeria monocytogenes str. 1/2a F6854
MTKSIRPELRDIQVSGIRTFNTRVTGIPDMIRLTLGEPDFPTPDHVKQAAISAIEENFTNYTPNAGMPELLEAASIYFHEKYDLSYSNKEIIVTVGATEAISVALQTILEPGDEVILPDPIYPGYEPLITLNKAHPVKVDTTETNFKLTPEQLKAHITPKTKALIIPYPSNPTGVTLSKDELSALAEVLKETGIFVIADEIYSELTYHEEHVSIAPMLRDQTIVINGLSKSHAMIGWRIGFLLAPEILTQEMLKIHQYSVTCASSISQKAALEAITNGKDDAFQMRTEYKTRANFTQDRLEKMGFTVIPPDGAFYFFVKLPDEIAENSFDWAVKLAEEAKVAVVPGNAFSEKGDRYFRLSYATSFNNLAEALDRMAQFVEK

SEQ ID NO: 13111 - protein, 321 aa, Burkholderia sp. 383
MTSRQHPLHSGFGAASTANDVLVDLDLDGKTAIVTGGHSGLGLETTRALAQAGATVIVGARNADAAREATRGIAGVEIAALDLADLASVAAFAARFVEARRDVDIVINSAGVMACPETRVGDGLEAQMAVNHLGHYALVNGLWPVLAQGDGARVVAVSSLGHRLSPIRWDDAQFAHGYDKWLAYGQSKTANALFAVQLDALGAPYGVRAYSLHPGKIATPLQRHLTREEMMAQGWVDEHGLPIDPTFKTPAQGAATQVWAATSPRLAGIGGVYCEDCDIAVVTQGNEESGVRPHAIDPEEAARLWAWSAALTGIDAFAVRR

SEQ ID NO: 13112 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 13113 - protein, 262 aa, Candida albicans SC5314
MLVLFFFFFFFTMGCLSLLWLVGTENLSPITATTHKKKKISTHRHQIKNLTSHTQILSLNVIPPLLPSPLYFHTNSIYPFIMRPLTEEETKVVFEKLANYIGRNISFLIDNPENPHVFRLQKDRVYYVQESIAKFATSVSRQQLMSLGTCFGKFTKTGKFRLHITSLPYLAQYAKFKIWIKQNGEMPFLYGNHVLKAHIGRMSDDIPEHAGVIIYSMNDIPLGFGASAKSTAEARNLPPTGIVAFRQGDIGEYLREEDTLFT

SEQ ID NO: 13114 - protein, 367 aa, Arabidopsis thaliana
MEAVRSTTTLSNFHLLNILVLRSLKPLRRLSFSFSASAMESDASCSLVLCGKSSVETEVAKGLKNKNSLKLPDNTKVSLILESEAKNLVKDDDNSFNLSLFMNSIITHRFGRFLIWSPRLSSTHDVVSHNFSELPVGSVCVTDIQFKGRGRTKNVWESPKGCLMYSFTLEMEDGRVVPLIQYVVSLAVTEAVKDVCDKKGLPYIDVKIKWPNDLYVNGLKVGGILCTSTYRSKKFNVSVGVGLNVDNGQPTTCLNAVLKGMAPESNLLKREEILGAFFHKFEKFFDLFMDQGFKSLEELYYRTWLHSEQRVIVEDKVEDQVVQNVVTIQGLTSSGYLLAVGDDNQMYELHPDGNSFDFFKGLVRRKI

SEQ ID NO: 13115 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 13116 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVANFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 13117 - protein, 476 aa, Bartonella quintana str. Toulouse
MLFDEKHNKLKRSLQNRHVQMIALGGVIGTGLFYGSTESIRLAGPSTILAYLFGGLIMYFIMRMLGEMSVEEPTSGAFSFFAYKYWGSLAGFITGWNYWFLYILVSMTELTVIGFYLDHWLLIDHWKSSFIVLLLVTLINLLNVRFYGEFEFGLALIKVAAVVGMIVFGIFLIVTEIGENQASISHLWDHGGFFPYGAMGVVLATCVVMFSFGGTELIGIAAGEVSNPQKTIPIAIRKVMWRIVIFYIGSISVIMMISPWNMIGKDVSPFVKIFEIIGIPAAGHILNFVVIMAAISVYNSGIYSNGRMLYSLAIQKNAPHIFSKLSAARVPYVAILFSSICTAIIIVMNAFVPNNSFMRIMALATAAAIITWSIIVIVHLKFRKVHKDRKGAFIYAFALYPYANYLCLCFLAALFCIMFVSGFGKNGLMAQLFNVVGISASSVESYIPAQMPDMSLAVIIIPLWCLLLLLGYKLKR

SEQ ID NO: 13118 - protein, 463 aa, Lactobacillus sakei subsp. sakei 23K
MGLGTRLFRKESLERYLQQDQRLAKTLTAKDLIALGVGAVIGTGIFILPGTIAALHSGPAITLSFMIAAVVCAVAAMCYAEFSSALPVAGSAYSYGNIIFGELIGWLLGWALFLEYMLSVAAVSTGWSAYFVSFIEGFGVHIPKAITGSFDPAHGTYINLFAVLIVTLISVLLMSGTRSSTRINNLMVMIKIGVVLLFLVVGIFYVKSSNWQPFMPFGVSGVFKGASLVFFAYLGFDCVSASAAEVKNPQKNLPIGIIGTLVICTLLYILVAFVLTGMVSYRELNVANPVAFALQVVHQNWFAGLLSLGALAGMFTMMLTMTYSSSRLVYSIGRDGLLPKMLGKIETRHQTPINSVRVVTVIIATLGGLVSLDQLTNLVNIGTLIAFFFMSIGVIPLRKRKDIPNKDGFKVPLYPWLPLLSGLLCLFMLFELPAVTWMAAGIWFILGLIIYFSYGLKHSRLND

SEQ ID NO: 13119 - protein, 246 aa, Arabidopsis thaliana
MLFLISFSNFSEIPVGSVCVSDIQLKGRGRTKNVWESPKGCLMYSFTLEMEDGRVVPLIQYVVSLAVTEAVKDVCDKKGLSYIDVKIKWPNDLYLNGLKIGGILCTSTYRSRKFLVSVGVGLNVDNEQPTTCLNAVLKDVCPPSNLLKREEILGAFFNKFENFFDLFMEQGFKSLEELYYRTWLHSGQKVIAEEKNEDQVVQNVVTIQGLTSSGYLLAIGDDNIMYELHPDGNSFDFFKGLVRRKL

SEQ ID NO: 13120 - protein, 427 aa, Photorhabdus luminescens subsp. laumondii TTO1
MSQSDILYSQAKQLIPGGVNSPVRAFNGVGGTPLFIKHADGAYLYDVDGKAYIDYVGSWGPMVLGHNHSAIRNAVIKAAEQGLSFGAPTAAEVEMAQLVTELVPSMDMVRMVNSGTEATMSAIRLARGYTHRDKIIKFEGCYHGHADCLLVKAGSGALTIGQPNSPGVPVDFVKHTLTCTYNDLSSVREAFEQYPQEIACIIVEPVAGNMNCVPPQPEFLPGLRALCDEFGALLIIDEVMTGFRVALSGAQSYYDVEPDITCLGKIIGGGMPVGAFGGRYEVMEKLAPIGPVYQAGTLSGNPIAMAAGLACLKEVSQPGVHQRLTELTDNLAAGLTKSAKAANIPLVVNHVGGMFGIFFTDAETVTCYQDVMNCDIERFKHFFHLMLDEGVYLAPSAFEAGFMSIAHTDEDIQRTVNAAARCFAKLK

SEQ ID NO: 13121 - protein, 444 aa, Streptomyces avermitilis
MVPHAGDARDAEAKHDARTRGWETTMSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 13122 - protein, 437 aa, Nostoc punctiforme PCC 73102
MYNQGAVEGAANIELGSRIFVYEVVGLRQGEETDQTNYPIRKSGSVFIRVPYNRMNQEMRRITRLGGTIVSIQPITALEPVNGKASFGNATSVVSELAKSGETANSEGNGKATPVNAHSAEEQNKDKKGNTMTQAKAKKDHGDVPVNTYRPNAPFIGKVISNEPLVKEGGIGIVQHLKFDLSGGDLKYIEGQSIGIIPPGLDKNGKPEKLRLYSIASTRHGDDVDDKTVSLCVRQLEYKHPETGETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPENFRLTAAISREQKNPQGGRMYIQDRVAEHADELWQLIKNEKTHTYICGLRGMEEGIDAALTAAAAKEGVTWSDYQKQLKKAGRWHVETY

SEQ ID NO: 13123 - protein, 155 aa, Triticum aestivum
MDASATVATGKGKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 13124 - protein, 477 aa, Nostoc punctiforme PCC 73102
MKSRNNKIQKPSNLQTPMTATYNLPDGPQMPRWLRTIKFISQPVKYVDDFAKTYGDTFTIRSSRSDNHIVYFSQPQALEEIFTADSRHFEVGRGNTGLRFLLGDRSFMLVDGDRHQRQRQLLAPPFHGERMRAYGEDIRKITQQVSHEWKIGKPFNIRESMQEITLRVILRVVFGLNEGELFEELRRSLSDLLDFISSPIMSSAFFFRFIQKDFGAWSPWGRILLQRQKVDLLIYTLLRERRAQTDQNRQDILSLMMAARYDDGQGMSDEELHDELMTLLVAGHETTASALTWAFYWIDHLPEVREKLLQELNTIGVNPDLSSVAKLPYLTAVCQETLRIYPIAMTAFVRIVKTPITIMGYELREGTAIVPSIYLAHHREEVYPQSKQFKPERFLERQYSPYEYLPFGGGNRRCIGMAFAQYEMKIVLATVLSEFQVSLVNKRPVHPVRRGLTVATPAGMRMVATPQVKRANTPALV

SEQ ID NO: 13125 - protein, 278 aa, Desulfitobacterium hafniense Y51
MKTTKDFWVMKNEGKKIVMITAYDYPSAKQAEQAGADIILVGDSLGNVVLGYDSTVYVTMEDMIHHGKAAKRGAPNTFIVADMPFMSCHLSIRDTLLNGARLIQETGAQAVKVEGADEMIPHIRALVRAGIPVVSHLGLTPQTAAVLGGFKVRGKDGEAARKMLEDVKECQEAGAFALVLECIPKQLAQEISTNLTIPTIGIGAGVHTDGQVLVYHDILTYGVNRAPKFVKAYANADQLMLKGLQDYADEVRSMNFPDDEHSFTMKEEELKTLYGGRG

SEQ ID NO: 13126 - protein, 123 aa, Glycine max
  misc_feature (120)..(120): Xaa can be any naturally occurring amino acid
  unsure (1)..(123): unsure at all Xaa locations
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGXKIV

SEQ ID NO: 13127 - protein, 149 aa, Treponema pallidum subsp. pallidum str. Nichols
MAFETTFVMLKPGVLQRRLVGEVLSRFERKGLVLTALRLLCVDTATAELHYAEHREKPFYPSLIAYITSAPVVALAFKGENAISLVRTLCGSTRVEHAQPGTIRGDFALRTTTNIVHASDSPESAARELALYFSAQDFVEWRDGNYDFF

SEQ ID NO: 13128 - protein, 455 aa, Bacillus anthracis str. A2012
MIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 13129 - protein, 331 aa, Vibrio harveyi
MTIKVGINGFGRIGRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTDNFVKVVSWYDNEIGYSNKVLDLIAHISK

SEQ ID NO: 13130 - protein, 382 aa, Vibrio parahaemolyticus RIMD 2210633
MTLEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKQAPLEEVCLLGCGVTTGMGAVLNTAKVEKGDTVAIFGLGGIGLSAIIGARMAGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLEDVNKAFDLMHEGKSIRTVIHMDK

SEQ ID NO: 13131 - protein, 367 aa, Shewanella sp. ANA-3
MALHSIEEIIEDIRQGKMVILMDDEDRENEGDLIMAAELVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSELHGIKIGTIAALIEYRNTKETTVVREAKCKLPTRFGEFDMVTFRDTIDNQLHFALVKGEVKPDCLVRVHLQNTFNDLLHSERDQQRSWPLEKAMERISAEGGVLVLLGNQEHTCEILSKVKAFEAEDQGQAPASAKWQGTSRRVGVGSQILASLGVTKMRLLSSPKRYHSLSGFGLEVTEYVAE

SEQ ID NO: 13132 - protein, 377 aa, Streptomyces coelicolor A3(2)
MKAVVYKGPFSVAVEDVEKPDIRHPNDVIVRVTSTAICGSDLHMYEGRTAAEPGIVFGHENMGIVDQVGQGVTGLKKGDRVVMPFNVACGFCTNCAAGYTGYCTTVNPGFAGGAYGYVSMGPWQGGQAEYLRVPYADFNCLKLPEGDAHETDFILLADIFPTGYHGCELADVRPGESVAVYGAGPVGLMAAYSALLRGAKKVFVVDRVPERLQKAEEIGAVPVDFSAGDPVEQIKEQTEGAGTDKGVDAVGYQATAGGTGKEEPATVLNSLVNTVRPTGALGVPGLYVPADPGGPDEQAKQGMLLVAIGKLFEKGLRVGTGQCNVKRYNRQLRDMIIEGRAEPSFVVSHELPLDQAPSGYDKFDKRIEGYTKVVLHP

SEQ ID NO: 13133 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 13134 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 13135 - protein, 925 aa, Medicago sativa
  misc_feature (635)..(635): Xaa can be any naturally occurring amino acid
  unsure (1)..(925): unsure at all Xaa locations
MELQVIRIFRLVVACVLCLCIFIRSASSATKGFESISCCADSNYTDPKTTLTYTTDHIWFSDKRSCRPIPEILFSHRSNKNVRIFEIDEGKRCYTLPTIKDQVYLIRGVFPFDSLNSSFYVYIGVTELGELRSSRLEDLEIEGVFRATKDYIDFCLLKEDVNPFISQIELRPLPEEYLHGFATSVLKLISRNNLGDTNDDIRFPDDQNDRIWKRKATSTPSSALPLSSNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLELIQKMREELLLHNRENEALESWSGDPCMIFPWKGITCDDSTGSSIITMLDLSSNNLKGAIPYFVTKMTNLQILNLSHNQFDSLFPSFPPSSLLISLDLSYNDLDGRLPESIISLPHLKSLYFGCNPYMKDEDTTKLNSSLINTDYGRCKGKKPKFGQVFVIGAITRGSLLITLAVGILFFCRYRHKSITLEGFGGKTYPMATNIIFSLPSKDDFFIKSVSVKPFTLEYIEQATEQYKTLIGEGGFGSVYRGTLDDGQEVAVKVRSSTSTQGTXEFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLTHPQPR

SEQ ID NO: 13136 - protein, 139 aa, Moorella thermoacetica ATCC 39073
MAVERTFSMIKPEGVRRGLVGAILARLEQKGYRIVALKMLRLTPEMAAAHYAEHRDKPFYQDLINHITSGPVVAMVLEGPGVIAGLRRLMGATNPQEAAPGTIRGDFALETSDNVIHGADSPASAEREIALYFTPAELG

SEQ ID NO: 13137 - protein, 949 aa, Bacteroides fragilis NCTC 9343
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQGIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSIGKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 13138 - protein, 319 aa, Yarrowia lipolytica CLIB122
MPPKQKLNEKNKAAKRQERASDKTFGLKNKNKSSKVQRFVQQVEATASGADKKKQAERERKEAEKKAAAAAKAEAAKLFGSVVITQKVPFGVDPKTVLCAYFKEGQCTKGTRCKFSHNLEADRKTQKKDLYTDAREQEKEQGMDTWDEEELRKVILSKHGNPKTTTDIVCKFFLDAIEDSKYGWFWVCPNGGDQCKYRHSLPPGFVFKTKEQKKLEKLALEKQPKITLEDFLETERAKLPKNLTPVTLESFNKWKADRIKAKEEAAAEEARKLTQKQMSGRQLLLTGKYDDDEEDDGTNGTAWDLSEFKPSLDIVDDEE

SEQ ID NO: 13139 - protein, 480 aa, Pseudomonas fluorescens PfO-1
MLIPVILSGGAGTRLWPVSREGHPKPFMTLPDGQSLLGKTYRRAAALLDGWGDIVTVTNREYYFQSKDHYQAAHLSRHRGHFLLEPTGRNTAPAIAAAALSLQALHGDAAIMVVMPADHLIVNEEALKSAVEHAVNLAKDGYLVTFGVVPTAPETGFGYIETGAPLNDRGAAKVQRFVEKPDLQTATHYLESGNFLWNSGMFCFSTATVIAELALHAPELLEQTRACMAASEPVETAGCLQQELSTQLFAEITDISIDYALMERSEKVVVVPAGFDWSDIGSWSAVAALVPADTDNNRASGEAIFIDSRNNFVQSEGRLVAAVGVEDLIVIDTADAVLVAHADRAQDVRRVAKQLKDKSHEAYRLHRTVSRPWGTYTVLEEGPRFKIKRIVVKPGGKLSLQMHHHRNEHWVVVEGMAKVTNNGSGTTLVAKNESTFIAAGHKHRLENPGVIDLVIIEVQSGEYLGEDDIVRFEDQYGRTV

SEQ ID NO: 13140 - protein, 456 aa, Chromobacterium violaceum ATCC 12472
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 13141 - protein, 239 aa, Glycine max
MEAKKIPEVILNSGKKMPVIGLGTASIPLPSHEALTSILIDAFEVGYRHFDTASLYESEESLGKAVAKALELGLINSREELFITSKLWSTDAHPDLVVPALKTSLQKLGLEYVDLYLIHWPVRLKPEAKGYHEAMEECYRLGLAKSIGVSNFGIKKLSQLLENATIPPAVNQVEMSPTWQQGKLKEFCKQKGIHVSAWSPLGAYKSAQGTNAVMESPILKEIACERQKSMAQVLLVSQS

SEQ ID NO: 13142 - protein, 257 aa, Streptomyces hygroscopicus subsp. yingchengensis
MPGTGCPWQGAHSQGTVVAMNDRTALVTGANKGIGKHIARVLVAEGLTVYVGSRDRGLGQRAVEEIGAGARLLVLDVTDLDGIARATTQVDRLDVLVNNAGISPSLAPPADTSVEEFRRTYETNVFGVVAVTNAFLPALRRSPHPRIVNISSGTASLTWSTNPNPQFTPGSGGAAAYRSSKAALNALTVLYAQTLAEDGFKVNALAPGMRATDLNPLAAAAGDDPAEAAQGAARLALLPDDGPTGGFFSWDGTPVPW

SEQ ID NO: 13143 - protein, 542 aa, Prochlorococcus marinus str. NATL2A
MSGSNPAVSINKKKVAPVVLAILDGWGYREEIEHNAVRQASTPVIDALWHAYPHTLIEASGADVGLPDEQMGNSEVGHLTIGAGRIIQQELVRISNTVKENKLIANPALNQFSQSLKKGGGTLHIMGLCSDGGVHSHIKHLCGLIEWAASKGLKNVSLHLFTDGRDTSAKSATKYINTIEAKIKATGVGEISSLCGRYWAMDRDNRWERTSKAYELLTDPRFAISKLSAAESINKSYQEGITDEFIEPVRLSSSFLKDGDGVVFFNFRPDRARQLVKALKLKDFDGFERKNKTDIDVLTFTQYESGLPVSVAFPPEPLNDLLGQVIADHGLNQYRTAETEKYPHVTYFLNGGIEKPLKGEVRHLVPSPRVATYDLQPEMSADELTESCIQAIDTGIYSLVVINFANPDMVGHSGIMKAAIKANEKVDSCIGKLLNSIGKLGGSLLITADHGNSEMMIGPDGQPWTAHTTNPVPVILIEGEKRKLSGYGNDIKLRESGGGLADLAPTLLHLLNLPKPKAMTGKTLIEPINLPKKPNLIPQPAY

SEQ ID NO: 13144 - protein, 94 aa, Zea mays
  misc_feature (67)..(67): Xaa can be any naturally occurring amino acid
  unsure (1)..(94): unsure at all Xaa locations
MAAAAATKASSWMVAMSVGAVEALKDQGGLCRWNYALRSVYRTAKANVRSGSQKLRRAAGQGPGPGXREKGRQDKAAAEEGLRTVMYLSCWGPN

SEQ ID NO: 13145 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 13146 - protein, 563 aa, Erwinia carotovora subsp. atroseptica SCRI1043
MSTSLPWWQNGVIYQIYPKSFQDSTGNGIGDIAGVTARLDYLQQLGIDAIWLTPVYLSPQVDNGYDVADYCAIDPAYGTMADMETLIAEAHRRRIRIVMDMVFNHTSTQHHWFQNAQDRRSPYRHFYIWRDGNDGAPPNNWRSKFGGPAWLWHAESKQYYLHLFATEQADLNWEHPRVRDELKQVCGFWADKGVDGLRLDVINLVSKQQDFPSDTQGDGRRFYTDGPLIHDYLQEFSQDVFQPRGLMTVGEMSSTSLEHCRRYAALDGSELSMTFNFHHLKVDYPNGEKWTLAEPDFIQLKLIFNHWQQGMHNHAWNALFWCNHDQPRIVSRFGDEGEFRVQSAKMLAMVLHGMQGTPYIYQGEELGMTNPGYTQIEQYRDIESLNQFAEQRDRGQVDEQILAILASKSRDNGRTPMQWDESDHAGFTTGTPWITPSQNFPHINAEQSLADKESVFYTYQQLIAMRKALPLLTHGDYKDLLPDHPNVWCYQRTWEGQRLLVLANLSKQPLRWQPPMETHDRRWRLLFSNYSDAQPQPAILELRPFEAIYWIQGMQEKEDKIQE

SEQ ID NO: 13147 - protein, 463 aa, Leifsonia xyli subsp. xyli str. CTCB07
MHLGEDLIILGLLLLVAYALGRLGKLVGLPAIPIYMIVGLLASPNTGWFPLDFESRYIELIAVFGLILLLFNLGLEFDQDEFFGNFGKLIISGGSYILINMGVGLAFGFWVGWGTREALVIAGMTATSSSAIVTKLLIELRRLPNRETPMILGVTVVEDIFIAIYLAIVSVVLSGETALWPVAGKLAIAFAFLVVMFTLARWGGKVFSRLFRTKDDELFTILFFGLAVLFAGIGEILGVTDAIGAFLIGLVLGATKHRNKIEHIAIPLRDVFAAFFFLNFGLELEPAKFSGVLGPVLIAVAMTIALNILAGQVVAWINGMDAQAGINTTVILQNRGEFALILATLSISAGLDPRIQPFAGLYVLIMAVLGPVLAASSERIGALVLRTGKLRRRGRRKPRPPMLDEEIALVEAATADLDSDKPREEKSAAVAAEETRRAVDRLVEQAMQQAGPQNDTTGDRKRD

SEQ ID NO: 13148 - protein, 680 aa, Glycine max
AREKQLPKLVVGLLLIGAGLVLYTNRTERSAQLLQQPEVIAITVEEVSSTAKPLVRELQELPRRIKNIIASLPDQGVRNEEEASLFDMLWLLLASVIFVPIFQKIPGGSPVLGYLAAGILIGPYGLSIIRHVHGTKAVAEFGVVFLLFNIGLELSVERLSSMKKYVFGFGSAQVLAHYICGQAGPAAIVIGNGLALSSTAVVLQVLQERGESTSRHGRATFSVLLFQDLAVVVLLILIPLISPNSSKGGVGFQAIAEALGLAAVKAAVAITAIIAGGRLLLRPIYKQVAENQNAEIFSANTLLVILGTSLLTARAGLSMALGAFLAGLLLAETEFSLQVESDIAPYRGLLLGLFFMTVGMSIDPKLLVSNFPVITGTLGLLICGKTILVCLMGRMFGISLISAIRVGLLLAPGGEFAFVAFGEAVNQGIMSSQLSSLLFLVVGISMALTPWLAEGGQLLASRFELHDVRSLLPVESETDDLQNHIIICGFGRVGQIIAQLLSEQLIPFVALDVRSDRVAIGRSLDLPVYFGDAGSREVLHKVGAERACAAAITLDTPGANYRTVWALSKYFPNVKTFVRAHDVDHGLNLEKAGATAVVPETLEPSLQLAAAVLSQAKLPTSEIAATINEFRSRHLAELTELCEASGSSLGYGYNRTMNKPKSPSPDSLDETPVSEGTLAI

SEQ ID NO: 13149 - protein, 456 aa, Glycine max
MESKNPARFTLGKQSSLAPERHNKEAELQNDGEVVDQGVRLMYSAFEGDVDGICEALESGVSVNYKDIDNRTALHVAVCEGFTDVVDLLLQKGAEVDPKDRWGSTPLADAIFYKKNDVIKLLEKHGAKLLMAPMHVNHAREVPEYEINPKELDFTNSVEITKGTFCIALWRGTEVAVKKLGEDVISDEEKVKAFRDELALFQKIRHPNVVQFLGAVTQSSPMMIVTEYLPKGDLRDFLKRKGALKPSTAVRFALDIARGVGYLHENKPSPIIHRDLEPSNILRDDSGHLKVADFGVSKLLAVKEDKPLTCHDTSCRYVAPEVFRQEEYDTKVDVFSFALILQEMIEGCPPFSAKQDDEVPKVYAAKERPPFQAPAKRYSHGIRELIEECWNENPAKRPTFRQIITKLESIYNTIGHKRHWKVRPLKCFQNLEALLKRDHSNGSSRGGSSRSTSSRI

SEQ ID NO: 13150 - protein, 223 aa, Neisseria meningitidis Z2491
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 13151 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 13152 - protein, 473 aa, Bartonella quintana str. Toulouse
MKNGKQMKSKGSKPVSQFLKNLRGVDNWEQVSQWLALRNVEDIECITPDQAGVARGKMMLSKKFISETSLALPSAVFMATISGDYPEDGHGFEYPKTDGDLRLEPDLSTLSIVPWEEAPTAQVICDLVYQNGQGVDYTPRNVLRKVINFYTKMGLKPVVSPEIEFYLVEKNPDPDYPLVPPIGRSGRSIGGGQGYSIAGVNEFDDLIDDIYHFSEAQGLEIDTLIHEEGAGQFEINLRHGDPIELADQVFIFKRTIREVALKHNMYATFMAKPIQGQPGSAMHIHQSVVDKKTGMNIFTQEDGKENIRFRHFIGGLQRHIPGVLVMLAPYVNSYRRLVPDLSAPVNLRWGYDNRTTAFRVPRSSPQGRRVENRLPSSDANPYLALAASLACGLIGLQQELEPDEPTTKNVNTDNIELPRGLIEAVNLFEQDTAIRAILGDVFVSTYAAIKRQEFETFMEVISPWEREYLLLNV

SEQ ID NO: 13153 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEEGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 13154 - protein, 495 aa, Mesorhizobium loti MAFF303099
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 13155 - protein, 340 aa, Triticum aestivum
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLFKHNKVGTGGGKG

SEQ ID NO: 13156 - protein, 278 aa, Cladonia rangiferina
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 13157 - protein, 360 aa, Atriplex nummularia
MAKVKIGINGFGRIGRLVARVILQSDDCELVAINDPFITTDYMTYMFKYDSVHGQWKHHELKVKDEKTLLFGERPVTVFGNRNPEEIPWGQTGADYVVESTGVFTDKDKAAAHLKGGAKKVIISAPSKDAPMFVVGVNEHEYKSELNIVSNASCTTNCLAPLAKVINDKFGIVEGLMTTVHSITATQKTVDGPSAKDWRGGRAASFNIIPSSTGAAKAVGKVLPALNGKLTGMSFRVPTVDVSVVDLTVRLEKEATYEQIKAAIKEESEGKMKGILGYTEDDVVSTDFVGDNRSSIFDAKAGICLNGNFVKLVSWYDNEWGYSSRVVDLIRHMSKTTSKLDSVALACVDAVSTLILSSEC

SEQ ID NO: 13158 - protein, 378 aa, Zea mays
  misc_feature (121)..(121): Xaa can be any naturally occurring amino acid
  unsure (1)..(378): unsure at all Xaa locations
SESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVMHLSVGDRVALEPGXSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADAAVRVSPRVEDLADEVERIRAAMGSDIDVSLDCAGFSKTMSTALESTRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 13159 - protein, 278 aa, Cladonia subtenuis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASNGELKGIMAYSEDDLVSTDLNGDNHSCIFDAKAG

SEQ ID NO: 13160 - protein, 510 aa, Corynebacterium diphtheriae
MCYRLLAAWGASILRLPPLIGFLAAGFIMSALGLEQIPFIDYIAELGVTTLLFTIGLKLNPHDIASPRVVGTATAHAVVNTIVFAGLFALFAIVGWTGLLYIGIAASFSSTVFVMSQLEVHSRSGSAVGRISIGVLVLQDIIAVGVLVVSAGTTPQLWALFLPLILCLRPLVTRMPDRMFRTELLVLTGVGIAVGAYSFFELAGVSGSLGSLVAGIVLSGHPVSQRLSHALISVRELLLVAFFIHIGLGGIPNAAGLGIAAILVAFLAVKAAVFFAILPLMGMGVRTTILAGLTLANYSEFGLIVTAVAVSHGALPDQWLPIMAIAVGASFIVGSIVSAQEEKLVRILARFVPKVSEHRKAPNERPVIVAGADAIVLGMGRVGVGVYDRLTEEYGMHVYGIEFDEDRIIELRDRGYRIVAGDVTDPELWRRIELLDIPQLFAMSLPRYTDSDKVLARIHHDYPGATVATITQTRGREQALLTAGADVAVYLYEGVGDELADQAVAHLRQG

SEQ ID NO: 13161 - protein, 475 aa, Fusobacterium nucleatum subsp. vincentii ATCC 49256
MSSLKKTKIVCTIGPVTESVETLKELLNRGMNVMRLNFSHGDYEEHGIRIKNFRQAMSETGIRGGLLLDTKGPEIRTMTLKDGKDVSIKAGQKFTFTTDQSVVGDNERVAVTYENFAKDLKVGNMVLVDDGLLELDVTEIKGNEVICVARNSGDLGQKKGINLPNVSVNLPALSEKDIEDLKFGCQNNVDFVAASFIRKADDVRQVRKVLKENGGERIQIISKIESQEGLDNFDEILAESDGIMVARGDLGVEIPVEEVPCAQKMMIKKCNRAGKVVITATQMLDSMIKNPRPTRAEANDVANAIFDGTDAIMLSGETAKGKYPLAAVEVMNKIAKKVDATIPAFYVDGVINKHDITSAVAEGSADISGRLNAKLIVVGTESGRAARDMRRYFPKANILAITNNEKTANQLVLSRGVISYVDASPKTLEEFFILAEVIAKKLNLVENNDIIIATCGESVFIQGTTNSIKVIQVKA

SEQ ID NO: 13162 - protein, 349 aa, Oceanobacillus iheyensis HTE831
MEALNLYGIEDLRYEDTPKPMIEKDDDVIIKVKSVGICGSDTSRYKKLGPYVEGMTFGHEFAGEVIEVGKSVTNFKSGDRVVACPTFSCGNCHYCREGHPTRCVELTVIGARNPGAYAEYTKLPEGHVKILPDSIDDDTAALVEPSAVVAHGFYRASITPGSSVAIMGVGSIGLLAVQWAKIFGASKVIAIDIDDHKLKIAQELGADIVVNPMKENAEGIVKQHTDELGVDLAVESAGSPITSEQVLALPKKGGEVVFLGIPYGDITLKRYYFEKIVRNELRILGSWNALSAPFPGKEWNATLHYMSTGQLNIKPMISHRLGLQAGPEIFHQITNKLSDAVKVIFHPGK

SEQ ID NO: 13163 - protein, 343 aa, Myxococcus xanthus DK 1622
MKGAAMRATVLHKPGDVRFEERAEPKILAPTDAIIRLSATCVCGSDLWPYRGVQAVTEPTPMGHEYCGIVEEVGSAVASVKPGQFVIGSFFASDNTCPHCKAGYQTSCQHREPVSGAQAPRMRVPLADGTLVVTAEVPPDALVPSLLAVSDVFGTGWFAADAANVNPGSTVVVVGDGAVGLLAVLSAKQMGAERIIAMSRHETRQALAREFGATDIVSVRGDEGVARIKELTRGIGADSVLECVGTQESMLQAIGAARPGGFVSYVGVPHGVSLDGEKLFFSHVHLHGGPAPVRRFMPQLIDLVWSRKVNPGKVFDLTLPLEKVAEGYRAMDERRAIKALLRP

SEQ ID NO: 13164 - protein, 300 aa, Triticum aestivum
MVASSNTGLEREDHQRDADFNKAMHGSSAQARGGVAAMFRKGGAAKQAAVDEYFKHWDNKPAENETPEERAARQAEYATLTRHYYNLATDLYEYGWGQSFHFCRFSQGEPFYQAIARHEHYLAHQIGIKDGMKVLDVGCGVGGPAREIAKFTGAHITGLNNNNYQIERATHYAFKEGLSNQLEFVKGDFMQMSFPDNSFDAVYAIEATVHAPTLKGIYSEIFRVLKPGGVFGVYEWLMTDEYDNDNLRHREIRLGIEQGDGISNMCKVSEGIAAIHDSGFEMLHHEDLADRPDALPWYWP

SEQ ID NO: 13165 - protein, 425 aa, Triticum aestivum
MSAMQSSYLPATTESIAMAQEAKDASESILILYRVLEDPSSSSDAVRTKEVAITNLTNYLTKENRAEELRNLLTQLRPFFALIPKAKTAKIVRGIIDAVSKIPGTSDLQISLCKEMVEWTRAEKRTFLRQRVEARLAALLLESQEYTEALTLLPGLIKEVRRLDDRLLLVDIDLLESKLHFSLRNLPKAKASLTAARTAANAIYVPPAQQGTIDLQSGILHAEEKDYKTAYSYFFEAFEGFNALDDPKAIFCLKYMLLCKIMVNQADDVAGVISSKAGLKYVGPDVDAMKAVADAYSKRSLKYFETALGDYKAQLEEDPIVHRHLSSLYDTLLEQNLCRLIEAYSRVEIAHVAEMIELPIEHVEKKLSQMILDKKFAGTLDQGAGCLIIFEDAKTEAIFPATLETISNVGKVVESLYMRSAKIMA

SEQ ID NO: 13166 - protein, 344 aa, Oceanobacillus iheyensis HTE831
MKALVKTELGHGNLHIQNVEEPSVSSHQVKIKVAYAGICGSDIHTYEGHYKVAAPVTLGHEFSGRIVEVGEGVTDFKVGDRVTSETTFSICGECRYCQTGDYNLCNHRKGLGTQQNGGFTNYLIAREESLHHLPDEVDDRSASMTEPLACTYHAIQKINIKPGDLVVVLGPGPIGLLAAQVAKSYGATVMMSGLDNDKIRLDKAKEVGIDYVINIQEEDIKEKIAALTDGYGVDVVLECSGSIHAANQGLDLLRKKGSYAQVGIFPDSHVKFDMEKVIQKEIHVVGSRSQKSADWEPSLQLMKEKKVDAKALVTHEFTIDQWDEAYQAIKDGEAIKVLLKPLQD

SEQ ID NO: 13167 - protein, 404 aa, Vibrio angustum S14
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEIARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 13168 - protein, 399 aa, Oryza sativa
MAVASAWAKPGSWALAAEEQDDLPPPPPPVPAADFPSLATAATTKVPKKKKPQPVPLGEFNSTKFVAPAYRGPTQDDLLSLPTGPRERTAEELANATRGFGARWGGAGAGGPRGDDEPRRGGSGPQDFGPSRADEADDWGAGKKPLERRERMGGFGVDSSMSRADDVDDWVSTKRAAAPAPMERRERSVAFGADSHSRADDSASWISNKGYSAAPPPPSDSRRGGPVWGFNRDGGPDADSWERRREEVSGGGSSGGARPRLNLQKRTLPLANGTDGEGKEDKEEEKGEMQPKSRTSNPFGAARPREEVLAAKGEDWRKIDEKLEAMKMREAPPPERRSFGRRGSPVRGEDNGSRPLPESHVEGAWKKPDAVQAVGESEDGSDKLNTAEAARKFEEGFDN

SEQ ID NO: 13169 - protein, 437 aa, Corynebacterium glutamicum ATCC 13032
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 13170 - protein, 673 aa, Candida glabrata CBS 138
MDEIDANKDILYHYRSSVKVGEIERYLIEYILYEDDEIPDDLKLDSLYVRLKNCSPLSFRAGYLAGPFILYGDVRSNNYHHSQHIVSSADYPQFEANLQAQQVKVMELSLHNIQSKYVWILDVVSQILFTTNTNVPFEVTVGMDRKMLEENNEIECLPHLGSTSNNLIVSRLTTDDLWKLPRELAPKKDIKHLVILTHGLHSNVSADLSYLMEEIYKSQANFPNEILIVDGYFDNVCETEKGVRYLGTRLADYIIDNLYDADVKKISFVGHSLGGLVQTFAIGNLAARYPWFFDKVKPVNFITIASPMLGIVTDNPAYINLLLSFGVVGRTGKDLNLDVDLPDEKPLLYSLSGEFIRSILRKFERRTIYANAVNDGIVPLYTSGLLYLDYDAILKKLREKEENKSLSGPNNITVSDNTAFFNKNFISPLTKMLSLWAPQKFPESDPKIPKVSFFQSAASILLPPLPDINFIVNPKHRNDIIIHDKIYTEEDIKDVEKDPDSSFFNNKNIFLQALSTVTSEKTKYQELEKTIAIRWHKGLSWRKVIVALKPDAHNNIIVRRRFSNAYGWPVIDHLISEHFSGENFEMDSQKDVSITTTREDLNWIKRPDEDGLFKEGPTGMISTVGEIVESFAKKRFSNLVDATASNEESLREIKDEVTQNLDLDMVDIPNETI

SEQ ID NO: 13171 - protein, 296 aa, Bacillus cereus E33L
MVIQWFPGHMAKARRQVTEKLKLIDVVIELVDARLPLSSRNPMIDEIITHKPRLVVLNKADMADDRLTKQWIAYFKEKGHMAISINAQAGQGMKEIAAACKVLVKEKFDKMVAKGIRPRAIRALIVGIPNVGKSTLINKLAKKNIAKTGDRPGVTTAQQWIKVGKEMELLDTPGILWPKFEDELVGLRLATTGAIKDSILNLQDVAVYALRFMEKHYPERLKERYNLNDIPEDIVELFDAIGKNRGCLMGGGMIDYDKTSELVLRELRGGKLGKMTFETPEEFAEQTEDAEKVEEV

SEQ ID NO: 13172 - protein, 318 aa, Mycobacterium avium subsp. paratuberculosis K-10
MASVQRKSWCALTIRLLGRTEIRRLAKELEFRPRKSLGQNFVHDANTVRRVVSTSGVSRSDHVLEVGPGLGPLTLALLDRGAHVTAVEIDPVLAERLPHTVAEHSHSEIQRLTVLNRDVLTLRRDELAEPPTAVVANLPYNVAVPALLHLLAEFPSIRTVTVMVQAEVAERLAAEPGGKEYGVPSVKVRFFGRVRRCGMVSPTVFWPIPRVYSGLVRIDRYPTSPWPTDPAFRRQVFELVDIAFGQRRKTCRNAFVDWAGSGNESADRLLAASIDPARRGETLSIDDFVRLLQRSADRGGTDREGTSPPTAGQGAPAR

SEQ ID NO: 13173 - protein, 472 aa, Pseudomonas syringae pv. syringae B728a
MFTPVILAGGSGSRLWPLSRQSFPKQFLALDGQDQGTMFQRTLARLKGLEHAPAVVVSNENHRFIVAEQLRVAKMGSRRVILEPLARNTAPAIALAALEATADGTDPILLVLAADHHIHDEEAFRQAVAVAQVHAEAGRLVTFGITPTHAETGFGYIHCGESIAQGGFAIEAFKEKPSPEMAAEYLSSGAYLWNSGMFMFRASVFLAELKKHRSDILSACRVALADSDADSYFLHVSAEKFALCADESVDYAVMEHTDLGLVVPLDAGWNDLGSWAAIWDVGPHDENVNRLEGDVMAIDTRNCLVQSHHRLVATVGVEDLIVIETKDAVLVANKHNSQQVKDVVKRLQAEERPEFVTHPLVNRPWGHYDTIDLGERYQVKRISVLPGECLSLQMHYHRAEHWIVVSGTAKVICDDKELILSENQSTYIPLGVKHSLANPGKVPLELIEVQSGSYLGEDDIVRFEDRYGRLKK

SEQ ID NO: 13174 - protein, 269 aa, Moorella thermoacetica ATCC 39073
MAQRSRVTLPQLQAMKERGERITMVTAYDYPSSLLADRAGMDMILVGDSLGMVVLGYSSTVPVTMDEMIHHTKAVVRANPAALVVADLPFLSYQTSVPDAVYNAGRLIKEGGADAVKLEGGQAVVPTVRAIVNAGIPVMGHLGLTPQSAVQLGGFRVQGRSEAEGEKIAADAAALVEAGVFALVLECVPADLARRITAALPVPTIGIGAGPDCDGQVLVYHDLLGLFDRFRPKFVKQYANLAEATVAALEKYRDEVRQGKFPDQEHSFK

SEQ ID NO: 13175 - protein, 497 aa, Glycine max
PIQSRRHRPAPEDQAHQQDQGLSRTPRSQKALQQARGPARGTFHSLRVPALEDSRVCLRVSYRPEFCFTLRSKNEKKGWNLLLLKLVRNKGVVYPVHAVPPEDQVDLETVEPQAQQSEQTNESKFVRVSFQLEKTCNFGEQFLIVGGDPVLGSWDPLEALPMTWSEGHVWAVELDMPAGQTFQYKFILKGEGGDIIWQPGSDRLIHTWETMNRIVVLEDWENVELQEITEEDQLAEPNEEPQVDFEVPTLAEFLNNPQEELDSKALEISSVGDTQIHAVEEPLAETVRQQITGNSISSSMEKPMSIVVENISSSEDLISSISHKSNKKSILQPSEESADSPGNDDIIHDLGQNGNAASLENQEKTIVESSLFDLEEGPVLVPGLTIPPTEPTDEADQGEVQETTKKDTSVEAFETQDQNIAEFSKEEETDDAIPQEINATINNGPELLYNKQHEESHLSPEMEDWPNYEPDDDNTVQNDIKWGQDTVNKFLTKLGFF

SEQ ID NO: 13176 - protein, 221 aa, Zea mays
  misc_feature (71)..(71): Xaa can be any naturally occurring amino acid
  unsure (1)..(221): unsure at all Xaa locations
MSMFNRIFGKPKEQANSSALATLDKLNETLDMLEKKEKVLDKKAAAELERAKEFSKAKNKRAAIQSLKRKXLYEQQIEQLGNFQLRIHDQMIMLEAAKATTETVDALRTGAAAMKAMQKATNIDDVDKTMDEINEQTENMKQIQDALSTPLGASDFDEDELEAELEELEGAELESQLLEPVAALPVHPVHVPGNKQPARPAPQKATAEDDELAALQAEMAL

SEQ ID NO: 13177 - protein, 289 aa, Mycobacterium avium subsp. paratuberculosis K-10
MTGWTAADLPSFAQRTVVITGANSGLGAVTARELARRGATVIMAVRDTRKGEAAARTMAGQVEVRELDLQDLSSVRRFADGVSGADVLINNAGIMAVPYALTVDGFESQIGTNHLGHFALTNLLLPRLTDRVVTVSSMAHWPGRINLEDLNWRSRRYSPWLAYSQSKLANLLFTSELQRRLTAAGSPLRALAAHPGYSHTNLQGASGRKLGDALMSAATRVVATDADFGARQTLYAASQDLPGDSFVGPRFGYLGRTQPVGRSRRAKDAGMAAALWALSEQLTKTEFPL

SEQ ID NO: 13178 - protein, 250 aa, Irpex lacteus
VNSGCGTSGAESCSNSDDGTCCFEAPGGLLLQTQFWDTDPSTGPSDSWTIHGLWPDNCDGTFESSCDASRAYTGIGDLLTAQGASDTLDFMNQYWVDINGQNEQFWEHEWSKHGTCYSTLETSCLPSGSPKGAEAVAFFQQVVTLFKTLPTYQWLAKAGITPDSSKTFTLSEITSALKSAAGVTPALDCDGKNLNQISWYFHLKGSLLDGKFVPIDAPKAGSCASSGLKYPPKSGSGSSSGGSSGGTSGS

SEQ ID NO: 13179 - protein, 569 aa, Shigella flexneri 2a str. 301
MSEEKLGQHYLAALNEAFLGVVLDHAWQTKDQLTVTVKVNYLPEVVEFLYYKQGGWLSVLFGNDERKLNGHYAVYYVLSMEKGTKCWVTVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHPHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGLARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSYAPLIIGSLDPCYSCTDRMTVVDVRKKKSKVVPYKELERYSIERKNSPLK

SEQ ID NO: 13180 - protein, 515 aa, marine gamma proteobacterium HTCC2207
MTEQHKPLVLLILDGFGYSDIKTHNAISNADAPVWQALWQERPKTLIHTSGMAVGLPEGQMGNSEVGHMTLGAGRVVYQNFTRINKAISDGDFFTNPVYCDAIDKAQSTGNAVHIMGLLSPGGVHSHEDHINAMLEMAAQRGAENIYLHAFLDGRDCPPRSAQPSLEKTQALIEKLGVGKIASICGRFFALDRDNRWDRVEEAYNLVTSGRADFSATDAVSALNDAYARDENDEFVHATTICGEGEAPVTLEDGDAVIFMNFRPDRAREIAHALTTKDFDGFERAATPQLSTFVQTTEYQDNIDAPCAYPPIPLVNSMGDYLAQQGKRQLRIAETEKYAHVTFFFSGGRESLYEHEERILVPSPNIATYDDQPEMSAPEVTEKLVEAIGSGKFDTIICNYANCDQVGHTGNYEASIKAVEAIDHSLAQVIAAAEKVGGEILITADHGNVEEMYDDANQQPHTQHTTLPVPLVYVGERSLSLDNNGSLADIAPTMLALMDLPQPAEMTGRSLVIKS

SEQ ID NO: 13181 - protein, 356 aa, Bacillus cereus ATCC 14579
MVTKMTIDRICTIGPASNNKETLAQLIKNGMKIVRLNLSHGTHESHKDIIRLVKSLDDSIKFLGDVQGPKIRLGEVKGEQITLQAGDSFILHTQPVTGSNTEASVDYEGIANDVKVGSRILINDGEVELIVEKISTDKIETKVKTGGNISSHKGVNLPDAAVRLPAITEKDKKDIQFLLEENVDFIACSFVRKPSHIKEIRDFIQQYKETSPNVIAKIETMEAIENFQDICKEADGIMIARGDLGVELPYQCIPLLQKMMIQECNRTNTYVITATQMLQSMVDHSIPTRAEVTDVFQAVLDGTNAVMLSAESASGEHPIESVRTLRLVSEFAEHVKKDGPFAMKDVLQLLRESLDE

SEQ ID NO: 13182 - protein, 453 aa, Pseudomonas putida KT2440
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 13183 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 13184 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 13185 - protein, 278 aa, Cladonia arbuscula
  misc_feature (2)..(2): Xaa can be any naturally occurring amino acid
  unsure (1)..(278): unsure at all Xaa locations
VXHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 13186 - protein, 295 aa, Streptomyces avermitilis MA-4680
MSSPAPDALLGPADIRELAAALGVRPTKQRGQNFVIDANTVRRIVRTAGVRPDDVVVEVGPGLGSLTLALLEAADRVIAVEIDDVLAGALPATIAARMPERAERFALVHSDAMHVRELPGPPPTALVANLPYNVAVPVLLHMLDTFPSIERTLVMVQAEVADRLAADPGSRVYGVPSVKANWHAEVKRAGSIGRNVFWPAPNVDSGLVSLVRRTEPIKTTASKTEVFAVVDAAFAQRRKTLRAALAGWAGSAAAAEAALVAAGVSPQARGESLTVEEFARIAENRGADHADDANN

SEQ ID NO: 13187 - protein, 278 aa, Cladonia arbuscula
  misc_feature (274)..(274): Xaa can be any naturally occurring amino acid
  unsure (1)..(278): unsure at all Xaa locations
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFXAKAG

SEQ ID NO: 13188 - protein, 470 aa, Helicobacter pylori J99
MKIKNVLLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDFQAYENAIKKAINLAQKGFLVTFGISIEKPNTEFGYIESPNGLDVKRFIEKPSLEKAIEFQKSGGFYFNSGMFVFQAGVFLDELKKHAPTILKGCERAFESLENTHFFEQKIARLSEKSMQDLEDMSIDIALMQQSHKIKMVELNAKWSDLGNFNALFEEAANGTKENVSLNQTPIFAKESTNNLVFSHKVSALLGVEDLAIIDTKDALLVAHKDKAKDLKALVSEIETHNQELLQTHTKVYRPWGSYEVLHESGCYKVKILEVKPNARLSLQKHFHRSEHWVVISGMASVELDHQSFELQANESTYIPKNTLHRLANYGKIPLIIIEVQVGEYVGEDDIVRVDDDFNRQNQNA

SEQ ID NO: 13189 - protein, 271 aa, Mesorhizobium loti MAFF303099
MTNRLVLAGCGNMGYAMLSGWLKSGKLAPSAVFVIEPNAELRQRAATLGCATSADAGEIPADAVPDLVVIAVKPQVIRDVTAAYKRFGDGRTTFVSIAAGTPVATFEDILGNRAPVVRCMPNTPASIGKGMMVVFSNPLVSDDTKRFVADLLSASGEVATIDDEGLMDAVTAVSGSGPAYIFHFIEALTVAAEKAGLPSATARLLAMQTVYGAASLAAESQEEPGVLRQQVTSPNGTTAAALAVLMGEDRLTNLLTQAVEAARLRSIELGK

SEQ ID NO: 13190 - protein, 99 aa, Glycine max
MSAVNITNVAVLDNPTAFLNPFQFEISYECLVPLDDDLEWKLTYVGSAEDETYDQQLESVLVGPVNVGTYRFVFQADPPDPLKIREEDIIGVTVLLLTC

SEQ ID NO: 13191 - protein, 473 aa, Synechococcus elongatus PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDCLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRPHPYEFALYYDC

SEQ ID NO: 13192 - protein, 248 aa, Kluyveromyces lactis
MARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 13193 - protein, 104 aa, Triticum aestivum
  misc_feature (5)..(5): Xaa can be any naturally occurring amino acid
  misc_feature (10)..(10): Xaa can be any naturally occurring amino acid
  misc_feature (31)..(31): Xaa can be any naturally occurring amino acid
  misc_feature (33)..(33): Xaa can be any naturally occurring amino acid
  misc_feature (40)..(42): Xaa can be any naturally occurring amino acid
  misc_feature (48)..(48): Xaa can be any naturally occurring amino acid
  misc_feature (50)..(50): Xaa can be any naturally occurring amino acid
  misc_feature (53)..(53): Xaa can be any naturally occurring amino acid
  misc_feature (56)..(56): Xaa can be any naturally occurring amino acid
  misc_feature (61)..(62): Xaa can be any naturally occurring amino acid
  misc_feature (65)..(65): Xaa can be any naturally occurring amino acid
  misc_feature (70)..(70): Xaa can be any naturally occurring amino acid
  misc_feature (74)..(75): Xaa can be any naturally occurring amino acid
  misc_feature (84)..(84): Xaa can be any naturally occurring amino acid
  misc_feature (95)..(95): Xaa can be any naturally occurring amino acid
  misc_feature (98)..(98): Xaa can be any naturally occurring amino acid
  unsure (1)..(104): unsure at all Xaa locations
MGEPXQAPAXQEAGVHIVYVDRPEDADPEEXHXRTLAPVXXXEEKGQXAXLYXYKXAASGXXRKXSTPEXVEDXXKQQVSFKLXPGQDRPTHGNXGGXWKPGYV

SEQ ID NO: 13194 - protein, 392 aa, Aspergillus oryzae
MGKVARTKHSRGANGPYQKPDQGPLGKATSAIFKFNTDLGQHILKNGAIADAIVDKANIQQGQTVLEVGPGPGVLTNRILAKAKKVVAVEVDPRMAAELTKNVQGTPAEKKLQIVLGDFVKTDLSQLPPFQICISNTPYQISSPLIFKLLSMPNPPKMCVLMVQREFALRLVARPGDSLYSRLSVNVQFFSRVQHIMKVGRNNFRPPPQVESSVVRVEPKSDRPAISWDEWDGMLRICFVRKNKTLRAGFMGNKTRAMIERNWITFATMYPEKVTQADIDFMLGNGEPEPMEDVEMDTNNDADDDVPEMDEDDILMGDMGFEKKNVPEIPKGALLTIGNNKVSRVMVTKLIQVKLQRILDRTELANARAQKCDENDFLRLLHACNKEGIHFS

SEQ ID NO: 13195 - protein, 446 aa, Streptomyces coelicolor A3(2)
MGHADTLLAMGGAFVAAAFLARLGGRIGLPTIPLFMLAGILLGPHTPGFVLVEDAHDFEMLSALGLVLLLFYLGLEFHLDDLRSGGKRLLTAGGIYLLLNVGAGLGFGFVLGWGVREALVLAGVLGISSSAIVTKILIDLGRIGRPETRLILGVIVVEDIFLALYLAALQPVISGAHGVADTALQAGKAFGFLLVLAAAARYGTRLVGRLIHTRDNELLVISFLGAAVLVAGVSEVLGVADAIGAFMVGLILAGTPSGPRIRELVHPLRDAFAAIFFFAFGLAIDPGDLASVAGPVAAAAALTVVMNIVAGLCVARVYHYGSEPAAEIATTLVARGEFALILAAMAAGAGLDAQLAPFIAGYVLVLAVLGPIVAGRAHVLAAALRAVGGLLPGTRTPVAAADGGAGGAETEDEDDGRPEPGPVPVPAQASPAFGSSSSPEHTEAGH

SEQ ID NO: 13196 - protein, 394 aa, Arabidopsis thaliana
MGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 13197 - protein, 289 aa, Synechococcus sp. WH 7805
MSSPPIQWYPGHIAKAEQQLKRNLDKVDLVIEVRDARIPLATGHPHLNRWINGKQHLLVINRRDMVTSEARVAWEAWFKARGQRTVWCDAKAGTGVKQVQQAAIRAGDQLNERRRNRGMRPRPVRALTLGFPNVGKSALINRLVKQKVVASARRAGVTRTLRWVRLGQDLDLLDAPGVLPPRLDDQQAALHLALCDDIGQAAYDGELVAQAFLNLLKGLQPQEASGVGLALLESRYGVPLEGATEDPAYWLEAVAERHTSGDTARMAQRLLDDFRKSALGSIALELPFD

SEQ ID NO: 13198 - protein, 485 aa, Bacillus licheniformis ATCC 14580
MNNQDQSLIFEVSKEGRVGYSLPELDVPETDVTDVIDEAYIRDEPADLPEVSELDIMRHYTALSRRNHGVDSGFYPLGSCTMKYNPKINEKIARIPGFSAIHPLQDEATVQGALELLYDLSEHLEEITGMDEVTLQPAAGAHGEWTGLMMIRAFHEANGDHKRTKVIVPDSAHGTNPASATVAGFETVTVKSNDDGLVDLEDLKRVVDEETAALMLTNPNTLGLFEENILEMAEIVHSAGGKLYYDGANLNAVLSKARPGDMGFDVVHLNLHKTFTGPHGGGGPGSGPVGVKKELIPYLPKPVLVKKDGRYTFDHDRPHSIGRVKPYYGNFGINVRAYTYIRSMGPDGLKEVTENAVLNANYMMRKLAPYYDLPFDRHSKHEFVLSGRRQKKLGVRTLDIAKRLLDFGFHPPTIYFPLNVEECIMIEPTETESKETLDAFIDTMIQIAKEAEETPEVVQEAPHTTVVKRMDETKAARKPVLRYEK

SEQ ID NO: 13199 - protein, 448 aa, Bacillus licheniformis ATCC 14580
MKHRYLPATDQDKKEMLEAIGVERIDELFSDIPESVRFKGEYQIKKAKSETELTKELTKLAAKNKDTVTYASFLGAGVYDHYQPVIVDHVISRSEFYTAYTPYQPEISQGELQAIFEFQTMICELTGMDISNSSMYDGGTALAEAAMLASGHTKKKKIVVSETVHPESREVLKTYAKGQYIDVVEVPSKNGTADLEALDEAVCEDTAAVIVQYPNFFGRIEPLKDIKPIAHKGKSMFIVSANPLALGLLTPPGALGADIVVGDAQPFGIPAAFGGPHCGFFAVTKKLMRKVPGRLVGQTEDENGKRGFVLTLQAREQHIRRDKATSNICSNQALNALAASVAMTALGKKGVKEIAWQNLQKAAYAKEAAKRAGLEVAFEGPMFNEFVIRLNEPVEKANERLLEKNIIGGYDLGASYPDLKRHMLIAVTELRTKEEIDTLMNELGDCHE

SEQ ID NO: 13200 - protein, 404 aa, Erwinia carotovora subsp. atroseptica SCRI1043
MSPIEKSKKLENVCYDIRGPVLKEAKRLEEEGNKVLKLNIGNPAPFGFEAPDEILVDVIRNLPTAQGYCDSKGLYSARKAIVQHYQARDMRDMTVEDVYIGNGVSELIVQSMQALLNPGDEMLVPAPDYPLWTAAVSLSNGNAVHYLCDESSDWFPDLDDIRKKITSNTRGIVIINPNNPTGAVYSKELLLDIVAIAREHSLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRNRSWELINQIPGVSCVKPRGALYMFPRIDAKRFNIHDDQKLVLDLLLQEKVLLVQGTAFNWPYPDHVRIVTLPRIDELDMAIHKLGRFLGHYHQ

SEQ ID NO: 13201 - protein, 318 aa, Oryza sativa
MLAVFDRAVAPSPEGLRHPGAAGDGAAGLAERFRDARPGAVTVALGPGGANSLAYSSHGQSPLLPRLFAATDEIFCLFQGTIENIAVLKQQYGLHNKGSTEINIIIEAYRTLRDRGPYPADQVVRDINGKFAFVLYDCSNNSVFMATDADGSVPFYWGVDPDSRLVVSDDDEIVNKACGKSSAPFPKGFFFTTSGGLQSYEHPMNEVKPVPRLDSRGERPTVALAGNDGQGEEADPNGVEHRAGELEAFEVDKVANKVRTHGDKGVNNGELDIGGVEAVEELEELVVRGPEGVGDGGGEGDDDGERWSLATRLSVCIA

SEQ ID NO: 13202 - protein, 265 aa, Streptococcus pneumoniae R6
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRTEDSELFCQLLSKAGLLVELGESLINAATGLAGCGPAFVYLFIEALADAGVQTGLPRETALKMAAQTVVGAGQLVLESQQHPGVLKDQVCSPGGSTIAGVASLEAHAFRGIVMEAVHQAYKRTQELGK

SEQ ID NO: 13203 - protein, 334 aa, Desulfitobacterium hafniense DCB-2
MTIRIGINGFGRIGRNVFRAAFGRENIEIVAVNNRSTGEILPHLLKYDSVHGIFPAQIQHTEDGFTVDGQLVKVVSHTDPGDIPWGELGVDIVIESSGKFNNGPACQKHLNNGARKVIISAPAKEEDITLVMGVNEEIYDPQKHHIISNASCTTNCLAPVAKVIHKNFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 13204 - protein, 279 aa, Stictis radiata
SIEHGAVNVVAVNDPFIEAHYAAYMLKYDSTHGQFKGEIKVDGNDLIVNGQKVKFYQEKDPANIPWSETGAYYVVESTGVFTTTDKAKAHLKGGAKKVVISAPSADAPMFVMGVNEKSYKSDIEVISNASCTTNCLAPLAKVVHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKEAIKKASDGELKGIMAYTEDEIVSTDLIGDNNSSIFDAKAG

SEQ ID NO: 13205 - protein, 481 aa, Salmonella enterica
MSQCLYPVVIAGGTGSRLWPLSRVLYPKQFLNLVGNSTMLQTTIARLNGIKCENPIVICNEDHRFIVAEQLRQIDKLTKNIILEPKGRNTAPAIALAAFIAQKKKPKDDPLLLVLAADHSINNEQAFREAIIKAIPYADAGKLVMFGIIPSVAHTGYGYIKRSVPVDADKDSTAYYVANFVEKPNIQKAQEYIMSEGYYWNSGMFLFRASKYLGELKKFRPDIYNKCESATATANIDMDFVRINETEFINCPEESIDYAVMEKTKDAVVLPIDVGWSDVGSWSSLWDISQKDVHGNVCQGDVINHDSEDSFIYSESSLVATVGVSNLVIVQTKDAVLVADRDKVQNVKNIVDSLKQGGRAEYYMHREVFRPWGKYDAIDQGDRYKVKKIIVKPGEGLDLRMHHHRAEHWIVVSGTAKVSLGNKIKLLVPNESIYIPQGAEYSLENPGVIPLHLIEVSSGDYLESDDIVRFTDRYNSKKFLK

SEQ ID NO: 13206 - protein, 269 aa, Stictis sp. 2-MW-2004
AVNDPFIEAEYAAYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 13207 - protein, 140 aa, Oceanicola granulosus HTCC2516
MATERTLSIIKPDATKRNLTGKINAKFEDAGLRIVAQKRIKLTQEQAGEFYAVHKERPFFGELTEFMASGPVVVQVLEGEGAIAKNREVMGATNPADAAPGTIRAEFAESVGENSVHGSDAPETAKEEISFFFSGLELVG

SEQ ID NO: 13208 - protein, 122 aa, Triticum aestivum
MRRHPLEQVNQVRRRRREKERKQGEEQDLGAAMASAASRKAPSLVVAASVGAVEALKDQAGLCRWGYPLRSLYRHAAAAPRVRALSASLSEAAAAAAPRPAPLSAEDAKLRKAHHLVCWGPN

SEQ ID NO: 13209 - protein, 257 aa, Stictis sp. 2-MW-2004
  misc_feature (40)..(40): Xaa can be any naturally occurring amino acid
  unsure (1)..(257): unsure at all Xaa locations
AYMLKYDSTHGQFKGEIKVDGNDLVVNGQKVKFYQKKDPXDIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 13210 - protein, 476 aa, Salinibacter ruber DSM 13855
MDRRTKIVCTLGPATTDPETLRRLVAAGMDVARMNFSHGTHEEHRERVETVREVAEAEGKGITVLQDLQGPKIRVGAVQNDSVMLAEGDEVRVSTDTPRESTNEHIFIDYEALARDAREGERILIDDGLLELRVIETNGSQLRATVVEGGPLRSRKGVNLPDLQASTPPMTEKDLKDLELGLELEVDVVALSFVQERSDVEALVHRIEETGKKTSVVAKIEKPQAVHNIDEILEVVDGIMVARGDLGIEMPMEEVPGTQKRLIRKSMEAAKPVITATQMLESMVEDPRPTRAEASDVANAVLDGSDAVMLSAETAVGDHPVRVVEAMNQIIRQAESYWHEERRALTMTPDHFEQGANVTNSVSFTACRLAEQVGAEAICCLTNSGSTARSIARHRPSMPIYAFTDNKRVVAQLGSLWGTEAFYIPFQQDTDQGIARVHGVLHDYDLVRSGGHVVLTVGMPLPARGRTNTVHVSTVQ

SEQ ID NO: 13211 - protein, 92 aa, Psychrobacter arcticus 273-4
MARTASALHILVKHKELADDIIAKLKKGAQFDVLAKKHSTCPSGKKGGSLGEFKQGQMVQPFDKVCFSGELFTPHLVKTKFGWHVVKVLYRT

SEQ ID NO: 13212 - protein, 162 aa, Zea mays
MGRRGEPYYVEAVPPVDVNKNTEWFMYPGVWTTYILMLFFACLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTIAVFVLVVAKLPNMHKVRIFGINADI

SEQ ID NO: 13213 - protein, 272 aa, Conotrema populorum
  misc_feature (243)..(243): Xaa can be any naturally occurring amino acid
  misc_feature (249)..(249): Xaa can be any naturally occurring amino acid
  misc_feature (265)..(265): Xaa can be any naturally occurring amino acid
  unsure (1)..(272): unsure at all Xaa locations
SIEHGAVNVVAVNDPFIEAEYAAYMLKYDSTHGQFKGEIKVDGNDLVVNGQKVKFYQKKDPAEIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKXASEGEXKGILAYTEDDIVSSDXNGDNNSS

SEQ ID NO: 13214 - protein, 962 aa, Shewanella sp. MR-4
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIDALFDVILGAGHGLDVAALDAQIVAQGSQSIPEALVRQDAILTHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGQAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 13215 - protein, 980 aa, Salinibacter ruber DSM 13855
MPSHPTSCLQMAIDLSSANTFDERHLGPTDADVDAMLDALGAESLDALVDAAIPDSIRTDAPLDLPSALTEQQVLDAAQDAGAKNDTWRSFIGMGYRHTHTPPVIQRNILENPAWYTQYTPYQAEIAQGRLEALLNFQDMTIDLTGLEIANASLLDEATAAAEAMMMLNRVDRRSDAATFYVSEDCHPQTIEVVKGRAEPIGIDVIVESPENFVFGEDTFGCLLQYPTTDGAVHDYRDVADRAHEADAYVAVAADLLSLTLLEAPGEWGADAVVGSTQRFGVPMGYGGPHAAYFATRERFQRQVPGRMIGVTKDADGEMALRMALQTREQHIRRGRATSNICTSQVLLAVMASMYAVYHGPEGLREIATRVHDLTKTLAEGLNRTGHTVRHDAYFDTLRVDLTDATQAQVRERAEAHEINLRYYDDGSVGVALDQTVDAEDLDALFTVFGATNGQKLYADDLAADLDSGYDGPMPRQTSYLEHPVFNSYHSEGELTRYMKSLADKDLSLVHSMIPLGSCTMKLNPTAALQPISNPQFAGLHPFAPQEQAAGYEQVIDELSGYLTEITGFDDISFQPNSGASGEYTGLLIIQAYHEARGEEQRDVCLVPESAHGTNPASANMAGMEVITIDCDENGDVDLEDLREQAEVNSERLAAAMITYPSTHGVFEEHVEEICDVIHEHGGQVYLDGANVNAQVGLCRPREYGVDVCHLNLHKTFSIPHGGGGPGVGPVCTAEHLSPFLPGHPVVETGGDQHIPAIAAAPHGSALILLISWAYIKLLGPEGLTKSSKTALLNANYLADQLSNHYDIVFRGPNDRVAHEFILDLRPFRSELDINEQDVAKRLMDYGFHAPTMSWPVVGTLMVEPTESESKAELDRLVDAFAAIRSEIEAVETGTLEAEASTLKQAPHTAEMVTADEWDRAYSRETAAYPVEAVRERKFWPTVRRVNDAYGDRNLYCACPPTDAYEADEEEELTSALKTA

SEQ ID NO: 13216 - protein, 337 aa, Zea mays
MAKIKIGINGFGRIGRLVARVALQSDDVELVAVNDPFISTDYMTYMFKYDTVHGQWKHSDITVKDSKTLLFGEKPVTVFGIRNPEEIPWGEAGAEYVVESTGVFTDKEKAAAHLKGGAKKVVISAPSKDAPMFVVGVNEEEYKSDVNIVSNASCTTNCLAPLAKVIHDNFGIVEGLMTTVHAITATQKTVDGPSAKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 13217 - protein, 264 aa, Arabidopsis thaliana
MEEERVAVTGVGTTRYALKPGRIKSEDILICIDVDAESMVEMKTTGTNGRPLIRMECVKQAIILFIHNKLSINPDHRFAFATLAKSAAWLKKEFTSDAESAVASLRGLSGNKSSSRADLTLLFRAAAQEAKVSRAQNRIFRVILIYCRSSMRPTHEWPLNQKLFTLDVMYLHDKPSPDNCPQDVYDSLVDAVEHVSEYEGYIFESGQGLARSVFKPMSMLLTHPQQRCAQDDLDIPMSLAKKVPVTEAASAVDPHNGNNIQIIN

SEQ ID NO: 13218 - protein, 353 aa, Crocosphaera watsonii WH 8501
MTQPLIPVILAGGKGERFWPLSRRQRPKQFLSLDGSGESLLQATANRLLPLADNWDNLWVITASPIADGVREQLPNLPSNNLLVEPQGKDTAPAVAWTTLEIAKRYGKDAVIGFFPADHWIKETDEFEKTLNAASQLAIAEDAIVTLGIKPNYPSTGYGYIEQGNLTNNFNDLPVYKVTRFTEKPDLETAKSFLETGRFSWNSGMFIFRAGVVLQELEKHTPQVLKPLQEKGEAAYEELEKTSIDYALMEKTDLTYVLPANFGWDDLGNWNSLERLVDSNGDNVELGNHVTLDSKGAIIYNSDEQEVIATIGLEDVVIVRDKNVTLVVNKNRTQDIKKLLKELQKDSQLDKLL

SEQ ID NO: 13219 - protein, 743 aa, Arabidopsis thaliana
MTGAVATRDSVEPSEDILICVDVDAESTVEMKTTGTNGKPLNRLECLKLAITRFIHDKLSRNSDHRFAFATLSQSAAWLKKEFSNDAKSAAASLREMSATRSSGPADLTFLFQEAAQEAKTSRAQNRILRVILMYCRSSVRPTHDWPINQKLFTLDVMYLHDKSGPDNCTHDVYDSLVDAIERVSEYEGYIFEGSHGLSQSVFRRMSTLLSHPPQRCAQVDLPKPPAKKPAVSCDKSASDSTKGAKQPLEKKPKTNTKRIHSLGKEKTSDFKKYDEKIVGSRVKIWWPLDRAYYEAVVISYCSAKERHRDKEANQTGCDEEASTMPQKKKAKTRKEQSTNKQSKMLSPFPPNVKKDDEVPQISRRQAEQVLSNCASQIKKYLTEAGKLSSVSLANPSDVVDSICGRAFDALKQEDVVANEKEDRQGPREAAVKACFFLPETSIETLKSFICKKKMNVILAYVGTISSMNENGHKILEMVQQPVAEEEDLAETKTKTYKRARVESSSVHKADGEMEKEAAEGEPSCRSHKSSAEPGDLQPKNLPEPCSVTQQLAKVKQSILDTVASVRQFRCELERKEQSIADTLSIVRQFRSEIEEKEDMLEASLLEIDVLGLSDNVMFGTNRGEDIGNQQNPQLKIIKWIANSTGILKLVGRLSNVVDNQREVIFLYSVITRSSLKTVDFLNVKSKTNSGSYRHHFFDDLTKFEVTAIANTDRFNQKKAPRNCIASITEVKESLLCPSGTTQ

SEQ ID NO: 13220 - protein, 261 aa, Lactococcus lactis subsp. lactis Il1403
MKTLITGENKGIGFALAQNLGHRGYEVLVGARNETRGQEAVEKLKAEGITAKFVKVDLDDLNQLTSLSALTDIDLLINNAGISGNIHSDKGHLDMEKSAFDYSTTDLEETIKTNFLGTHAVIKELLPHSLTENAKIINITVPVSQEYWMPLAYVTSKAAQNAMTFAFGHQFKKDKSKKQIFAVMPGAVATDLNGAKVGDSPFVKSPEETAQMISKFIFDDKNHNAQIINFDGTIYDNYEPGLRNKVIKDVAKNGLKRKFKK

SEQ ID NO: 13221 - protein, 494 aa, Oryza sativa (japonica cultivar-group)
MMSNTLSFSFVLIICVAALHANGSPEEARFREFVRSRRSSTVTVSGSNGYSAHEPGARVSSRLKEEYSVSDQSNLKAADKITALPGQPKGVGFNQYGGYVTVDEMNGRALFYYFVEATTDAAAKPLLLWLNGGGPGCSSVGYGAMIELGPFRINSDNKTLSRNEYAWNNVANVLFLESPAGVGFSYSNTSSDYDKSGDQRTANDSYIFLVNWLERFPEYKGRAFYISGESYAGHYAPQLAATILTHNMESKRMIINLQGILVGNPCLDEFKNLKGQIDYLWSHGVISDEVLANITKNCRFSPSDGKACSDAMDAFDSGNTDPYDIYGPVCINAPDGKFFPSRIVPGYDPCSNYYIHAYLNNPVVQKALHARVTTWLGCKNLHWKDAPVSMVPTLKWLMEHGLPVWLYSGDLDSVCPLTATRYSVGDLGLAVTEPWRPWTANREVGGYVQQYTGGLVFISVRGAGHQVPYFQPEKALIVVSSFLRGALPPYVKQQ

SEQ ID NO: 13222 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 13223 - protein, 357 aa, Solanum tuberosum
SLTVRAASSYADELIKTAKTVASPGRGILAMDESNATCGKRLASIGLENTEANRQAYRTLLVSAPGLGQYISGAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGALNARQGTPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 13224 - protein, 264 aa, Bordetella parapertussis
MRQALFLGYGRMGAALGEAWLRAGLLAGIDAVDPGRDGAGLRARLVRGADELPEQAYDLVVLAVKPAMAQQALRPVPPARLARACLVSIMAGVPAGALRQALQPPRPVARAMPNTPVMAGQGCTGLYGGDDVAPAQRAAIGRLFEAVGAAFWVDTEDQLHAVTALSGSGPAYYHLFSEALAQAGEQLGLPAALARSLAARTALGAASLQCEEGADFAALRREVTSPHGTTHAAIEVFEQAGALRTLVRDAVRQAQARSRELARP

SEQ ID NO: 13225 - protein, 502 aa, Oryza sativa (japonica cultivar-group)
MRHQITLSVLIIILLALGASVTDASSHSQEDQLIKFMESRALKRLRNRPNKNGPGEDDQWADPGRFSHLATRSVSSPESTKEDDRIAALPGQPCGVNFAQFAGYVTVDRKNGRELFYYFVESPYDASTKPLILWLNGGPGCSSLGFGAMKELGPFRVNPDGKTLSRNKHAWNNVANVIFLESPAGVGFSYSMNSSDYSDVGDQITAEDTYVFLLNWFNRFPEYKGRDFYIAGESYGGHYVPQIATIVTFINHLFDGNTPFNLRGIFVGNPLLDEYKNGEGNLEFLWSHGVISDEVWGKILANCTFTSSDDWPCFVAAHSFQRVNIDRYNIYAPVCLHEQDGTFRSSGYLPGYDPCIDYYIPRYLNNPDVQKALHARADTNWSGCNLDLAWNDSPDSMVRTIKRLVENGLSVWIYSGDMDSICSLTATRYSVKDLNLTITHKWRPWYTPDNEVGGYVQQYEGGFTLASVRGAGHLVPSFQPKRSLVLLYSFLKGMLPPADIPK

SEQ ID NO: 13226 - protein, 124 aa, Brassica napus
HQWISPYPPPPYSSSSITAALLLLLRRTRYRRMGLPPGSLGLPLIGETLQLIAAYKTENPEPFVDARVARYGSVFMTHIFGEPTVFSADPETNRFVLQNEGKLFECSYPASICNLLGKHSLLLM

SEQ ID NO: 13227 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 13228 - protein, 431 aa, Triticum aestivum
HYRTSLYKKAGWYRSGIPGISSTHASVPFTESTGNRTARILAITLPIVAAILAAVVICLYLWRRKSKPARKASLSYPTNPEDIQSIDSLILDLSTLRAATDNFDERNKLGEGGFGVVYKGILPDNEEIAVKRLSQSSRQGIEELKNELVLVAKLQHKNLVRLLGVCLEEQEKLLAYEYMPNKSLDTILFDPDRSSQLDWGMRFRIVNGIARGLQYLHEDSQLKIIHRDLKASNVLLDSEFNPKISDFGLARLFGSDQSHDVTNRVVGTYGYMAPEYAMRGNYSIKSDVFSFGVLILEIVTGKRNSIAYDSEQAVDLLSLVWEHWTMGTIVEIMDSSMTSHSPGDQMLKCMHIGLLCVQEDPADRPMMSVVTVMLSSSTVSLQAPSRPAFCIQKSGMNYSGMHTDPYPGVTHSTSRSPMSPNEVSITELEPR

SEQ ID NO: 13229 - protein, 155 aa, Ashbya gossypii ATCC 10895
MRRILREYKQLQKQLALHPAVLSLAPVGEENGDLHRWEAHFQGPENTPYAGFTFTLRINVPETYPNEPPKCSFPPHHICHPNIKWSTGEVCLDLLKHEAWSPVYNLLQVVEAISTLLAEPGVDSPLDVDLSRLYTTDRAAYDGVVNYRLRTRPQP

SEQ ID NO: 13230 - protein, 411 aa, Pseudomonas syringae pv. tomato str. DC3000
MRALTYHGANSVKVDSVPDPELQEADDIILRVTATAICGSDLHLYRGKIPTVEHGDIFGHEFMGIVEETGSAVTAVQKGDRVVIPFVIACGSCFFCNIDLFAACETTNTGRGAIMNKKSIPPGAALFGFSHLYGGIPGGQAEYVRVPKANVGPFKVPGTLADEKVLFLSDILPTAWQAVTNAGIGPGSSVAIYGAGPVGLMSAACAKMLGAERIFMVDHHPYRLAYAQKTYGVIPINFDDDDDPADTIIRQTPGMRGVDGVVDAVGFEAKGSTTETILATLKLEGSSGKALRQCIAAVRRGGVVSVPGVYAGFIHGFMFGDAFDKGLTFKMGQTHVHRFMPELLEHIEAGRLAPEAIISHRMSLEDAAKGYKLFDKKEEDCRKVILTPGDNTIVVPDTQTEALVGGVVPAM

SEQ ID NO: 13231 - protein, 427 aa, Pseudomonas fluorescens Pf-5
MSRSETLFANAQKHIPGGVNSPVRAFKSVGGTPLFFKHAEGAYVTDEDDKRYVDYVGSWGPMILGHSHPDVLDAVRKQLEHGLSYGAPTAMETEMADLVCSIVPSMEMVRMVSSGTEATMSAIRLARGFTGRDSIIKFEGCYHGHSDSLLVKAGSGALTQGVPSSAGVPAAFAKHTLTLPFNDIAAVEKMLAEVGQEVACIIVEPVAGNMNCVPPAPGFLEGLRRLCDQHGVVLIFDEVMTGFRVALGGAQAHYGVTPDLSTFGKIIGGGMPVGCFGGKRKIMEHIAPLGPVYQAGTLSGNPLAMAAGLTTLRLISRPGFHAELSDYTSRLLEGLQQRADAAGIPFVTTQAGGMFGLYFSGADDIVTFDDVMASDANLFKRFFHLMLEGGVYLAPSAFEAGFTSIAHGEAELQLTLDAAERAFAALK

SEQ ID NO: 13232 - protein, 176 aa, Brassica napus
  misc_feature (157)..(157): Xaa can be any naturally occurring amino acid
  unsure (1)..(176): unsure at all Xaa locations
KLLRKHSGEQSKKNVSNFDSEKQLQGDDDDDAERQVHSSNNFDLRNRDHNATRFTRPASSFRRNSPVPRHKPQSSYSSEAIFDETSSYSVTWTQKKDQVVEPEPEYEPGLALLESEPELKPESFYDEEDEDHDVLVGELSNDDDESVNAEEETEKNXRLECTEVDRTQSYSKIKGS

SEQ ID NO: 13233 - protein, 468 aa, marine gamma proteobacterium HTCC2207
MSEKTLNLIKESGARWVDMRFTDTKGKEQHVSIPTGEVGDDFFVEGKMFDGSSIAGWKGINESDMILMPDDSTAVLDPFTDEPTVIIRCGIVEPSTMQGYERDPRSIAERAEQYLQSTGLGDTAFFGPEPEFFVFDDIKWGVDMSGAFYKINSDEAAWASGSDFTDGNMGHRPGVKGGYFPVPPVDSLHDLRAAMCNAMEQMGLDIEVHHHEVGTAGQCEIGVRFDTLVAKADQVQILKYCVHNVAHAYGKTATFMPKPIVGDNGSGMHCHMSFAKDGVNQFAGDAYAGLSEMALYYIGGIIKHAKSLNAFANASTNSYKRLIPGFEAPVMLAYSARNRSAAIRIPYVASPRGKRVEVRFGDPTANPYLMFASMLMAGLDGIKNKIHPGDAADKDLYDLPAEEAAAIPQVAGSLREALDELNADREYLTAGGVFTDDMIDAYIELKMEEVYRVEHTTHPVEFDMYYSV

SEQ ID NO: 13234 - protein, 480 aa, Photobacterium profundum SS9
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 13235 - protein, 256 aa, Volvox carteri
MVSCLRLLALTSLLCIASGARPLSSISWSGDATSSAIPTAQRDFDYFMFVRQWAGSFCSTHACPLVPNRGFHFTIHGLWPNYSNGSWPQFCTPEDKFDEDQLEDLMDDLEVEWPSVYDSDETFWEHEWSKHGTCALDIFPSEHSYFGHILKLHWRYDLSAALRRADIVPSRTSVYRTKDLIAAIEDMYGARPLVHCGRKRQLSEIWMCLDKDLKAFDCDTSQEGNACQEVVIPPFKSRLDVDQLSSKDEEERDGVQ

SEQ ID NO: 13236 - protein, 472 aa, Shigella flexneri 2a str. 301
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 13237 - protein, 186 aa, Glycine max
MGTTFIKEEGLSMILCSSVTAAYRACACMGAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 13238 - protein, 71 aa, Arabidopsis thaliana
  misc_feature (3)..(3): Xaa can be any naturally occurring amino acid
  misc_feature (18)..(18): Xaa can be any naturally occurring amino acid
  misc_feature (42)..(42): Xaa can be any naturally occurring amino acid
  misc_feature (49)..(49): Xaa can be any naturally occurring amino acid
  misc_feature (52)..(54): Xaa can be any naturally occurring amino acid
  misc_feature (60)..(60): Xaa can be any naturally occurring amino acid
  unsure (1)..(71): unsure at all Xaa locations
SMXSSATMVASPAQATMXAPFNGLKSSVAFPATRKANNDITXITSNGGXVNXXXVWAPIXKKKFETLSYLP

SEQ ID NO: 13239 - protein, 343 aa, Physcomitrella patens
MASEGVLLGMGNPLLDISCVVDDAFLEKYGLTLNNAILAEDKHLPMYKELAANPDVEYIAGGATQNTIRIAQWMLGESNATSYFGCVGKDEYGDRMFKLASEGGVNIRYDVDEDLPTGTCGVLVVKGERSLVANLSAANKYKIDHLKKPENWAFVEKAKYIYSAGFFLTVSPESMMTVAKHAAETGKYYMINLAAPFICQFFKDPLMELFPYVDFIFGNESEARAFAQVQGWETEDTKVIAVKLAALPKAGGTHKRVAVITQGTDPTIVAEDGKVTEFPVTPIPKEKLVDTNAAGDSFVGGFLSQLVLGKDIAQCVRAGNYAASVIIQRSGCTFPSKPSFESQ

SEQ ID NO: 13240 - protein, 472 aa, Methylobacillus flagellatus KT
MLLPVIMSGGAGSRLWPVSRETLTKPFIELPDGRTLLQKTLQRTACLDGVSEVLTVTNKEYYFLTRDVYEATDTNVSHSYLLETIGRNTAPAIAVAALHAAAKHGEDVVLLVMPADHLIGNQKVFSKAVTVATDMAVNGWIVTFGVEPSTPETGYGYIEGGESIGDSGARRVVRFVEKPDLETAEKYIALGRFTWNAGIFCFTAKTIIAALAEYVPEVLEIAKKTLASSDSKTEPVVLGEEHFASSPDISIDYAVMERASKVAVVAADFDWSDIGSWSAMAELVQSDERGNRVNGEALLVDANNCYIQSDSRLVAGIGIDNLLVVDTPDALLVAHHSRAQDVKTVVKQLKLESHSAANYHRKVHRPWGTYTVLEEGANFKIKCIKVKPGASLSLQMHHHRSEHWVVVSGIAKVVNGERELLINANESTYIPAGHKHRLENPGLLDLVIIEVQSGEYLGEDDIVRFQDIYGRT

SEQ ID NO: 13241 - protein, 841 aa, Gloeobacter violaceus PCC 7421
MQPPPPQTPPDMPLEEPSAAPGVEALRQAIVDNLRYVLGKDPSQAGAQDFLAALAHTVRDPLLHRWRNTRQAYFDCGARVVCYLASQYRPGPQLVANLVSAGLYARSVEALAGLGVRLEDLLALEREPQLGRREGSRQAASLAEALATQQMPAIGYGLRYEFGSEQVIRDGWPFERPVPWRFADDPWEIPRPEYRVEVPLGGRTEAHLDGENRYRVRWLPEGAVIGEPYDRLVPGYRTHTVNTLRLWSARASEQFDAPVANPEEYARAVEAKLDCELITRVPYPAGDGPHHQRLRLQQQYLLACCSVHDIVRLFTQTGRPLGELPERAAIHIDDSHPPIAIAEWMRILVDRHDLGWEEAWEMTGRMFSATAHTWAVETLECWPVALVERWLPRHLEILREIDRRFRLQLQALLVDEAQIARLSLFADDQVRLAHLACIACHTVVGTSESATGQLAQTVLADFHRLWPQKFQTIGAGVSTRRWLVLANPPLARLIGERIGPHWLTHPEGLDALRRHAADPDFQRSWRQIKQAHKRSLAAQLLATSGVALSSEALFDIRLEPFEGCRRQLLSALYIVTLFNRLQSEPGANIVPRAFIFSGWPRPGDPLGRLTVKLIHAVGAVVNADPIVAGRIRVVFVPEPTVALTQKIFAAADLAEQDALPGFQAGDTGSLCAALNGALLLGSPDGINLEIERTVGRERFFEFGLSTGEGQALKLTEYQPMAFYHSNPLLRQVVDQIATGYFSHGDSEQFKPIVAAMVEDDEALNLVDYQSYVDGQGSVDAAYRDLALWTRLSIESVSRLGAVCCDRTAREYCSRIWRLQPVKVHLDAYSQQVIALKGREHL

SEQ ID NO: 13242 - protein, 498 aa, Aspergillus nidulans FGSC A4
MANVRVKGENFYRDAKKVKRLNMLKDGKPQRDAAGNITVAASYQSREAPVARIEPNRKWFGNTRVISQEALSSFREAVAERASDPYQVLLKTNKLPMSLIRDNKTVNGLKQHEAKMTIETSPFSDTFGPKAQRKRVKLGVSSLEDLAGETMKMHDSYVEKSEQGRHEDGTPIVAGDDVATDLSVGTLPTSREAVFLKGQSKRIWNELYKVIDSSDVVIHVIDARDPEGTRCRGIEKYIREEAPHKHLIFVLNKCDLVPTGVAAAWISVGLIGYPNTGKSSIINTLRKKKVCTVAPIPGETKVWQYVTLMKRIYLIDCPGVVPPSQTDTPEDILLRGVVRVENVENPEQYIPAILKRVQPKHLERTYGIKETSDAIEFLSILARKGGRLLRGGEPDLDGVAKMVINDFLRGKIPWFTPPPFTPGEEGEKIEGREGRLGEMGRKRKIEETSQDASEGQEGQDQSASDSEEEFGGFDDEQDDSDNDSIANLEVSDEESGEE

SEQ ID NO: 13243 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQRTKQDYQMELGVNCIGPQLLQTLLDPLFIKTAEKNPPNLSRIVWVSSTAHMFSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 13244 - protein, 162 aa, Triticum aestivum
  misc_feature (116)..(116): Xaa can be any naturally occurring amino acid
  misc_feature (127)..(127): Xaa can be any naturally occurring amino acid
  misc_feature (134)..(134): Xaa can be any naturally occurring amino acid
  misc_feature (143)..(143): Xaa can be any naturally occurring amino acid
  misc_feature (154)..(154): Xaa can be any naturally occurring amino acid
  unsure (1)..(162): unsure at all Xaa locations
AENKVLDPKKAQNIAILLRALNVTKEEVSDALCEGNTENFGADLLETLLKMAPTKEEEIKLREFKEESSPVKLNPAEKFLKAVLDVPFAFKRVDAMLYIANFDAEVNYLKKSFETXEAACDELRSSXLFLKLLXEAVLKTGNXMNVGTNRGDHXFKLDTLLK

SEQ ID NO: 13245 - protein, 508 aa, Candida glabrata CBS 138
MDSRLHRLINLEVTPGKDVRKTAIIGTIGPKTNNVDTLVALRKAGLNIVRMNFSHGSYEYHQSVIDNARKSEQVYPGRPLAIALDTKGPEIRTGTNVDDVDYPIPPNHEMIFTTDDKYAKACDDKIMYVDYKNITKVIQPGKVIYVDDGVLSFEVLEVVDDKTLKVKSLNAGKISSHKGVNLPGTDVDLPALSEKDKEDLRFGVKNGVHMIFASFIRTAQDVLTIREVLGEEGKDIKVIVKIENQQGVNNFDEILEVAHGVMVARGDLGIEIPAPQVLAVQKKLIAKCNLAGKPVICATQMLESMTFNPRPTRAEVSDVGNAILDGADCVMLSGETAKGNYPINAVTTMAETAIIAERAIAYMPLYDDLRNCTPKPTSTTETVAASAVAAVQEQGAKLILVLSTSGNTARLVSKYRPQCPIVLVTRNPRTARFSHLFRGVFPFVYEKEPLDDWSEDTHARLRFGVDMAKEYGFVKNGDAVISIQGFKGGVGHSNTMRVSIVGGEKEDI

SEQ ID NO: 13246 - protein, 598 aa, Candida glabrata CBS 138
MFWSKEKEKDAVSVVSLGEEDVQHETITAMGSGGSGSRRGDEKFGKMPGDVDVFSLSSSTEKHSPHYTDMTGHELKQGLKSRHVQLIALGGAIGTGLFVGTSSTLHTCGPAGLFISYCIISSVIYPIMQGIGEMVCYLPGSGSKPEGFAAYLVGKYVDESLGFADAWNYYYCYVILVAAECTAASGVVEYWTTSVPKAAWITIFLAAVVILNFTAVKFYGESEFWFASIKILCIVGLIILSFILFWGGGPNHDRLGFRYWQNPGGFAHHIRGGSFGSFLDIYTGIIKGGFAFILGPEMIAMTSSEVEDQRRNIAKAARRFVWRLMFFYILGALSISVIVAYNDPALENALAQNKPGAGSSPFVIGIQNAGIKVLPHIINACILSSAWSAGNAFMFTSSRSLLTMAQNGQAPRIFAKVNRWGVPYYAVGLSSAISCLAYLNCSSSTADVFNWFSNISVISGFIGWICVCIAYIRFHKAILFHGMQSRLPYTARGMPYLIYWPLLVISIITLTNGYEVFIPRFWDAKNFVAAYITLPVFWVLWIGHRVYRRKIFTLKWWKSIEEIDVVTGVEEIEEKTRECDASRVLPTKWWEKALDALL

SEQ ID NO: 13247 - protein, 137 aa, Glycine max
MLWLFFKVLKLLLMIVWCDLVSGLKLVTVDRPFAEKHYADLSAKPFFSGLVDYIVSGPVVAMIWEGKNVVTTGRKIIGATNPAQSEPGTIRGDFAIDIGRNVIHGSDAVESANKEIALWFPEGPANWQSSQHSWIYE

SEQ ID NO: 13248 - protein, 219 aa, Shigella flexneri 2a str. 301
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 13249 - protein, 303 aa, Mycobacterium tuberculosis CDC1551
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTELVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 13250 - protein, 353 aa, Zea mays
MTKSGALQLARSTGGSLSKDQVKSAVDQYVKYHDLHGGEQESRKSNYADLANKYYDLVTGFYEYGWGDSFHFAGGYPGETSREAIKRHQHFMALQLGLKKGMKVLDVGCGIGGPLIEIARFSSTSITGLTNNDYHVSRGKEHIFSAGLSEQCCSLKGDFMNMPIADNTFDAAYAIQATCYAPEAQGVYSEVYRVLKPGQYFALDEWCLTDRFDPNNAKHLTAKAEIELGDGLPDIRTTRQCVQAMKDAGFEVIFAKDLAQDFPCPWYQTMDPNYFSWANFQCTRPGRIITRAIVNTLEFLRIAPAGSVGAYNVLTSASDGLLKGGREGIFTASFFVLGRKPLKESEIVNGGNL

SEQ ID NO: 13251 - protein, 586 aa, Bacillus acidopullulyticus
MFREAIYHRPKDNYAYACANGELHIRIRTKKDDMKEVTLVYGDTYEFDDNKWTYSTAHMKKTGSDQLFDYWLASVTPRYKRLRYGFIVNDRKDSTCFTEKGFYPEPPVNDISYYFSFPYVNQADIFQAPEWVKDTVWYQIFPERFANGNKDNDPDGTLPWGSREPEIDNFFGGDLEGVIEHIDYLKELGIGGIYFTPIFKAHSNHKYDTIDYMEIDPQFGTKETLKKLIDVCHKNGIKVMLDAVFNHSGVFFPPFQDVVEKGKNSKYQDWFHIREFPLVMEPRPNYDTFGFTSSMPKFKTENPEVKEYLLEVGRYWVREFDIDGWRLDVANEVSHAFWREFRREVKAIKPDLYILGEIWHDSLPWLRGDQFDAVMNYPLSTNIVNLFANQSVSVKEFVENMSHVIHMYPDTVNEAAFNLVGSHDTPRILTQCGEDVERLKQVFVLLLTFIGTPCIYYGDEIGLTGGQDPGCRKCMEWNPDQQNRELLQHVRKLIQLRSENPLLANEGELTFVPPKNEEDPCLAYTKSNEEKTIMIIINKSKNSVEYPLSFDAAEQTVKNLWNQEQLILQNGQTLELKANDFKILEF

SEQ ID NO: 13252 - protein, 274 aa, Kluyveromyces lactis NRRL Y-1140
MYRVFDKLASRPFVSLPGIQLIAKMPLSDLNKLPPLADQLEQAKRIAAYRAVDENFDAKTHKVVGVGSGTTVVYVAERLGEYMDEKTNFVCIPTGFQSKQLILSNKLQLGVIEQFPEVDIAFDGADEVDAGLQLIKGGGACLFQEKLVSTSAKKFIVVADSRKKSPKYLGTNWKKGVPIEVVPSSYVRVLSDLKNKLNCKSAMVRQGGSAKAGPVVTDNCNFIIDADFGEITDPRKLHQDIKLLVGVVETGLFIDNAEKAYFGYPDGSVDLQEL

SEQ ID NO: 13253 - protein, 856 aa, Gloeobacter violaceus PCC 7421
MTLSEYQATWKKRPEKHAALPTDLKKHVLRTPQVRVQVEDDRTGMDTETLKRAFLDNLYYIQAKDLQNATPYDLYMALSWTVRDRLLQRWIHTQETYLKQDVRSVCYFSAEYLPGRQLGNALVNVGLYEPARTFLRELGFELVDLMEQENEPGLGNGGLGRLAACFMDSLATLGVPAIGYGIRYEFGIFAQTIQGGWQFEQPDRWLRYGNPWEIPRPEYLVEVKFGGHTEAYTDPQGRYRVSWVHERSVLGTPYDTPVPGYRTNTVNTLRLWSARATEDFDFQVFNSGDFARAVAGKTYSENITKVLYPNDNTYQGKELRLEQQYFFVSCSLQDILRRYWDHHVDLDSFTDKVTIQINDTHPAIGIAELMRLLVDEYLIEWDRAWQITQKVFAYTNHTLLSEALERWPVSLFGRLLPRHLEIIYEINERFLHLARSRFGNDEARIARLSLIQEGSEKYVRMANLACVGSHAINGVAKLHTELLEQDVLADFYALTPEKFSNKTNGVTPRRFVLLSNPKLALLYTERLGQEWIRDLALLRKLEDHLHDADFRASWKQIKADNKHDLAEYILHFNGIEVAPDSLFDIQVKRVHEYKRQLLMLLYVITLYHRLKQNPAMALQPRTFIFAGKAAPGYTMAKLIIKCIHSVAAIINADPDVGGRLKVVFLANFNVSLAQRIYPAADLSEQISTAGKEASGTGNMKFAMGGALTIGTLDGANIEIREQVGPENFFLFGLTAQQVYALKARGYHPNDYYQTNTELRSVIDLVASGHFSPGRPDLFRPLVDALMARDEYLLFADYQVYLDCQQQVDAAFADSERWTTMSILNAVRMGYFSSDRSMGEYCRDIWKTGPVAVELNG

SEQ ID NO: 13254 - protein, 218 aa, Vibrio parahaemolyticus RIMD 2210633
MTQDEMKKAAGWAALKYVEKGSIVGVGTGSTVNHFIDALGTIKDDIKGAVSSSVASTERLKELGIEVFECNDVIKLDVYVDGADEINHAREMIKGGGAALTREKIVAAISEKFVCIVDDTKAVDVLGQFPLPVEVIPMARSYVARELVKLGGDPAYREGVVTDNGNIILDVHNMQITNPKEMEDKINGIAGVVTVGLFAHRGADVVITGTPEGAKIEE

SEQ ID NO: 13255 - protein, 410 aa, Vibrio parahaemolyticus RIMD 2210633
MAKVSLEKEKIKILLLEGLHPSSVEVLQAAGYTNIEYHKGSLSEEELIEAVKDTHFIGIRSRTNLSEEVINAANKLVAIGCFCIGTNQVDLGAAAKRGIPVFNAPFSNTRSVAELVLGQILLLLRGIPEKNALAHRGIWKKSADNSYEARGKRLGIIGYGHIGTQLGIIAENLGMRVYYYDIENKLSLGNATQIHTMSELLNKCDVISLHVPETPETKNMMGEEEFARMKPGAIFINAARGTVVDIPALCHSLEAGHLAGAAIDVFPVEPKTNADPFESPLQKFDNVILTPHVGGSTQEAQENIGVEVAGKLAKYSDNGSTLSSVNFPEVSLPEHGRECSRLLHIHKNRPGILTQINTIFAEEGINIAAQYLQTEAEIGYVVIDVETERSEEALTKLKSIEGTIRARILH

SEQ ID NO: 13256 - protein, 262 aa, Ceratopteris richardii
MVPKEVNACPFSVFHQRNWQFVNEFVKGVLRTSYVDCAAQVLDELTPYVSLAEKLGRLAIQLVAASGVKNVKVSYSSARDGDDLDTRLLRAMIIKGLIEPISDAYVNLVNADFIAKQRGLKVIEARELCDGSPEVPLQTIVIKIANVQSRFATALSDSGEITLEGRVKERIPHLCKVGEFDVDASLEGSVILTRQQDQPGMIGIVGNILGDENINVNFMSVGRIAPRKEALMAIGLDDEPTQAALKRIGSIPELQEYVYLKL

SEQ ID NO: 13257 - protein, 446 aa, Corynebacterium glutamicum ATCC 13032
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 13258 - protein, 236 aa, Prochlorococcus marinus str. NATL2A
MDLQNQMKKAVAQAAVDQIQNGMILGLGSGSTAALMIEALAIKIKSGEIKDVVGVTTSFQGEVLASELGIPLKSLSSVSEIDLAIDGADEVNPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDKPELLESQINNIPGVLENGLFVNLTDEVLVGKVESDVVGVESLKKI

SEQ ID NO: 13259 - protein, 402 aa, Desulfitobacterium hafniense DCB-2
MEFRFNTIEEAIEDIRQGKIIVVVDDEERENEGDLLMAAEKATPEAINFMATHGRGLICVPMTAERIQALNLEPMVTHNTDPHGTAFTVSVDGCDCTTGISAFERANTVKVLLDPHSRPENLRRPGHIFPLKAREGGVLVRAGHTEGAVDLARLAGFQPAGVICEILKDDGTMARVPDLMEFVKKHDLKMVTIKDLIHFRRQKEKLVERVVGIELPTDFGDFKAVGYRSLLDGQEHIALVKGDVDDGEPVLVRVHSECLTGDVFHSRRCDCGEQLSAALESIQKEGRGVLLYMRQEGRGIGLLNKLKAYKLQEEGKDTVEANLALGFPADLRDYGVGAQILVDLGIRKVRLMTNNPRKIVGLEGYGLEIQERVSMEMPVKPENQHYLHTKKIKLGHYLPGVR

SEQ ID NO: 13260 - protein, 352 aa, Bacillus cereus G9241
MTIDRICTIGPASNNKETLAQLINNGMKIVRLNLSHGTHESHKDIIRLVKSLDDSIKILGDVQGPKIRLGEIKGEQITLQAGDSFILHTQPVTGSSTEASVDYEGIAHDVKVESRILMNDGEVELIVEKVSTDKIETKVKTGGNISSHKGVNLPGTIVSLPAITEKDKKDIQFLLEEGVDFIACSFVRKPRHIKEIRDFIKEHKETVPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPIESVKTLRLVSEFAEHVKKDGPFAMKDVLELLHKSLNE

SEQ ID NO: 13261 - protein, 218 aa, Buchnera aphidicola str. Bp (Baizongia pistaciae)
MKTNELKRLVARKVVDYINPGSVIGIGTGSTVSYFIEVLSTIKNLISGAVSSSNFSTACLKRIGIPIYDLSKINSLVLYIDSADEINPQLQMIKGGGAALTREKIIAATAEKFICIADESKQVEILGKVPLPIEIIPMARSYISNEIIKIGGMPKYRKNVITDNGNVIIDVFNLVITDPVCLENKINSFPGVVSVGLFATRKADIALIGTSSGVQVIY

SEQ ID NO: 13262 - protein, 451 aa, Shigella flexneri 2a str. 301
MTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 13263 - protein, 347 aa, Kluyveromyces lactis NRRL Y-1140
MPPKKKQQQQPAKKKDNVDKTFGMKNKNKSTKVQKFIKQVQSQQDPAKEEMKRKKLEEKKMREAAEAERRALFNPVLDQKVKAGVDPKTVLCALFKIGNCNKGARCKFSHDMNVGRRVEKRDLYQDTRSEKEEDTMDNWDEAKLRSVILSKHGNPRTTTEKVCKYFIEAVENGKYGWFWICPNGGDKCMYKHSLPEGFVLKTKEQKRLEMEAFEKKPKITLEEFIETERERLDKRNLTPITMDNFAEWKKNHRIERLNLEKENNLKKKPSGREVVLKKYTEDKRFDLVDETDSTNGSAWDLTEFTKALRDEDSNGSSGIKDYGDGSNPTFELPSRDGPSKQSTTLTA

SEQ ID NO: 13264 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 13265 - protein, 220 aa, Triticum aestivum
PTFTSVDDFLQKVATLRGKLKKGGIVDVEAAARIVLHDWNEGKIPYFTVPPKRDAVDDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRKRKAEKKKRKANKFSVLTDMDADYDFKVDYQMKDAPAEDGNDGGDEEPKEADPMTGVDDA

SEQ ID NO: 13266 - protein, 368 aa, Bartonella quintana str. Toulouse
MTYDQKKFVSALRAFERGEILVVTDDNDRENEGDLTVAAVHCTEEKMAFIIRHTTGIVCAPMLKEEAQRFNLTPMVSDNNSAHRTQFTVTIDFKHGTTTGISAHDRTLAVRNLANSNAGASDFVRPGHIFPLIAHEGGVLMRSGHTEAAVDLCKLANLPPVGVIGELVNDDGSVKHGDEVTKFAQDNRLHIIKVSDLIAYRQRKEMLIKHVGEMHIETPVGPAVFQSYQLPWETVQHVAIIFGDIRDGEDIPVRLHRENIMSDIFGQSSDIITIMRRMMEKEKRGVFVYLREGSVGVQSAVGSQALAMRGLENHVQAIERGEEWRQIGLGSQILKHLGISSVIVYAANERHYLGLEGFGIRVSRTDIL

SEQ ID NO: 13267 - protein, 248 aa, Bdellovibrio bacteriovorus HD100
MYKLVLIRHGESVWNQENRFTGWQDVDLSEKGRAEALKGGKALREKGFSFDVAYTSVLKRAIKTLNFVLDEVDQVWLPVHKDWRLNERHYGALQGLNKAETAARHGEEQVKIWRRSYDTPPPPMEVSDPRHPSHDPRYKNVDAQLLPSNESLKDTVARFLPLWDGTIAPAVKSGKNVLIVAHGNSLRALMQHLEGMTPDEIMGVNMPTGIPMMYELDANLKVLKKEFIGDPDEVKAAIEAVANQGKAK

SEQ ID NO: 13268 - protein, 615 aa, Mesembryanthemum crystallinum
MMEWDSSSEESGDEEGFLLNDGGPVPFPVGNLIQTAPCGFTVTDALEPDHPIIYVNTVFEMVTGYRAEEVLGRNCRFLQCRGPFAKRRHPLVDSVVVAEIRRCLDDGVEFQGELLNFRKDGSPLMNRLRLTPIYGDDDTITHIIGIQLLSEANVDLGPLPSFPVKESTKSSDQYRSGLSLFPSFQSRERSICLEVCGLLQISDEVLALKIFSRLTPRDIAAVGSVCRRLYELTRNEDLWRMVCQNAWGTETTRVLETVPGAKRLGWGRLARELTTLEAAAWRKLTVGGAVEPSRCNFSACAVGNRVVLFGGEGVNMQPMNDTFVLDLNASNPEWQHVKVSSPPPGRWGHTLSCMNGSNLVVFGGCGTQGLLNDVFVLDLDAKQPTWREISGLAPPLPRSWHSSCTLDGTKLIVSGGCADSGVLLSDTFLLDIAMDKPVWREIPVTWSPPSRLGHTLSVYGGRKILMFGGLAKSGPLRFRSSDVYTMDLSEDDPCWRCVTGSAMPGAGNPGGVAPPPRLDHVAVSLPGGRILVFGGSVAGLHSASQLYLLDPTEEKPTWRILNVPGRPPSFAWGHSTCVVGGTRAIVLGGQTGEDWMLTDIHELSLASTVKEEDQL

SEQ ID NO: 13269 - protein, 113 aa, Arabidopsis thaliana
IKGLKYPEDPDKKAYALRYIGSMVADIHRTLLYGGVFIYPADAKSPDGKLRLLYEAAPMAFLIHHAGGKSTTGKEDILDVMPTGIHQRVPVYMGSPEDVADFEAVHAKINNTV

SEQ ID NO: 13270 - protein, 263 aa, Gloeobacter violaceus PCC 7421
MNLGIVGGGAMAEALIAGLIAGAVYAPSEIAVSDPVAERGEWLHRRYGVVAVTDNLVPAAAPTLLLAVKPQAFAVVSNQVAAHVRSELVVSILAGVPLARLQAAFTGRAVVRAMPNTPALVRSGITALSRSERVTPEQFAVARTLFACVGEVVEVPESAMDAVTGLSGSGPGYLALVVEALIDGGVAAGLPRATASQLVLATLRGSAELLIQEKLHPAVLKDRVTSPGGTTIAGIEQLEGRSVRGAFIEAVQAATRRARELSG

SEQ ID NO: 13271 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 13272 - protein, 634 aa, Mesembryanthemum crystallinum
MAKEEEFINNRRAGKRPKLTQKTKDQERESICNGHNNQWDLEENQYLHNNNNNNNNKFYYPQPVLAPSSIVVCDALEADYPIIYVNTSFEIFTGYRANEALGRNCRFLQYMDPHAQRRHPLVDPVMVSEMRRCLEEAVQFEGELLNFKKDGTPLVNRLRLQPIHADDGTITHVIGIQIFSEAKVNLNHVSYPVYKEKCDHQFDCADDDHPTKDGGDFCGILQLSDEVLAHNILSRLTPRDVASIGSVCRRIYQLTKNELVRKMVCQNLWGREVIGNLELMTKKLGWVRLARELTTLEAVRWRKFTVGGAVEPSRCNFSACAAGNRLVLFGGEGVDMQPMDDTFVLNLDAEHPEWRRVSVKSSPPGRWGHTLSCLNGSWLVVFGGCGKQGLLNDVFVIDLDAKQPTWTEIPGGSTPPVPRSWHSSCTIDGSKLVVSGGCSDSGVLLSDTHLLDLMTNTPAWREIPTSWAPPSRLGHSLTVYGKTNIFMFGGLVKSGQLRLRSGEAYTIDIGNDNPRWRQLECGAHAGGGTQGGVVPPPRLDHVAVSMPCGRIIIFGGSIAGLHSSSQIFLIDPSEEKPSWRIINVPGQPPKFAWGHSTCVVGGTRVLVLGGHTGEEWILNELHELCLASKHDSDF

SEQ ID NO: 13273 - protein, 483 aa, Pseudomonas syringae pv. tomato str. DC3000
MIPVILSGGSGSRLWPLSRKQFPKQFLALTGEHTLFQQTLQRLVFEGMQEPIVVCNKDHRFIVNEQLAALNLETQAILMEPFGRNTAPAVALTAMKLVNEGNDGLMLVLPADHVIEDQKALQRALALATVTAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDASTFACCPDNSIDYAVMEKTQRACVVPLSAGWSDVGCWSSLWEVNAKDAHGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 13274 - protein, 206 aa, Bartonella quintana str. Toulouse
MGRTLVLIRHGQSEWNIKNLFTGWKDPGLTEKGHAEAITAGKNLKAAGLKFDIAYTSALQRAQKTAQHILEQMGQSDLPLIKNSALNERDYGDLSGLNKDEVRQQWGEQQVQIWRRSYAVAPPNGESLRDTGARVWPYYLYHIQPHILRSQTVLIAAHGNSLRALIMALEGLNSEEIISQELTTGIPLIYTFNSDSTISSKTIITP

SEQ ID NO: 13275 - protein, 140 aa, Oryza sativa
  misc_feature (50)..(50): Xaa can be any naturally occurring amino acid
  misc_feature (52)..(52): Xaa can be any naturally occurring amino acid
  misc_feature (54)..(61): Xaa can be any naturally occurring amino acid
  misc_feature (65)..(66): Xaa can be any naturally occurring amino acid
  misc_feature (107)..(107): Xaa can be any naturally occurring amino acid
  unsure (1)..(140): unsure at all Xaa locations
PLPPPPLSLSLSLFPFRLPPPRLDDQGSSAGDSASGGEGAGASSHVTGRXTXTXXXXXXXXAYDXXARKTAKTMASPGRGILAMDEANATCGKRLASIGLENTEANXQAYRTLLVTAPDLGQYISGAILFEETLYQSTED

SEQ ID NO: 13276 - protein, 374 aa, Oceanobacillus iheyensis HTE831
MQVKTAVLRTQGADSPYKESKPIKIETLELDAPQLGEVLIQIKAASLCHSDLSVINGSRPRPLPMALGHEASGVVVEVGEGVTYLEPGDHIVCVFVPSCGHCVPCKEGRPALCEPGADSNTAGTLISGGIRLHADGEAINHHLGVSAFSEFAVVSRNSLVKVKKDIPFEKLALFGCAVITGVGAVVNTANVKLGSTVAIVGLGGIGLSALLGAVAAGASRIIAVDINENKLKQAKELGATDVFNSTEETVIQQIKEATDGGVNYAFETAGAVPAMEVAYGITKRGGTTVTTGLPHPEHQFSFPYVTLTAEEKTLKGSYVGSCVPDRDIPRYMNLFKQDRLPVDKLMTDFISLDEINEGFDKLAKGDSSRIIIKM

SEQ ID NO: 13277 - protein, 571 aa, Ashbya gossypii ATCC 10895
MAQLKWGAGRADDGQDGREVDIEERWHGGAKPDSADGSRRIQIQAVNDEDDTSELITFNQDVSWFIVMLTFVASLSGFLFGYDTGYISSALQSVGTDLGHQLTYRDKEYITSATSLGALIAALGAGICADLFGRRKCIMFSNILFVVGTVLQVAAFNFWQMVVGRLVMGFGIGFGSLISPLFISEIAPKMIRGRLTVINSLWLTGGQLIAYACGAGFQHVKHGWRILVGISMLPAVLQFVSFIFLPDTPRFYVMKGRLEDAANVLERTYVGAERALIDRKIEELVLLNKTIPGRTVFHRVWNTIVAIHTVPANLRALIIACGLQGIQQFCGWNSLMYFSGDIFSLVGFKDPVAVSIVVAATNFIFTLVAFFAIDKIGRRIILLIGLPGMTTAMTVCAIAFHYIKTEVDGEKLKPVGESNAWGIVVVIFIIVYAAFYALGIGTVPWQQSELFPQPVRGVGTSFATATNWAGSMVIASTFLTMFKNITPTATFGFFAGISVISLVAVYLCYPELSGLELEEVQFVLKDGFNIKASKALAKKRKFQMAESRKQARELDLESLHKAKPSDEFTES

SEQ ID NO: 13278 - protein, 339 aa, Streptococcus pneumoniae R6
MKAVVVNPESTGVAIEEKVLRPLETGEALVEVEYCGVCHTDLHVAHGDFGQVPGRVLGHEGIGIVKEIAPDVKSLKVGDRVSVAWFFEGCGTCEYCTTGRETLCRTVKNAGYSVDGGMAEQCIVTADYAVKVPDGLDPAQASSITCAGVTTYKAIKEAKVEPGQWVVLYGAGGLGNLAVQYAKKVFNAHVIAVDINNDKLALAKEVGADIVINGLEVEDVAGLIKEKTDGGAHSAVVTAVSKVAFNQAVDSIRAGGRVVAVGLPSEMMELSIVKTVLDGIQVIGSLVGTRKDLEEAFQFGAEGLVVPVVQKRPVEDAVAIFDEMEKGQIQGRMVLDFTH

SEQ ID NO: 13279 - protein, 163 aa, Arabidopsis thaliana
  misc_feature (6)..(6): Xaa can be any naturally occurring amino acid
  misc_feature (89)..(89): Xaa can be any naturally occurring amino acid
  misc_feature (105)..(105): Xaa can be any naturally occurring amino acid
  misc_feature (108)..(108): Xaa can be any naturally occurring amino acid
  misc_feature (122)..(123): Xaa can be any naturally occurring amino acid
  misc_feature (125)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (132)..(132): Xaa can be any naturally occurring amino acid
  misc_feature (139)..(141): Xaa can be any naturally occurring amino acid
  misc_feature (143)..(143): Xaa can be any naturally occurring amino acid
  misc_feature (146)..(146): Xaa can be any naturally occurring amino acid
  misc_feature (148)..(149): Xaa can be any naturally occurring amino acid
  misc_feature (156)..(156): Xaa can be any naturally occurring amino acid
  misc_feature (160)..(160): Xaa can be any naturally occurring amino acid
  misc_feature (162)..(162): Xaa can be any naturally occurring amino acid
  unsure (1)..(163): unsure at all Xaa locations
MASSMXSSTAVVTSPAQATMVAPFTGLKSSASFPVTRKANNDITSITSNGGRVSCMKVWPPIGKKKFETLSYLPDLSDVELAKEVDYLXRNKWIPCVEFELEHGXCVXREHGETLPDTYDWXXLXQXWXVPXLFGLDRXXXKXLRXVXXCKKGFPXASFXFXG

SEQ ID NO: 13280 - protein, 151 aa, Brassica napus
METDRAVVIGGGASRYALKPTRITSEDILICVDVDAESMVEMKTTGTNGRPLTRMECVKQAIILFIHNKLSINPDHRFAFATLSKSAAWLKKDFTSDAASAIASLRGLSATKSSGRADLTQLFRVAAQEAKISRAQSRILRVILIYCRSSV

SEQ ID NO: 13281 - protein, 253 aa, Glycine max
MGRKFFVGGNWKCNGTTEEVKKIVTTLNEAKVPGEDVVEVVVSPPFVFLPVVKSLLRPDSHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIVNAATVKKN

SEQ ID NO: 13282 - protein, 117 aa, Arabidopsis thaliana
  misc_feature (19)..(19): Xaa can be any naturally occurring amino acid
  unsure (1)..(117): unsure at all Xaa locations
HQTLRPSSTLSSATMVASXAQAGIYTPGNGLKSSAAFPATRKANNNITSITSNGGRVNCMQVWTTIGKKNFETLSYLPDLTDSELAKEVHYLIHNKSIPCVQFKLQHPFVYRKHSNS

SEQ ID NO: 13283 - protein, 149 aa, Gloeobacter violaceus PCC 7421
MERTFIAIKPDGVQRGLVGEILQRFERRGFKLVGLKLMQVSEALAQKHYAEHKERPFFGGLVAFITSSPVVAVVLEGKGVVATARAMMGVTNPLNSPLGTIRGDYGIDIGRNIIHGSDSLESAEREIALWFAPAELLEWQATLGSWVYE

SEQ ID NO: 13284 - protein, 1212 aa, Daucus carota
MHTQRRMDSMSLLFLLILLFCNFSESRKLSGQVKDQGNEVEGLANFKKFSVDAGPNGFLKTWDSSSSSSPCSWKGIGCSLEGAVTVLNLTGAGLVGHLQLSELMDNLPSLSQLYLSGNSFYGNLSSTASSCSFEVLDLSANNFSEPLDAQSLLLTCDHLMIFNLSRNLISAGSLKFGPSLLQPDLSRNRISDLGLLTDSLSNCQNLNLLNFSDNKLTGKLTSFLSSCKNLSTVDLSYNFFSQIHPNFVANSPASLKFLDLSHNNFTGNLVNLELGTCHNLTVLNLSHNSLSGTEFPASLANCQFLETLDMGHNDFHLKIPGDLLGNLKKLRHLSLAQNSFFGEIPPELGNACRTLEVLDLSGNQLIEQFPTEFSLCTSLVTLNVSKNQLSGDFLTSVLSPLPSLKYLYLSFNNITGSVPPSLTNATQLQVLDLSSNAFTGTIPTGFCSTSSSFSLEKLLLANNYLKGRIPSELGNCKNLKTIDLSFNSLIGPVPSEIWTLPYIADIVMWGNGLTGEIPEGICIDGGNLQTLILNNNFISGSIPQSFVKCTNLIWVSLSSNQLRGTIPAGIGNLLNLAILQLGNNSLTGEIPPGLGKCKSLIWLDLNSNALTGSIPPELSSQSGLVSPGPVSGKQFAFVRNEGGTACRGAGGLLEYEGIRAERLEKFPMVLACPSTRIYSGRTVYTFASNGSIIYFDLSYNALSGTIPESFGSLNSVQVMNLGHNNLTGSIPSSFGGLKYIGVLDLSYNNLQGAIPGSLGGLSFLSDLDVSNNNLSGSVPSGGQLTTFPSSRYENNAGLCGVPLPPCGSENGRHPLRSNSQGKKTSVTTGVMIGIGVSLFSIFILLCALYRIRKYQQKEELRDKYIGSLPTSGSSSWKLSSVPEPLSINVATFEKPLQKLTFAHLLEATNGFSANSLIGSGGFGDVYKAQLGDGRVVAIKKLIHVTGQGDREFMAEMETIGKIKHRNLVPLLGYCKIGEERLLVYEYMKWGSLESFIHDRPKVGGGLRIDWPARKKIAIGSARGLAFLHHSRIPHIIHRDMKSSNVLLDENFEARVSDFGMARLVNAFDTHLSVSTLAGTPGYVPPEYYQSFRCTAKGDVYSYGVVLLELLSGKRPIDPAQFGDDNNLVGWAKQLHKEKRDLEILDSELLLHQSSEAELYHYLQIAFECLDEKAYRRPTMIQVMAMFKELQMDSETDILDGLSVKNSVIDESL

SEQ ID NO: 13285 - protein, 323 aa, Aspergillus nidulans FGSC A4
MSLPSHFSLNTGAKIPAVGFGTWQAKPLEVENSVEVALKQGYRHIDCAAIYRNETEVGNGIRKSGVPREEIFLTGKLWNTKHAPEDVEPALDKTLKDLGVEYLDLYLMHWPCAFKASDKWFPLDDNGVFQLADIDYVTTYRAMEKLLNTGKVRAIGVSNFNVRRLEDLLSKVSVVPAANQIEAHPYLQQPDLLRYCQSKGIIIEAYSPLGNNQTGEPRTVDDPVVHTVAGQLSMDPGPLLASWAVQRGTVVLSKSVTPSRIAANLQVKRLPDDAFATLAALERHKRFNFPAFWGYDIFDEAGEEAVKKAAMDAAPINKTKFTV

SEQ ID NO: 13286 - protein, 368 aa, Prunus cerasus
MGKGGMSSQGGALEPMDGEQENMAAWLVGVNTLKIQPFKLPTVGPNDVRVKIKAVGICGSDVHYLKTMKCADFIVQEPMVIGHECAGIVDEVGSMVKNLLPGDRVALEPGISCWRCEQCKGGRYNLCPDMKFFATPPVHGSLANQIVHPADLCFKLPENVSLEEGAMCEPLSVGVHACRRANIGPETNVLVIGAGPIGLVSVLSARAFGAARIVIVDVDDERLSIAKSLGADDSVKVSTNPQDLENEVSKISKAMRGGVDVSFDCVGFNKTMSTALSATRPGGKVCLVGMGHGVMTVPLTPAAAREVDVVGIFRYKNTWPLCLEFLRTGKIDVKPLITHRFGFTQKEIEEAFETSARGGNAIKVMFNL

SEQ ID NO: 13287 - protein, 429 aa, Bacillus cereus E33L
MKKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 13288 - protein, 161 aa, Glycine max
MQKAKGTVAARKHTSKIMKAYFSDPVNRQKRSMAMKGVKFYCQNCGREGHRRHYCPELNDSLVDRRFTCRLCGGKGHNRRTCRKLKISLSNGRTIKHHQCKICHQFGHNRRTCPQAVPFAVPSKRRNAASRRPYKCRLCKKEGHNIRTCPSRTVVTENPQD

SEQ ID NO: 13289 - protein, 272 aa, Vibrio parahaemolyticus RIMD 2210633
MEHKKIAFIGAGNMVRAIVSGLVANGYPAQNIVATAPSEARRLPLEQDFGIRTTSDNMLAASEADVVVLSVKPQMMADVCKPLQSIDFSNKLVISIAAGINCSRLDEMLATKLNLVRVMPNTPSQLGLGMSGLFAPEHVKEQDRAFAAELMQAVGKVCWVEQESGINNVIAAAGSAPAYFFLFMEAMQAEAIAQGFDKETARLLVQQAALGAASMVVSNPDTELSTLRENVTSKGGTTAEALRTFNEHQLTDIVAKAMQAAVARAEEMEKLF

SEQ ID NO: 13290 - protein, 428 aa, Bacillus anthracis str. 'Ames Ancestor'
MKNKAIGLFQGIALYISAILGSGVLFLSGVTASIAGPASIVSWFIVIIISFPLAYSFASLARIFPDSGGAATFVRNSFGYHLGNIVGWFYFVTAAVGQTIVSLTGAFYVSQAFGFSHFETILIAVFILVIAGVSNYYGVNVSGKVALILSSLLLILFASAVFVAFPRIQWGNFNPFVPNGWFSVGNAITVIFWSFFGWEAICNLAEHFKRPEKDIVKGAVISAVVIGLLFLALSLVTIGTATYGSQESNLSPIGVIMGDTVGGGAKVVTAVLALIICTGTANAFVASLTQLGYSLSRDGAFPKFFSRLHATTQIPRQMVLFVICFSVAGVLVTKALSLTFDDILFIPTSLGILVYVLSMAAGVKLFRKNTPAWWASLISFILCLLVIPFFQLYIFVPLIVVAIYTIYMILSNKIFAYKGGLKSNEGSK

SEQ ID NO: 13291 - protein, 458 aa, Erwinia carotovora subsp. atroseptica SCRI1043
MANDQQELVLKRGLKNRHIQLIALGGAIGTGLFLGISQTIQMAGPSVLLGYAIAGMIAFLIMRQLGEMVVEEPVAGSFSHFAFKYWGDFAGFLAGWNYWAMFILVGMAELTAVGIYIQYWWPDTPTWLSAAIFFVLINLINLVNVKMFGETEFWFAIIKVLAIVGMIVFGSWLLLSGNGGETATVRNLWIHGGFMPNGASGLIMAMAVIMFSFGGLELVGITAAEAADPKRSIPQATNQVVYRILIFYIGALSILLSLYPWGNVVGGGSPFVLIFQALNSNIVANVLNVVVLTAALSVYNSGVYCNSRMLYGLAKQGNAPKSLAKVNARGVPVRSIALSALATSLGVAINYVMPGKAFELLMALVVSTLVINWIMICFAHLRFRQAMMEKGIVPAFKAFWYPWSNYLCLAFLAGILVIMLLSPGIRISVMLIPFWIAVIWLGFRFSRKTYSPAKIVPR

SEQ ID NO: 13292 - protein, 451 aa, Oceanicola granulosus HTCC2516
MSDWLNSLPSAARAYLESTGLDEVECVIADFPGIARGKAVPAGKFQRLTHFHLPNSIFYQTITGDWGEEAAQDGFTEPDMILRPDMETATAAPWADDGTLQVIHDAFDQAGDPIPLAPRNVLKRVVELYRAQGWEPIVAPEMEFYLVGRNTDPAKEIVPMMGRTGRPAAARQAYSLTAVDEYGPVIDDIYHFAEVQGFEIDGITQEGGAGQVEINLRHGDPVKLADEIFYFKRLIREAALKRDCFATFMAKPIEGEPGSAMHIHHSVSDAEGRNLFTGEDGAETDAFFHFIGGLQQHLPSVVALLAPYVNSYRRYVKDHAAPINLEWGRDNRTTGIRIPVSDPASRRVENRIAGMDCNPYLGIAASLACGYLGLRDKLRPHELFDGDAYEAEDAIPRGIYAALEQFDAAKDMHEVLHPEFARVYSIVKATEYDEFLQVISPWEREHLLLNV

SEQ ID NO: 13293 - protein, 92 aa, Glycine max
VLNLVPNRTSPQPLFLVSVRATWAFVERNYKELKTLNPKLPILIRECSGVEPQLWARYDLGVEKGIKLEGLSEAQIFKALEDLVKAGQSMKA

SEQ ID NO: 13294 - protein, 1065 aa, Bacillus anthracis str. 'Ames Ancestor'
MDKKVSAIPQPKTYGPLGNLPLIDKDKPTLSFIKLAEEYGPIFRMQTLSDTIIVVSGHELVAEVCDETRFDKSIEGALAKVRAFAGDGLFTSETQEPNWQKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEEYQLDVKQTLTLKPGDFKIRIVPRNQTISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKGDELKGVQYAVFGCGDHNWASTYQRIPRYIDEQMAQKGATRFSTRGEADASGDFEEQLEQWKQRMWSDAMKVFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFEPFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNVGEAHLYFGCRHPEKDYLYRTELENDERDGLISLHTAFSRLEGQAKTYVQHVIKEDRIHLISLLDNGAHLYICGDGSKMAPDVEDTLCQAYQEIHEVSEQEARNWLDRLQEEGRYGKDVWAGI

SEQ ID NO: 13295 - protein, 400 aa, Oceanicola granulosus HTCC2516
MQLLSATLDRVKPSPTVAMSGRALELKAAGRDVIGLAAGEPDFDTPPHVAAAGIRAIEEGRTRYTAVDGTAELKRAICAKFARDNGLDYGPAEISVGTGGKQVLYNALMATLNPGDEVVIPAPYWVSYPDMVRLAGATPVIVEAPLSAGFKITPAQLEAAITGRTRWLILNSPSNPTGAAYSEAELKGLTDVLLRHPHVWVLSDDIYEHLVYDGFRFTTPAQVEPRLKARTLTVNGVSKAYAMTGWRIGYAAGPEALIAGMRKVQSQSTSNPCSISQFAALAALEGPHDFLAERNAAFLRRRDMVVARLNEIDGIDCPVPEGAFYVYPSIKGLIGKVSAGGTEIADDEAFAMALLDEAEVAVVFGAAFGLSPAFRISYALADETLAQACDRIARFCAGLR

SEQ ID NO: 13296 - protein, 407 aa, Arabidopsis thaliana
WSHKGSFAEELPIGGYGCSVIQTIFNAINVMAGVGLLSTPYTVKEAGWASMVILLLFAVICCYTATLMKDCFENKTGIITYPDIGEAAFGKYGRILICMLLYTELYSYCVEFIILEGDNLTGLFPGTSLDLLGFRLDSKHLFGILTALIVLPTVWLKDLRIISYLSAGGVIATALIAVSVFFLGTTGGIGFHHTGQAVKWNGIPFAIGIYGFCYSGHSVFPNIYQSMADKTKFNKAVITCFIICVLLYGGVAIMGYLMFGEATLSQITLNMPQDQFFSKVAQWTTVVSPFTKYALLMNPLARSIEELLPERMSENIWCFLLLRTALVASSVCSAFLIPFFGLMMALIGSLLSILVAIIMPALCFIKIMGNKATRTQMILSSIIVAIGVVSGTLGTYSSVAKIIRNYQ

SEQ ID NO: 13297 - protein, 705 aa, Saccharophagus degradans 2-40
MRTQNATITRLVLFLSLSLAISACNGNGPKQNTISEQTPPADQTPAQPDDTAGADTEGTEDPKETPDTENNSPTVRIHYLNSNQAYDNWGLHLWGDAIASSTATNWTSPFALTRAENDYGLYEVPLADPNGTFNFIMHFGDFKNPAYDFSIIPAQFGTDVWLVQDTPADVTNGVAIPFDNEADARAAYESLMANIGNASAALDLTDIEIKDSDTGLAADWVDTAHFAEIYIRGYQDSDGNGIGDIQGLISRLDYLAESGINGIWLMPAMESSDNDHGYATSDYRAIESDYGTMQDFQQLLDEAHARNIAIVMDYVMNHSSNANPLFQDALSSPTNSKRDWYIIRDDKLEGWNTWGSDPWKSNANGYYYAAFSSQMPDFNLRNPDVIRFHQNNLRFWLNMGVDGFRFDAVGVLVENGKDAWEDQDDNHPVINAMKTTIEAYQKRYIVCESPTGYAAFAQQNSCGRAFNFSAGHGILRSVKQGKLDAEFVEQLNASNIDAMPLILANHDAFAGIRVWDQLNGNKTHYKLAAASYLLASRNPFTYYGEEIGLAGAANLSGDWSIRTPMSWNNDPQNAGFSTAQPFRELSANVMTQNVEAQLGKTDSLLAYYRSIYDLRNAHPVIANGNLNVQGQANDNALVLVRTSDDAQAVILFNYSAQATSKSVSGLTASANYSGALGASNNVSANASGTATVTIPAQTAVVYIRQ

SEQ ID NO: 13298 - protein, 471 aa, Mesorhizobium loti MAFF303099
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQALQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 13299 - protein, 334 aa, Medicago truncatula
MKATLRYLAGIAGPSGFGSNSTAEQVTQNCSSFLPSGLTALITGGTSGIGAETARVLAKRGVRIVIGARDLKKAMKVRDNIQKESPNAEVILLEIDLSSFCSVQRFCSDFLALDLPLNILINNAGVFSQDLEFSAEKIEMTFATNYLGHFLLTEMLLDKMIETSKKTDIQGRIINVSSVIHSWVKRHGFCFKDILNGKKYNYNGTRAYAQSKLANILHAKEIARQLKARKARVTMNAVHPGIVKTGIIKSHKGLITDSLFFIASKLLKSTSQGAATTCYVALSPKTEGVSGKYFTDCNESKCSRLANEESEAQKLWNNTHALIHKRLHQATNNM

SEQ ID NO: 13300 - protein, 91 aa, Triticum aestivum
MAGAAKASWMVAMSVGAVEALKDQAGLCRWNYALRSIIHRAAKARANVRGGVSQGAKQLPASAAAAAERRRAEKAEEGVRTVMYLSCWGPN

SEQ ID NO: 13301 - protein, 931 aa, Bartonella quintana str. Toulouse
MQERSFFSRHIGLRSDETQKMLDVLGLDCIDTLVSQAIPHSIHLGRVLNLPKAVSEGQALEELSKIMGRNHVHKSFIGQGYHGTCVPPVILRNLFENPAWYTAYTPYQAEISQGRLELLFYFQTLISELTGLPVAAASLLDEATALAEANAVAVRFAREKKTKISLQSLLHPQILSVVQTRAETQGISISENSEICSNTAAIVLSWPDTKGFFNDYSEVIKEAKAKGALVIVVADPLALTLMEPPAQWGADIVVGSMQRYGVPMGFGGPHAGYLAVSDALIRLIPGRIVGQSVDTKGRVGFRLALQTREQHIRRDKATSNICTAQALLANMATAYAVWHGPQGLQEIAQRIHSLTCRFMGGLEAAGIPCEGESFFDCVSVVVKGKAQEIARQAKAGGRLVRILDDDRVAVNFDELSTEEDACTLAQLFGAQLVDQVSPRLWGKGRDAAFLSQPFFHVVHSETDMMRFLRRLSDKDLALDRAMIPLGSCTMKLNAAAELMPVSWPTVANIHPFVPKEDAAGYQEMINQLNAWLCEITGFAQVSFQPNSGAQGEYAGLLAIRRYYQSRGENQRTLCLVPASAHGTNPASAHMAGMEVVVVKCLSDGDVDIDDLKMKAQLHKDRLAALMITYPSTHGVYEENIKDICSLIHENGGQVYFDGANLNALVGLTRPADIGADVCHMNLHKTFAIPHGGGGPGVGPIGVAEHLKPFLPGHAQNGTTHAVSAAPYGSASILVITWMYIRMMGAKGLKYATQTAILNANYIAERLSQAYSILYRGKHGRVAHECIVDTRVLKEQYGVSVDDIAKRLIDYGFHAPTMSFPVPGTLMIEPTESEPKAEIDRFCDALLSIAEEAKKVGAGVWPKDDNPLVNAPHTLVDTLDDAWVHPYSRQEAAFPNHHLDPTNKYWPPVSRIDNVAGDRVLICSCPPLGNTS

SEQ ID NO: 13302 - protein, 303 aa, Pisum sativum
MDLDQWISKVKDGQHLLEDELQLLCEYVKEILIEESNVQPVNSPVTVCGDIHGQFHDLMKLFQTGGHVPETNYIFMGDFVDRGYNSLEVFTILLLLKARYPANITLLRGNHESRQLTQVYGFYDECQRKYGNANAWRYCTDVFDYLTLSAIIDGTVLCVHGGLSPDIRTIDQIRVIERNCEIPHEGPFCDLMWSDPEDIETWAVSPRGAGWLFGSRVTSEFNHINNLDLVCRAHQLVQEGLKYMFQDKGLVTVWSAPNYCYRCGNVASILSFNENMEREVKFFTETEENNQMRGPRTGVPYFL

SEQ ID NO: 13303 - protein, 247 aa, Candida glabrata CBS 138
MPKLVLVRHGQSEWNEKNLFTGWVDVRLSAKGEQEAARAGELLKEKNVHPDILYTSKLSRAIQTANIALSKADRLWIPVKRSWRLNERHYGALQGKDKAETLETYGEEKFNTWRRSFDVPPPVIEADSPYSQKNDERYRDVDPNVLPQTESLALVIDRLLPYWEDVIAKDLLAGKTVMIAAHGNSLRGLVKHLEGISDADIAKLNIPTGIPLVFELDENLKPSKPSYYLDPEAAAAGAAAVAAQGKK

SEQ ID NO: 13304 - protein, 103 aa, Glycine max
  misc_feature (68)..(68): Xaa can be any naturally occurring amino acid
  misc_feature (81)..(81): Xaa can be any naturally occurring amino acid
  unsure (1)..(103): unsure at all Xaa locations
MASSMISWPGVTTVKRADAGMVASFTGLKSMAGFPTSNTNNDITFIAINGGRRRCTQASPPIGNKKFXTLSYLTDLDNAQXAKEVLFLLTKGLIPCFKFELEH

SEQ ID NO: 13305 - protein, 320 aa, Debaryomyces hansenii CBS767
MVLFRSQIRSIPRLRYFSTKSIIRSSYQTDVKRKTLLDIQRLYETKTPISVVTAYDFITGKYAESADVDINLVGDSLAMVALGYEDTTEISFDEFLYHTKAVLRGNKLSFMVADIPFGSTEISVEQAVSSAIKLVKYGKVQGVKIEGGSDIVPTVKKLSSIGIPVMAHVGLTPQRHNALGGFKVQGNNTERALEIYRDCLDLQEAGAFSLLLECIPNKLSEYITKNISIPTIGIGAGPGCSGQVLVMSDLLGMGDPKDSMKPKFVKQYNDFFSSAIHSLHAYKRDLQHGKFPLADDHGFKIKKEVFHDFKMQAEAMKKAN

SEQ ID NO: 13306 - protein, 145 aa, Triticum aestivum
  misc_feature (50)..(50): Xaa can be any naturally occurring amino acid
  misc_feature (76)..(76): Xaa can be any naturally occurring amino acid
  misc_feature (123)..(123): Xaa can be any naturally occurring amino acid
  unsure (1)..(145): unsure at all Xaa locations
WDVPLSKDRPAAEEHVFKVLRTGKRKTKQCKRMVTNAAFARAAFTRNPPXHDRFIRSTGLRFTKAHATHPELKCTXFNLDIISVEKNPDGPMDTSLGDMTRRTIIEENVSELSLVTPAGRVVXGIYSQDTNNPENDVCINADLLV

SEQ ID NO: 13307 - protein, 123 aa, Brassica napus
MAAGGGGGGSSSGRTPTWKERENNKRRERRRRAITAKIYSGLRGQGNYKLPKHCDNNEVLKALCLEAGWIVEDDGTTYRKGSKPPASDMLGTFSTNSSIQPSPQSSAFPSPAPSYHGSPVSSS

SEQ ID NO: 13308 - protein, 130 aa, Brassica napus
  misc_feature (9)..(9): Xaa can be any naturally occurring amino acid
  unsure (1)..(130): unsure at all Xaa locations
MEQTFIMIXPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALW

SEQ ID NO: 13309 - protein, 732 aa, Debaryomyces hansenii CBS767
MRSPNNIIEDSNISRIASSNSRALPSFSQMLARSKNNTNNYLNDNNDSNNSSVNQEFEFQMDNDSSSDYRELRNSIIQRRQSSTSNHRNEIQKLNYKNSLLLNLPTEILLQIFHHLDRKELYSLLTVCHEFADLIIEILWFRPNMQNDDSFKKIKTIMEIPKGGTHWDYRSFIKRLNLSFMTKLVDDDLLKLFVGCPKLERLTLVNCTKLTYSPVTSVLKNCEKLQSIDLTGVTGIHDDIILALANNCPRLQGLYAPGCGKVSEDAILKLLKSCPMLKRVKFNGSANITDRSIEAMHENCKSLVEIDLHNCSNVTDKYLKLIFLNLSQLREFRISNAAGVTDRLFELLPSEYYLEKLRIVDITGCNAITDRLIEKLVMCAPRLRNVVLSKCMQITDASLRALSQLGRSLHYIHLGHCGLITDFGVASLVRSCHRIQYIDLACCSQLTDWTLVELANLPKLRRIGLVKCSLISDSGILELVRRRGEQDCLERVHLSYCTNLTIGPIYLLLKNCPKLTHLSLTGISAFLRREITQYCRDPPPDFNEQQKNSFCVFSGNGVSQLRNHLNQIMEDRSYLIDHGDMHALFHERRRRFMNGGNDMDDEEMNLWVRQRGLGVLQGGDLGNPEVAEINREIFRELNEGNMGPEEMREHFQRLIRNHHQQRLLQRQMLEQDLQFQPDQQNQDPQNAPQIIQPAVFPNGDQLIQFVNGEGEDDDDVEMQPVDLFPRDRNPPA

SEQ ID NO: 13310 - protein, 397 aa, Burkholderia thailandensis E264
MNTAADSLLRLASRVDAIEPFYVMEIVKEAAVLERAGRDIIHMSIGEPDFTAPEPVVDAAAAALRRGVTQYTSALGIAPLREAIAAHYARAYGLSIGPERIVVTAGASAALLLACLALVGRDDEVLMPDPSYPCNRHFVATAEGRAVLVPSGPEARFQLTADDVRTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPHTLAIYEARRAEFKRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 13311 - protein, 483 aa, Pseudomonas fluorescens Pf-5
MSVRRTKIVATLGPASNSPEVLEQLILAGLDVARLNFSHGTPDEHKARAKLVRDLAAKHGRFVAILGDLQGPKIRIAKFANKRIELKIGDKFTFSTSHPLTEGTQDIVGIDYPDLVKDCGVGDELLLDDGRVVMRVETATATELHCVVTIGGPLSDHKGINRRGGGLTAPALTEKDKADIKLAAEMEVDYLAVSFPRDAADMEYARKLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRMGKVFESCDQSIALAAMYTANHFPGVKAIIALTESGYTPLIMSRIRSSVPIYAYSPHRETQARAAMFRGVYTIPFDPASLPPEQVSQAAIDELLKRGVVEKGDWVILTKGDSYHTTGGTNGMKILHVGDPMV

SEQ ID NO: 13312 - protein, 380 aa, Methanocaldococcus jannaschii DSM 2661
MSENMATIPIGPIHPVLKEPLRIKLVLDGEKPVDAEIEMGYVHRGIEKIMEGKHCHKGIHLAERVCGICSYVHTMTFAECIEHISKIEIPDKAKYLRVVTCELERIHSHLIASAVYNLSIEHETLAMWLLNVREIIMDLMEMITGNRVNMGYNVIGGVRRDINREMMDEIYKKLDIFEDELKNIIEVFETGPLIALRSKEIGILPYHEVMRTRAVGPICRGSGLPESDWRLRHSTYQELKFKPVWREEGDNFARMMVRHEEIIESVRLIREALEHYEECSGDIRVKAEIKGGKGEWRNEAPRGEVTYRMEITDGGIIKRIMIRTPTVMNLEAYKYMLKTCPTVADAVSAYTSIDPCVSCTERCIVAVKDGKEIPISIKFR

SEQ ID NO: 13313 - protein, 320 aa, Photobacterium profundum SS9
MKEHATRLALVKLLADGQFHSGEALGESLGISRSAISKHIKVLQLWGLDLFRIQGKGYCVSTPIELLDCDKILSQVKCPQLELIPIIDSTNQYLLDRFGLLPKGAVCLAEYQQAGRGRRGRQWLSPFGSNLYLSMYWRLDAGMAAAMGLSLIVGVAIAETLQSLGANEVRVKWPNDLYYKDKKLAGILVEMTGQAGDAAHLVIGMGLNIDMPDTEGSDIGQAWTNLSQACDKLPERNHLAAELIDSLQKTLITYEQVGLDGFVERWNRIDNFLNRPVKLLIGQRVIEGIARGIDKQGALLLETESGIEPYIGGEISLRGC

SEQ ID NO: 13314 - protein, 394 aa, Synechococcus sp. WH 7805
MTQLETRTEPMVVNFGPHHPSMHGVLRLVVTLDGEDVVDCEPVIGYLHRGMEKIAENRTNVMFVPYVSRMDYAAGMFYEAVVVNAPEKLANIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGVIGKDEAINWSLSGPMLRASGVPWDLRKVDHYECYDDFDWDVAWEKEGDCFARYRVRIEEMRQSLKILRQACDMIPGGPTENVEARRMAEGKDSEFAGFDYQYVAKKVAPTFKIPNGELYTRLESGKGEIGIFIQGNNDVTPWRFKIRAADSNNLQILPHILKGHKVADIMAILGSIDVIMGSVDR

SEQ ID NO: 13315 - protein, 362 aa, Frankia sp. CcI3
MGAQTVEAVVAREKGAAVSLEQIVVPDPGPGEARVRVRACGVCHTDLHYREGAINDDYPFLLGHEAAGTVESVGEGVVGLAPGDYVVLAWRAPCGTCRACRRGMAWYCFDSRNARNPMTLADGTPLAPALGIGAFTPLTLVAAGQCVPVDPAARPEAAGLIGCGVMAGFGAAVNTGRVTRGETVAVIGCGGVGGAAIAGASIAGARKIIAVDVDDRKLTWARRFGATDVVNATADDPVAAIRALTDGFGADVVIDAVGRPETYRQAFDARDLAGRLVLVGVPDPTMTVELPLAEVFGRGGHLSSSWYGDSLPSRDFPILIDLYRRGRLDLDAFVTETIGIGDVEEAFTRMQRGDVLRSVVIL

SEQ ID NO: 13316 - protein, 373 aa, Acinetobacter sp. ADP1
MPLSHVEALVEDIRAGKMVILMDDEDRENEGDLVMAATHVRPEDINFMITHARGLVCLTLSRERCQQLNLPLMVDHNGAQHATNFTLSIEAAEGITTGISAAERAHTIRTAVAAHAKPSDIVQPGHIFPLMAQPGGVLHRAGHTEAGCDLTRLAGLEPASVICEIINEDGTMARREDLEVFAEKHGLKIGTIADLIHYRMTNEQTVERLGQQTIETDYGSFELYRYREIGNPDIHLALVKGEPKDGVTTVRVHGFNPTRDLLKLKKQDGEPAWNLDRALQSIASAERGVLVWIGQNHLQDLGPALESLTQPKPLKSNAALSHQYQTIGVGAQILRDLGVEKMKLLSSPLRFNALSGFNLEVVEYITADQTIEN

SEQ ID NO: 13317 - protein, 357 aa, Sinorhizobium meliloti 1021
MPKMKAAIFVAPGRIVLDEKQIPDVGPLDALMRITTTTICGTDVHILRGEYPVARGLTIGHEPVGVIEKLGSAVRGYSEGQRVIAGAICTSGHSNAALCGCHAQDGPGTKHGWKGMGGWKFGNTIDGSQAEYVLVPDAMANLAPVPDGLADEQVLMCPDIMSTGFSGAESGAVRVGDAVAVFAQGPIGLCATAGARLIGATTIIAVESVPARMEMARRMGADDVVDFTVSDPTAEIMRLTDGRGVDVAIEALGRQETFEGALRVLRPGGTLSSLGVYSGDLRIPLDGFLAGLGDHTIRTTLCPGGKERMRRLMEVIASGRVDTRPLVTHRFKLDQIEEAYDLFANQRDGVLKVAINP

SEQ ID NO: 13318 - protein, 404 aa, Shewanella oneidensis MR-1
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 13319 - protein, 236 aa, Shigella flexneri 2a str. 301
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 13320 - protein, 501 aa, Pseudomonas fluorescens Pf-5
MSSLGSRSSTSIQPVILCGGSGTRLWPLSRQSYPKQFMPLLGGRSLLALTLERVSGLSSHPWCVASTEHRFLVIDAFEQCQLNGQVLLEPSARNTAAAIAVAALHAEDDALLLFCPADHYIPDAPAFVERVRQAQVAALDGALVTFGVFPTYPSSAYGYIEASAPWQDSGALHVQRFIEKPSATQAAELLLKGNMYWNAGIFLGLAREWRRALELHAPDILAACRDALREAESPVISRSGQTTVQSVVLHEPSFDACRSQSIDYAVMEHHRPICAVPFNGAWSDVGSWNAVADLSSADDKGNSSQGDAHLFDCQRTYVHAAGRRPVVALGLEDVCIVDTDDAVLVMPMSRAEDIKSVVGQLTDRSVAQALLHRRVARPWGWYDSLDQGERFQVKRIGVKPGASLSLQLHHHRAEHWTVVKGTAEITCGDRVFLLSENQSTYIPLGQRHRLHNPGKVELEIIEVQSGSYLAEDDIVRLEDNYGRTAPHCPGPAEADSTLIEQ

SEQ ID NO: 13321 - protein, 432 aa, Gloeobacter violaceus PCC 7421
MVTSAFQTAQSHRLFAEAQQLMPGGVNSPVRAFKSVGSEPVFIERAEGAYLWDVDGNRYIEYINTWGPSIVGHSHPEVISALREALPKGTSYGAPTRLENQMARTVIDAIPAVEMVRFVNSGTEATMSALRLARAFTGREKIIKFEGCYHGHADMLLVQAGSGVATLGLPDSPGVPKSTTAATLTAPYNDLAAVEALFKQYPSDVAGLILEPVVGNAGCLVPEIGFLEGLRDLTHAHGTVLIFDEVMTGFRLSYGGAQARYGIEPDLTCLGKIIGGGLPVGAYAGRREIMQMVAPAGPMYQAGTLSGNPLAMTAGIKTLEILQRPGTYERLEGLSARLADGLLAAAREAGHAATGNRVGAMFTLFFTEGPVRNFADAKRSDLQKFARFHRGMLERGVYLAPSQFEAGFMSLAHTEEDIDYTVAAARTVLAAL

SEQ ID NO: 13322 - protein, 497 aa, Mesorhizobium loti MAFF303099
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 13323 - protein, 296 aa, Triticum aestivum
NSFPPSRSNFIVFKQFKGTITVLDESTLEINGKKVSVTSKRDPSDIPWGNFGAEYVVESSGVFTTVEKASAHLKGGAKKVVISAPSADAPMFVVGVNEKNYNPSMDVVSNASCTTNCLAPVAKVVHEEFGILEGLMTTVHATTSTQKTVDGPSMKDWRGGRGAGQNIIPSSTGAAKAVGKVLPALNGKLTGMAFRVPTPNVSVVDLTCRLEKNASYEDVKAAIKEASEGPLKGILGYTDEDVVSNDFVGDTRSSIFDANAGMGLSSSFMKLVSWYDNEWGYSNRVLDLIGHMVLVA

SEQ ID NO: 13324 - protein, 235 aa, Glycine max
HASADAWADAWADAWAGASAAAEGDRPREILVQHLLVKEDDQKLLLDIQQRISSGEDLSDLAVEYSLCPSKEEGGMLGWVRKGQMVPEFEEAAFTAPLNKVVSCKTKFGWHLLQVLSEREESILQDIQPDELHVKIQDPSFFDGAQLIDVREPEEVAKASLPGFTVLPLRQFGSWGPEITTKFDPQKDTYVLCHHGMRSLQVAKWLQSQGFRKVYNLSGGIHAYAVQVDPSVPTY

SEQ ID NO: 13325 - protein, 956 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSRTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGALMIEPTESESKAELDRCLRCSHFNQGRNCTD

SEQ ID NO: 13326 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 13327 - protein, 668 aa, Methanosarcina acetivorans C2A
MVYETSKQLEIDSEPLLEKVYGEDKVVEMFANTLEIVERAGPECTTSLKQLEIDIKPALEKVYGEDRVDEMFANILEIIERARSERAASLKMDDLTRDCSWYKDEIMYTFYADQFGVKNKNTTNTFKDLIEMLPYLKGLGVTTLYILPFMDSPMGDAGFDVRDPQKVREDLGGIAEFDQFMAEAKKYGFKIQADLVLNHFSDQHEWFQDALNGDVSKLDYFIFRKEPPKYERSQKGTIIKYFEEDGVPPSERRIVFADASEETHYRKVDIGGKDYYLYHTFYPFQLDINWENPEVLYYVLEKIIAFWSNKGIDIFRLDAIPFLIKEKGTNAENQPGTHCIIKILSSFNQAIGPRSIFHAEACEPPKEVLKYFSKERVFNIYGGENLTRTDGVQVAYNFPYMPAIWASLITGSNEYFWNVHEETPSIPESAAWAQFLRVHDELTVEMADTGTRKIIYDALLSKGKDFKGLGISGRMANFLDKNPAKIGLAFAILLSLPGIPVIYYGDEIGAENNTNYGEEAGNKRKEVLNKINTNFCSFDSRDINRGPILKSDFYSSEKDNVIHKTVKNLIEVRKGMSVLGRGKLSRLESDNKEIFSYLIDSDDQYVIVVNNLSGEKLETSLTLSNDLVEKIDKTTGMVNLIDRGKINVCLKCKKLIVSLEPYQTLWLN

SEQ ID NO: 13328 - protein, 586 aa, Oceanobacillus iheyensis HTE831
MRNTKIVCTIGPASESIEKLEQLIEAGMNVARLNFSHGDYAEHGARIENIRKAAKNKNKTVAILLDTKGPEIRTGSFKEGRADLMQGNPVTIAMDEVEGTAEKFSVTYQGLINDVHEGSKILLDDGLIELEVKSIDKSKGEIETIALNSGEIKNKKGVNVPNVSVNLPGITEKDTNDIIFGIEQGVDFIAASFVRRASDILEIKEVLDQHQAQYIKIIPKIENQEGVDNIDSILEVSDGLMVARGDLGVEIPAEDVPLVQKKLIKQCNNAGKPVITATQMLDSMQRNPRPTRAEASDVANAIFDGTDAIMLSGETAAGTYPVESVQTMSNIALKAESALDHKQMLEERSQYVDMTITEAISQSVTHTASNLNVDTIITPTESGHTARMISKYRPKASILAVTFNEVVNRQLSLVWGVHAVLGKPATSTDEMLEIAVDKGLNTGICSRGSRVIITAGVPVGESGTTNLLKVHVIGDVIAKGQGIGRRSAYGHAVFAKTNKEALEKVQDGDILVTYATEKEMMPAIEKASAIITEEGGLTSHAAVVGLSLGIPVIVGVDNVFEILQDGQDITVDGNRGDIYAGHAGVL

SEQ ID NO: 13329 - protein, 390 aa, Gloeobacter violaceus PCC 7421
MKAVCWHGAGDVRVETVPDPAILYPRDAIIKVTSTAICGSDLHLYDGVIPTMQKGDILGHEFMGEVVEVGAAVKNLRKGDRVVVPFTIACGHCHFCERTLWSLCDNSNPNAWMAEKVYGSTSGSGLFGYSHLFGGYAGGQAEYVRVPFADTGPMKVPESLTDEQVLFLTDIFPTGYMAAENCNIQPGDTVAVWGCGPVGQFAIKSAYMLGADRVIGIDRHPKRLKMAKEQGGAEVLNLDEVEVGEALKEMTGGWGPSHCIDAVGLEAHGSGIEGIYDNVMNALKLETDKPAALRQAIVACRKGGTVSIPGVYGGLLDKMPMGAAFAKGLTFKMGQTHVHRYLQPLLERIVQGELDPTFVITHRLKLDDAPEGYRTFRDQKDDCIKVVLKP

SEQ ID NO: 13330 - protein, 263 aa, Oryza sativa (japonica cultivar-group)
MTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEK

SEQ ID NO: 13331 - protein, 180 aa, Nicotiana sylvestris
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 13332 - protein, 398 aa, Methylobacillus flagellatus KT
MELSQRVQSIKESPTLAVTARAAKLKAEGRDIIGLGAGEPDFDTPQHIKDAAKQAIDQGFTKYTPVAGIPGLKKAIVAKFKKENGFDYTEKEVIVGVGGKQCIFNLALAVLNPGDEVIVPAPYWVSYADIALVAGAKPVIIECGIEQGFKLTAAQLEAAITPQTKLFMINSPSNPTGAVYSLEELKALGAVLKKHPHILVATDDMYEHVNLTGDKFYNILNAAPELKERCIVLNGVSKAYSMTGWRIGYAAGPAKIIKAMEILQSQSTSNPTSISQVAAQAALEGPQECITPMLDAFRERHEFVVKRFNEIKGLKCIKAGGAFYAFPDAREAIHNLFAAGKIKQATDMALSEYLLEQEGVAVVPGSAFGAEGYFRISFATSMDNLKKALERIERALAN

SEQ ID NO: 13333 - protein, 574 aa, Thermoanaerobacter ethanolicus
MIKEAIFHKSDVPYAYPLNENQLKIVLRTAVFDVDRVYVLYKDRYDWLGKFKIKPMVLTHTNELFDYYETTLELNKKFVYFFYLVSDGGEKLYYTEAGFYKKRPENHFWGFFHYPYIGEKDVFFAPEWTSDCMVYQIFPERFNNGDKSNDPENVKPWGEKPTADSFFGGDLQGIIDKIDYLKDLGINAIYLTPIFLSHSTHKYDTTDYYTIDPHFGDTQKARELVQKCHDNGIKVIFDAVFNHCGYDFFAFQDVIKNGKKSKYWDWFNIYEWPIKTHGKPSYEAFADTVWRMPKLMTKNPEVQKYLLEVAEYWIKEVDIDGWRLDVANEIDHHFWRKFREVVKAAKPEAIIVGEVWHDASPWLRGDQFDSVMNYPFRNAVVDFFAKRKISASRFNTMITEQLMRHMDSVNRVMFNLIGSHDTERFLTLANGMVARMKLALVFQFTFVGIPYIYYGDEVGMVGDYDPDCRRCMIWEEEKQNKSIFNFYKKLISIRRENEELKYGSFCTLYAIGRVFAFKREYKGKSIIVVLNNSSKQEVIFLNEVEGKEDILKMKELKRSGNLLYLQPNSAYILK

SEQ ID NO: 13334 - protein, 494 aa, Candida glabrata CBS 138
MGTGKKEKQRRIREGTTKDGNIRVKGENFYRDSKRVQFLNMYKSGKAIKNKHGDVIRAADYQDTTIPDARVQPDRRWFGNTRVISQDALQHFRDALGETQKDTYQVLLRRNKLPMSLLDEKDSTESPRARILETESFDQTFGPKAQRKKPRVAASSLEELVQATEEENKTYEEKEELKATLGLMGKQEDEENGWTQVTKEAIFSKGQSKRIWNELYKVIDSSDVVIHVLDARDPLGTRCKSVEEYMKKETPHKHLIYVLNKCDLVPTWVAAAWVKHLSKDRPTLAFHASITNSFGKGSLIQLLRQFSQLHTDRKQISVGFIGYPNTGKSSIINTLRKKKVCQVAPIPGETKVWQYITLMKRIFLIDCPGIVPPSTKDSEEDILFRGVVRVEHVSHPEQYIPGVLKRCQTKHLERTYEISGWKDATDFIEMLARKQGRLLKGGEPDESGVSKQILNDFNRGKIPWFVIPPEKEEDKKRKLDEEEVKSAKMQKVKD

SEQ ID NO: 13335 - protein, 262 aa, Ehrlichia ruminantium str. Gardel
MNDNYMINPKKELSQCFIHSTDITDKIVNYAGNISNFSIIEIGPGLGTMTYSILKKNPKKLISIEKDSRLLPIHDKIIKEFQGKYEFILSDALDIDLRNIAKPPVKVIANLPYSIATLLLIKWINYINFFHSFTLMFQKEVADRIIAQPNNKNYGTLSILTQLFADVYKMQDFGPEIFSPKPKVFSSVINIVVLPQPRFDVNYDKLRKIVKITFNQRRKMIRSTLKQITNNTDEILHSLNIPNNLRPENLSIKQFCDIANCI

SEQ ID NO: 13336 - protein, 240 aa, Ehrlichia ruminantium str. Gardel
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSKSFPKNGKFIIAYEPVWAIGNNKIPSTDVIIEALEIIRSYDYVSDIIYGGAVNHTNVGDIVSINQLSGVLVGSASLDMESFFNIICSAINVGQS

SEQ ID NO: 13337 - protein, 204 aa, Debaryomyces hansenii CBS767
MSAKFVSIPEAIEAFKNGEYLIVMDDESRENEGDLIMSAELMTQEKMAFLVRYSSGYVCVPLSTERADALNLHPMLANETDRHGTAYTVTCDYADGTTTGISAHDRALTSTKLADPNSKPVDFIRPGHILPLRAVPGLLKKRRGHTEAGVQLCELAGLQPAAVICEMVRDEDGLMMRLDDCTKFSKTHNIKMITIEQLVEHISQ

SEQ ID NO: 13338 - protein, 150 aa, Pediococcus pentosaceus ATCC 25745
MGDLPMSTEKSLILVKPDGVQCGHIGHVISRIENRRYEIKALKMVNATEEQLRQHYSQLVDKPYYADIEKFMTSGPIVAIIAEGNEIIDTFRKMAGPTNPSEAMAGTIRGDFARAWGPGPIKNVVHSSDSVESAEKEIKIWFPERINTEN

SEQ ID NO: 13339 - protein, 298 aa, Xanthomonas oryzae pv. oryzae KACC10331
MSPHQSLVKGAAMTTPVASTPSSSSSDVARIAFVGGGNMARSLIAGLIRQGMPAASIRVAEPVAELRDALARDFGVQVVEDARTAVDAAATWVLAVKPQVLPTVCAQLAELAQAQQPLLVSIAAGITATQLQRWSGGDIAVVRAMPNTPALLGAGVTGLYANARVSDPQRQQATRLLDSAGVTVWIDDEAQMDAVTAVSGSGPAYVFLLAEAMEAAAQAQGLPAETARTLVLQTLLGAARMLTESGEAPDVLRRRVTSPNGTTHAAIETFQAGGFEALTANAIAAATERGRSLSAAND

SEQ ID NO: 13340 - protein, 452 aa, Nostoc punctiforme PCC 73102
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 13341 - protein, 479 aa, Shewanella oneidensis MR-1
MFRRTKIVTTLGPATDRDDNLRRIIAAGANVVRLNFSHGSPEDHLKRATQAREIAKELGVHVAILGDLQGPKIRVSTFKDNKKIQLKLGQTYILDAELAKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASDEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCVGAESHPSVKVSKHRLDARFTSVEETIALSTMYAANHLEGVKAIIALTESGATPKLMSRISSSLPILGLSRHDTTLAKMALYRGVLPIYFDSTIYPADELAQKALESLTKAGYLHSGDLVLMTKGDAMETIGGTNTCKVLIVA

SEQ ID NO: 13342 - protein, 540 aa, Saccharophagus degradans 2-40
MRSQPWWRGAVIYQIYPRSFMDTNADGVGDIPGIVQKLDYIASLGVDAIWISPFFKSPMHDFGYDISDYRDVDPLFGTLDDFDLLIDEAHKRGIKVMIDQVLSHTSAEHEWFKESRQSRDNPKADWYVWADPNEDGTPPNNWLAIFGGSAWEWDSRRGQYYLHNFLKSQPDLNFHCEDVQNQILQEVEFWLKRGVDGLRLDAINFCFHDKQLRNNPPKSASERKARGFSEDNPYAFQWHTYNNTQPENLAFLQRLRSLMDKYPNTVTLGEISSDDSLATMAEYTADNDKLHMAYSFELLADEFSAAYIRETVGTLESRLNDGWPCWSIGNHDVPRVASRWGKEDACDALSIVLNAMLLSLRGSVCCYQGEELGLKEAELTFEQLQDPYGITFWPKFKGRDGCRTPMPWDSQQHAGFSNGAPWLPVADDHKAKNVTVQQQADLSVLQAYKQFIAWRKTQPEILYGDIAFLSSHESTLAFTRSYEGSTLFAAFNLSNTEQVVNLPAGEWTALEGHGLSAAVSATQITLPPFGGFFAKQASNS

SEQ ID NO: 13343 - protein, 466 aa, Leptospira interrogans serovar Lai str. 56601
MRSVTGFYPRKGKKGYNRFWLSNEGIEHEIVEYSEKEAFEDTANPIWILRHSLGVDQGEEDYSSYDFERYITADRKTDLEKFVTKKGIKDLVYKGLKVPIPASHYSHAVGPIHAGVIEPGHFRFIVKGEEIRSLDIRLGFQKRGLIDLIKGKGPKDSIPYAEAISGDSTISYAIAFSRIFEEAQNIAVPQELDFARLVLLELERVATHIGDMGAIAGDIGYYPLQGVCSLQRGIPLGVMEALTGNRFGRGALSPGKIFFRKGLDRNKLKELSERIRSVTEEVVGHFERAAGRSTNRERLQSCGVIRQKQVRHLGFIGMVEKCTGLNRDLRNLEKSYAFSSPISLELNRDQMRGDAWARFYLRYEELKNSSKWLVEAIPKLEAALDLKFGKSNPVKKGTYYSAVEGWRGPVLVSLDLDSNGTIENAYIREVSVPNWHALELAVRGEYIGDFPLNNKSFNLSYVGVDL

SEQ ID NO: 13344 - protein, 128 aa, Glycine max
PGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 13345 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETW

SEQ ID NO: 13346 - protein, 486 aa, Rhodopseudomonas palustris CGA009
MNVHQRYAMGDSLAAKHGLWSEEQIDAAARVRRIAEEQGLETIRFSFPDQHGILRGKTLVASEALNCLDNGATITTTMLAKDTSHKTVFPVFQAGGGFGMSEMQGGADVVMLPDPTTFRVLPWAPTTGWVLCDLYFADGRPVQFATRNIYRAALQKLAARGYDYKAGLEVEFHVFKVVDSKMRPEHAGQPGEPPEVSLLSHGYQYLTEQRYDQMEPVLELIRRDVVALGLPLRSIEVEFGPSQCEFTFQPTVGLLPADLMVLFRAAVKQICRRHGYHATFMCRPRIPNVVSSGWHLHQSVVARDGGRNAFMSDSDVLSDFGRHYLAGLMTHARAATVFTTPTINGYKRYRSYSLAPDRAIWGRDNRGVMLRVLGGAGDKATRIENRVGEPAANPYLYMASQILSGLDGVDRALDPGPSADTPYETKADLLPKSLREAIFALRDDPFFRTALGDEFVDYYTFIKNAEIERFQAEVTEWEQREYFEMF

SEQ ID NO: 13347 - protein, 320 aa, Magnaporthe grisea 70-15
MSSLIPGSNTFNPDKDIPDLSGKHYIVTGGSAGIGFGIAAHLLQHKADNVTILSNKEEHAQSALEELKEYGDASKAHWVKCDFEDLKFTEKVANELARSQDKLDGLVLNAGLGVGVYNETKDKIDSHFQVNILSQFLLLKKLLPRLQKTPGARLVFESSDLHKAADGGAQFKDEAEINNDIGPTQLYNRTKLALILLARALQRRKEAGELGFQPGQSVFINAVHPGAVATDQQLQAEEAYGTLGVVGHAIVRPFLKDPVSQGCRPALFATTSKEIEEQEISGQYIVPDKKVTSPSSKAQDDELGERLWNLMEQMLKDRLG

SEQ ID NO: 13348 - protein, 501 aa, Ehrlichia chaffeensis str. Arkansas
MTNHSVILCILDGWGNSENSQFNAIAQSYKPCWDNTILQYPKSQLITHGLNVGLPDGQIGNSEVGHVNLGSGRIVLQDLCKINNEIKYIKNNRYLLEFIKKIKQNNGICHIAGLLSDGGVHSLHTHMLDIIDTLSNFQIQIAVHIFLDGRDTPPISAIKYINILREHIKHLNNVNIATISGRYYSMDRDNKLDRTRTAYKAMAFADAKRYTDPSLAIQDSYNAGITDEFILPCVIGDYNGMNPQDGFIMTNFRSDRAIQIIKMIIGDIKTDNHITLENTIGMVKYSESINIPCLFPNNNITNTLGEVIANHKLHQLRIAETEKYAHVTFFFNGGREDTFENEDRIIIPSPSVTTYNLMPEMSAKEVTNTVIERIKLQKYSLIILNYANADMVGHTGNIEATKQAITALDQCLNKILNCIQGTNYVLVITADHGNAEEMFDVKNNMPYTAHTLNPVPFIICNYSKQIRLKNGRLCDVAPTILEILNIEKPKEMTGISLIEYI

SEQ ID NO: 13349 - protein, 545 aa, Shewanella sp. MR-4
MEPAILIITLICGMLVSRIGLPPLIGYLVAGFVLFVFGIEKESLPLLQELANLGVTLLLFAIGLKLDIRSLFKAEVWAGSSIHLVLSMVLFIPILKILGLIGLSQLDGLSVAQLSLIAFALSFSSTVFAIKVLEDKGDVQSLYGRVAIGILIMQDIFAVVFLTISKGAVPSVWALALLLLPLAKPLIYKAFDRVGHGELLVLFGLVMALVVGAWLFESVGLKPDLGALIIGILLAGHKKASELAKSLFYFKELFLVAFFLTIGLNGLPTVSDVVLAALLVLLVPLKILLFVYILTRFKLRSRTSMLASFNLGNFSEFGLIVAAVATSKGWLPPQWLVIIAVALSFSFLFAAPLNATVGNIYQRFQQRLIRLEKPPLHPEDRPIAIGNPRFLILGMGRIGSGAYDELRARFDGEILGIEHKQELVDLHRANGRNVVQGDAADTDFWEKLDKAPNLELVLLAMPHHTGNLFAVEQLKKLNYQGKLSAIVQYGDDAASLRTSGVHSVYNLYEAAGAGFVDHVIHELLPDSETRAAVEANAEDTNSRTA

SEQ ID NO: 13350 - protein, 643 aa, Candida glabrata CBS 138
MAKEKDVIGGHAAKLEELLGAVRREFEAVSQEVSSYQQQNQKNYDFKINQQLAEMQQIRNTVYELELTHRKMKDVYEEEIGRLKAEIEKRDQQLSEFGAHSAAPPQPALPAPQITAEGTHLQDSKAGLTPLVSVLSSQNQAQAQAQAQAQAQAQAQAQAQAQAQAQAQAQAQAQAQAQAQAQAQAQAQAQAQAVHAAQVAQQTPAAQYQMTLPPMQQPQQYQQGYQLNSMSPQQAKTEPVDKKPETQVATTTATAEKQETAYNQWANQAKPIPPFLLDLDAENTSAEFKKQTEDYYVLYNPTQPKDIDIELHRTLLHDSVVCCVKFSNNGEYLATGCNKTTKIFEVATGNLVTELVDDTKTGTEDANSASSADLYIRSVCFSPDGKFLATGAEDKLIRIWDIAQRKIVMVLRGHEQDIYSLDYFQSGNKLVSGSGDRTIRIWDLHTGQCSLTLSIEDGVTTVAVSPGNGNYVAAGSLDRTVRVWDSNSGFLVERLDSEGETGVGHKDSVYSVVFTRDGKNIVSGSLDRSVKLWNLRNINGASTSPQPKTEGNCEMTYIGHKDFVLSVTTTENDQYILSGSKDRGVIFWDKVSGVPLLMLQGHRNSVISVAVANGKPLGANYNVFATGSGDCKAKIWKFQTIRK

SEQ ID NO: 13351 - protein, 286 aa, Enterococcus faecalis
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRKMSRFCKFGKLHVTKGNVDKLLGILLTASKELKRSLAPTGNL

SEQ ID NO: 13352 - protein, 327 aa, Pediococcus pentosaceus ATCC 25745
MGNKTSQKVLLELLKDRDRWVSGNEIADSLGVTRETIWKNINLLKKRGHQIQSQKNLGYKYESSSKLDEVVINFYKNKSVDHVAVEEQVDSTQMYAKNYLATHQVEKAFAVISEQQTQGYGRRGRSFYSPKEQGLYFSIVIPKPTFEINQVGLITTGVAYVIAQTFKDFFPEREFKLKWVNDILMNRRKVAGIITEAITEVESASTQAFVIGVGINLTTPEFPEELQQKAGAIVAKNEPNIDRNLIAAQLINTIVDNWQNYLDGSFLSEYRRMSIVIGKPVTLQVGTKQVKGIATDINEYGNIVVKLDDGQVKAFNNGEITKVNLDW

SEQ ID NO: 13353 - protein, 954 aa, Pseudomonas syringae pv. tomato str. DC3000
MTDRIELTTANEFIARHIGPRAADELAMLHTLGFDSIEALSDSVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADETELGDVSDYFGALLQYPASNGDVFDYRELAERFHGANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHHLTAILAEGLSQLGLNAEQAYFFDSLTLHTGGRTAALHAAARARHINLREIDDQRLGLSLDETTSQSAVEVLWDIFASTGQTLPDFTALAASVKSRLPAALLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKALQHREQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMQRKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVEDGTLDKDDNPLKNAPHTAAEIVGQWSHPYSREQAVYPVDSLIENKYWPPVGRVDNVFGDRNLVCACPSIESYQEA

SEQ ID NO: 13354 - protein, 139 aa, Pisum sativum
NTDITSITSNGGRVKCMQVWPPIGKKKFETLSYLPPLTRDQLLKEVEYLLRKPWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 13355 - protein, 265 aa, Pinus strobus
RENYTVMHLDLASLESVRQFVDNFRQSGRPMDVLVCNAAVYLPTAKVPTFTAEGFELSVGTNHLGHFLLSRLLLEDLKKSDFKSKRVIIVGSITGNTNTLAGNIPPKANLGDLRGLSARLNGVNSSPMIDGGEFDGAKAYKDSKVCNMLTMQEFHRRYHEETGITFASLYPGCIATTGLFREHVPPFRLLFPPFQKYITKGFVSEEEAGKRLAQVVSDPSLTKSGVYWSWNNDSASFENQLSEEASDPGKARKVWEISEKLVGLA

SEQ ID NO: 13356 - protein, 107 aa, Zea mays
TRPAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 13357 - protein, 397 aa, Alkaliphilus metalliredigenes QYMF
MKVELSKKGLSVSSSITLAIDSKAKQMKAEGMNVISFGVGEPDFQTPDYIKQAAIKAIEEKSIGYTPAPGMLQLRQSICNKLASDNELEYLPQHIIVSNGAKHSVYNIFQAVCNPGDEVIIPVPYWVSYPEHVKMADAIPVYIDCPEENDFKMKPEDFLAAISSKTKAIILNSPSNPTGAVYSKKELEQIAKIAVDHNILVVSDEIYEKLIYGNEKHVSIASLNSEIKDLTIVINGMSKGYAMTGWRIGYTASNSEIAKIMSNIQSHATSNPNTVAQYASIEALERDQSSIETMRLAFDERRKYMINRVNEIQNLSCIAPNGAFYIMMNISQLIGKVVDGKIINGSMDFAEVLLDRTHVAVVPGIAFGVDHLVRLSYANSMENITEGLNRIDKFLNE

SEQ ID NO: 13358 - protein, 270 aa, Glycine max
INVSLVAEAESALILVRHGESLWNEKNLFSGCCSVPLTNRGVEEAIEAGQRISYIPIDMIFTSALIRAQMTALLAMTRHSQKKVPIIIHDESEQATTWTQVYSEKTTKQSIPVITAWQLNERMYGELQGLNKQETAERYGKEKVHEWCRSFDIPLPKALYWIFYDTDILLGIETYEISTGIEPPLKSGKHVMVAAHGNSLRSIIMYLDGLTSQEVTSLEISTGIPLLYIYKEGKFNSRGSPVGPTEAGVYAYTQSLAVYRQQLDDMSSCY

SEQ ID NO: 13359 - protein, 103 aa, Triticum aestivum
KGLKLFQCPKDLAQEHYKDLKERPFFPNLIDYITSGPVVCMAWEGDGVVASARKLIGATNPLQAEPGTIRGDLAVQTGRNVVHGSDSPDNGKREIGKFCQWRI

SEQ ID NO: 13360 - protein, 261 aa, Actinophrys sol
EAPLNPKANRERMTQIMFETFNVPAMYVNIQAVLSLYASGRTTGCVLDSGDGVSHTVPIYEGYALPHAIVRLDLAGRDLTDYFMKILTERGYSFTTTAEREIVRDVKEKLTYVALDFDEEMKKAAESSELEKSYELPDGNVIVIGNERFRCPEVLFQPSFIGKEAAGIHDCTFQTIMKCDVDIRKDLYANIVLSGGTTMFPGIAERMTKEITALAPSTMKIKVVAPPERKYSVWIGGSILASLSTFQQMWISKAEYDESGP

SEQ ID NO: 13361 - protein, 1061 aa, Oryza sativa
MASCRRPAPLRLVVFLAIVLLRWSTNGNATAGGDDALRGDALALVRLRASLRCHAHALRDWSAGNVAAVCAWTGVRCAGGRVVSVDVANMNVSTGAPVSAAVAGLDALANLSLAGNGIVGAVTASALPALRFVNVSGNQLGGGLDGWDFASLPSLEVFDAYDNNFSSPLPAGVVALRRLRYLDLGGNFFSGEIPAAYGGMAALEYLSLNGNNLQGAIPPELGNLTSLRELYLGYYNVFDGGIPPELGRLRNLTMLDISNCGLSGRIPPELGALAALDTLFLHTNQLSGAIPPELGNLTALTALDLSNNALTGEVPATLASLTSLRLLNLFLNRLHGPVPDFVAALPRLETVQLFMNNLTGRVPAGLGANAALRLVDISSNRLTGMVPEMLCASGELHTAILMNNFLFGPIPASLGSCSSLTRVRLGQNYLNGTIPAGLLYLPRLNLLELQNNLLSGDVPANPSPAMAAASQSSQLAQLNLSSNQLSGPLPSSIANLTALQTLLVSNNRLAGAVPPEVGELRRLVKLDLSGNALSGTIPAAIGRCGELTYLDLSKNNLSGAIPEAIAGVRVLNYLNLSRNQLEEAIPAAIGAMSSLTAADFSYNDLSGELPDAGQLGYLNATAFAGNPRLCGPLLGRPCGYGGGGAAAVGAGGSSSAPVVTTRQRAAGGDFKLVLALGLLVCSVVFAAAAVLRARSCRGGGGPDGGGAWRFTAFHKVDFGIAEVIESMKDGNVVGRGGAGVVYVGRTRSGGSIAVKRLNTSSSAAAAGGGEAARHDHGFRAEIRTLGSIRHRNIVRLLAFCSRRGGSGGGEAASSSNVLVYEYMANGSLGEVLHGKGGGFLSWDRRYRIAVEAARGLCYLHHDCSPMIVHRDVKSNNILLGDNFEAHVADFGLAKFLRSGGGATASSECMSAVAGSYGYIAPEYAYTLRVDEKSDVYSYGVVLLELITGRRPVGDFGEGVDIVQWTKRVTDGRRESVHRIVDRRISTVPMDEVAHIFFVSMLCVQENSVERPTMREVVQMLSEFPRHGSDQPSPSSSAPETGEESSPEKEPNCYKLFPDLLT

SEQ ID NO: 13362 - protein, 358 aa, Glycine max
MSSFKSKYQDELIANATYIGTPGKGILAADESTGTIGKRLASINVENVETNRRILRELLFTAPGCLECLSGVILFEETLYQKSAAGVPFVDILKKGGVLPGIKVDKGTVELAGTNGETTTQGLDDLAQRCKKYYEAGARFAKWRAVLKIGPNEPSPLSIHENANGLACYAAICQENGLVPIVEPEILSDGPHDIAKCADVTERVLAACYKALNDHHVLLEGTLLKPNMVTPGSEAARVTAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 13363 - protein, 268 aa, Oceanospirillum sp. MED92
MSKKPVAHKARKRFGQNFLHDHGIIRRIIRSIAPHETDTMVEIGPGLGALTEELLAEAGELDAIELDRDLPPILRTKFFSYGDKFRIHEADAMKFDFTQLRRSEKRLRIVGNLPYNISTQLIFHLLSHADDVEDMHFMLQKEVVDRMAAGPGENNYGRLGIMAQYFCKVESLFVVPPGAFNPAPKVDSAIIRLTPYRELPYVADEVEQLQTVVRTAFNMRRKTLRNNLKPLLSAEEIEALNIDPGLRPEKLPISDFVAISNYLSKKKS

SEQ ID NO: 13364 - protein, 294 aa, Listeria monocytogenes
MTKTLQDRMILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE
